(12) United States Patent
Qian et al.

(10) Patent No.: US 9,644,005 B2
(45) Date of Patent: May 9, 2017

(54) **DIDEMNIN BIOSYNTHETIC GENE CLUSTER IN *TISTRELLA MOBILIS***

(71) Applicant: King Abdullah University of Science and Technology, Thuwal (SA)

(72) Inventors: Pei-Yuan Qian, Hong Kong (CN); Ying Sharon Xu, Hong Kong (CN); Pok-Yui Lai, Hong Kong (CN)

(73) Assignee: King Abdullah University of Science and Technology, Thuwal (SA)

( * ) Notice: Subject to any disclaimer, the term of this patent is extended or adjusted under 35 U.S.C. 154(b) by 0 days.

(21) Appl. No.: 14/346,068

(22) PCT Filed: Sep. 21, 2012

(86) PCT No.: PCT/IB2012/002361
§ 371 (c)(1),
(2) Date: Mar. 20, 2014

(87) PCT Pub. No.: WO2013/041969
PCT Pub. Date: Mar. 28, 2013

(65) Prior Publication Data
US 2014/0296161 A1  Oct. 2, 2014

Related U.S. Application Data

(60) Provisional application No. 61/537,416, filed on Sep. 21, 2011.

(51) Int. Cl.
| | | |
|---|---|---|
| *C07K 11/02* | (2006.01) | |
| *C07K 14/195* | (2006.01) | |
| *C12R 1/01* | (2006.01) | |
| *C12P 17/18* | (2006.01) | |
| *C12N 15/52* | (2006.01) | |

(52) U.S. Cl.
CPC ............ *C07K 11/02* (2013.01); *C07K 14/195* (2013.01); *C12N 15/52* (2013.01); *C12P 17/188* (2013.01); *C12R 1/01* (2013.01)

(58) Field of Classification Search
None
See application file for complete search history.

(56) References Cited

U.S. PATENT DOCUMENTS 4,950,649 A    8/1990  Rinehart ................. 514/3.7

FOREIGN PATENT DOCUMENTS

| JP | 2012240974 | * | 5/2011 |
|---|---|---|---|
| WO | WO-91/04985 A1 | | 4/1991 |
| WO | WO 9850048 | | 11/1998 |
| WO | WO 0176616 | | 10/2001 |

OTHER PUBLICATIONS

Sen et al. Appl Biochem Biotechnol. Dec. 2007;143(3):212-23.*
Chica et al. Curr Opin Biotechnol. Aug. 2005;16(4):378-84.*
Hsu et al., "Addition of Autotrophic Carbon Fixation Pathways to Increase the Theoretical Heterotrophic Yield of Acetate", The Fourth International Conference on Computational Systems Biology (ISB2010), Suzhou, China, Sep. 9-11, 2010, pp. 314-322.*
Jou et al., "Total Sythesis of Dehydrodidemnin B. Use of Uronium and Phosphonium Salt Coupleing Reagents in Peptide Synthesis in Solution", J. Org. Chem., 62:354-366, 1997.
Vera and Joullie, "Natural Products as Probes of Cell Biology: 20 Years of Didemnin Research", Medical Research Reviews, 22(2):102-145, 2002.
Marahiel et al., "Modular Peptide Synthetases Involved in Nonribosomal Peptide Synthesis", Chem. Rev., 97:2651-2673, 1997.
Tsukimoto et al., "Bacterial Production of the Tunicate-Derived Antitumor Cyclic Depsipeptide Didemnin B", Journal of Natural Products, 74(11):2329-2331, 2011.
Xu et al., "Bacterial biosynthesis and maturation of the didemnin anti-cancer agents", Journal of the American Chemical Society, 134(20):8625-8632, 2012.
Shi et al., "Tistrella mobilis gen. nov., sp.nov., a novel polyhydroxyalkanoate-producing Bacterium belonging to α-Proteobacteria", J. Gen. Appl. Microbiol., 48(6):335-343, 2002.
Cui et al., "Predominant strains of polycylic aromatic hydrocarbon-degrading consortia From deep sea of the Middle Atlantic Ridge", Acta Microbiologica Sinica, 49(7):902-909, 2009.
Rinehart et al., "Didemnins: antiviral and antitumor depsipeptides from a Caribbean Tunicate", Science, 212(4497):933-935, 1981.
Crampton et al., "Biochemical and cellular effects of didemnins A and B.", Cancer Res., 44 (5):1796-1801, 1984.
Hossain et al., "Crystal and molecular structure of didemnin A, an antiviral depsipeptide", Internat. J. Peptide Protein Res. 47(1-2):20-27, 1996.
Schmidt et al., "Total synthesis of the didemnins—2. Synthesis of didemnin A, B, C and prolyldidemnin A", Tetrahedron Lett., 29(35):4407-4408, 1988.
Rinehart et al., "Didemnins and tunichlorin: novel natural products from the marine tunicate Trididemnum solidum", J. Nat. Prod. 51(1):1-21, 1988.
Rinehart, 2nd Euroconf. Marine Nat. Prod., 1999 Santiago d. Comp.
Guyot et al., "Isodidemnine-1, a cytotoxic cyclodepsipeptide isolated from the tunicate, Trididemnum Cyanophorum (Didemnidae)", Acad. Sci. P Ser. II, 305(8):681-686,1987.
McKee et al., "The complete spectral assignment of didemnin B and nordidemnin B", Tetrahedron Lett., 30(23):3053-3056, 1989.
Sakai et al., "Seven new didemnins from the marine tunicate Trididemnum solidum", J. Am. Chem. Soc., 117:3734-3748, 1995.
Abou-Mansour et al., "Tyr5didemnin B and [D-Pro4]didemnin B; Two new natural didemnins with a modified macrocycle", Tetrahedron, 51(46):12591-12600, 1995.
Boulanger et al., "The complete spectral assignment of didemnin H a new constituent of the tunicate Tirdidemnum Cyanophorum", Tetrahedron Lett., 35(25):4345-4348, 1994.
Banaigs et al., "[Hysp2] and [Hap2]Didemnin B, two new [Hip2]-modified didemnin B from the tunicate Trididemnum cyanophorum", Tetrahedron, 55:9559-9574, 1999.
Xu et al., "Bacterial Biosynthesis and Maturation of the Didemnin Anti-cancer Agents", J. Am. Chem. Soc, 8625-8632 2012.

* cited by examiner

*Primary Examiner* — Christian Fronda
(74) *Attorney, Agent, or Firm* — Smith, Gambrell & Russell, LLP

(57) ABSTRACT

A novel *Tistrella mobilis* strain having Accession Deposit Number NRRL B-50531 is provided. A method of producing a didemnin precursor, didemnin or didemnin derivative by using the *Tistrella mobilis* strain, and the therapeutic composition comprising at least one didemnin or didemnin derivative produced from the strain or modified strain thereof are also provided.

2 Claims, 16 Drawing Sheets

Didemnin B and its monomers

Didemnin X

*Nordidemnin B*

*Dehydrodidemnin B (Aplidine)*

DIDEMNIN BIOSYNTHETIC GENE CLUSTER IN *TISTRELLA MOBILIS*

This application is a U.S. §371 national phase filing application from PCT International Application Serial No. PCT/IB2012/002361, filed Sep. 21, 2012, which claims priority to U.S. Provisional Patent Application Ser. No. 61/537,416, filed Sep. 21, 2011, both of which applications are incorporated by reference herein in their entirety.

TECHNICAL FIELD

The present invention generally concerns the fields of cell biology, molecular biology, bacteriology, and medicine. In particular aspects, the invention concerns direct or indirect production of anti-cancer compounds in bacteria.

BACKGROUND OF THE INVENTION

The didemnins (FIG. 1) are a group of cyclic depsipeptides with extraordinary biological activities, including antitumor, antivirus and immunosuppressive activities (Vera and Joullié, 2002; Rawat et al., 2006). Rinehart and his coworkers (1981) initially isolated didemnins A, B and C from a Caribbean tunicate of the family Didemnidae in 1981. Since then, more than 20 other didemnins have been isolated from tunicates collected from different geographical locations. Owing to its potent antitumor activity, didemnin B was the first marine natural product selected to enter clinical trials. Although didemnin B failed in mid-1990s, a closely related didemnin compound-dehydrodidemnin B (Aplidin) is currently in human phase II clinic trials for solid and haematological malignant neoplasias like T cell lymphoma and myelofibrosis and in phase III clinical trials for multiple myeloma (Soto-Matos et al., 2011). Until now, didemnins are exclusively isolated from the eukaryotic marine tunicates. However, since cyclic peptides are usually synthesized by non-ribosomal peptide synthetases (NRPS) from microorganisms, a microorganism associated with the tunicates would be a useful source for producing didemnins. Until the present invention, careful scrutiny of tunicate symbiotic microorganisms has not been successful to locate such a microorganism and chemical synthesis remains to be the only route to obtain sufficient amount of didemnins. The chemical reactions to synthesize didemnin A, the simplest compound of the didemnin family, are too complicated to be finished within 10 steps (Jou et al, 1997), and consequently the yield is undoubtedly very low. Therefore, the discovery of didemnin biosynthetic gene cluster from a microbe will be beneficial for producing didemnins more economically. More importantly, novel didemnin analogues can be generated through genetic engineering of the biosynthetic pathways and be investigated for their biological activities, which may in turn provide more drug leads.

BRIEF SUMMARY OF THE INVENTION

The present invention is directed to a system, method, and compositions related to production of anti-cancer compounds or precursors or derivatives thereto from a bacterium. In particular aspects, the bacterium is from the *Tistrella* genus, and in specific aspects the bacterium is *Tistrella mobilis*.

This invention relates to the production of didemnins or didemnin derivatives through the use of novel didemnin-producing bacterium and/or didemnins or didemnin derivatives produced by these species; it also relates to polynucleotide and amino acids from the novel bacterium producing the didemnins. Furthermore, the invention relates to therapeutic compositions containing the didemnins and to uses of the therapeutic compositions.

It is therefore an object of the present invention to provide novel species of didemnin-producing *Tistrella* bacteria. It is also an object of the invention to provide a novel *Tistrella mobilis* bacterium or one or more strains thereof. In specific cases, the novel didemnin-producing *Tistrella mobilis* bacterium was deposited on Jul. 27, 2011 as Accession No. NRRL B-50531 with the depository Agricultural Research Service Culture Collection, National Center for Agricultural Utilization Research Agricultural Research Service, U.S. Department of Agriculture, 1815 North University Street, Peoria, Ill. 61604, U.S.A.

An isolated or biologically pure culture of the bacterium is encompassed in the invention. A further object of the present invention is to provide didemnins, didemnin precursors, and/or didemnin derivatives produced by novel strains of *Tistrella*. In additional aspects of the present invention, there are novel amino acid and polynucleotide sequences of *Tistrella mobilis*, and exemplary sequences include SEQ ID NOS:10-61.

Any *Tistrella* species may be utilized in the invention. In specific embodiments, the following bacteria are utilized: *Tistrella mobilis* (Shi et al., 2002); *Tistrella bauzanensis* (Zhang et al., 2010), *Tistrella* sp. BZ78, *Tistrella* sp. D1-34, *Tistrella* sp. D1-36, *Tistrella* sp. D6-30, *Tistrella* sp. f-1-2, *Tistrella* sp. JW16.1a, *Tistrella* sp. MARC2PPND, *Tistrella* sp. PhS5A, *Tistrella* sp. S67-5, *Tistrella* sp. S73-3, and *Tistrella* sp. Zp5.

Specific embodiments of the invention include the isolation of didemnin B and nordidemnin B from a Gram-negative marine-derived bacterium *Tistrella mobilis*. The complete genome sequence of this bacterium revealed the biosynthetic gene cluster responsible for the didemnin synthesis. Bioinformatic analysis was used to predict the function of the genes in the cluster. Culture conditions were optimized in order to increase the yield of the target didemnin compounds.

In particular aspects, there is a process for producing a didemnin, which comprises the steps of: a) culturing at least one *Tistrella* strain in growth-supporting nutrient medium capable of promoting growth and reproduction of said bacteria, wherein said culturing is effected for a time sufficient to allow production of a didemnin; and b) recovering the didemnin from said bacteria or medium of step a).

One embodiment of the present invention is to provide a plurality of bacteria for the mass production of a didemnin or precursor or derivative thereof.

A particular embodiment of the present invention is to provide a novel process for the production of didemnins, didemnin precursors, or didemnin derivatives from bacteria. The industrial application of this process would provide renewable sources of didemnins, didemnin precursors, or didemnin derivatives for the pharmaceutical industry. In certain aspects, there is a biotransformation process in which bacteria-derived didemnins, didemnin precursors, or didemnin derivatives are converted into substances that are useful as therapeutic compounds or for the production of other therapeutic compounds. In certain aspects of the invention, didemnin B and/or nordidemnin B (for example) are produced endogenously by *Tistrella mobilis* and derivatives are made therefrom one or the other; however, in other cases other didemnins are produced endogenously by other *Tistrella* bacteria.

Aspects of the invention include methods and compositions wherein bacteria capable of producing didemnin precursors or derivatives, wherein reagents are added to their culture medium to effect production of a didemnin or the didemnin derivatives.

In accordance with the present invention there is also provided a process for improving production of didemnins, didemnin precursors, or didemnin derivatives in bacteria comprising the steps of a) culturing *Tistrella* bacteria in the presence of a mutagenic agent for a period of time sufficient to allow mutagenesis; and b) selecting said mutants by a change of the phenotype that results in an increased production of didemnins, didemnin precursors, or didemnin derivatives. The mutagenic agent may be a chemical agent, such as daunorubicin and nitrosoguanidine; a physical agent, such as gamma radiation or ultraviolet radiation; or a biological agent, such as a transposon, for example. Exemplary modifications include to the side chain region, to the hip-isostatine region, to the tetrapeptide region, and/or to the macrocyclic backbone.

In certain embodiments, there is provided a process for improving biotransformation of didemnins into didemnin derivative-producing bacteria comprising the steps of a) culturing bacteria in the presence of a mutagenic agent for a time sufficient to allow mutagenesis; and b) selecting said mutants by a change of the phenotype that results in an increased biotransformation of didemnins into didemnin derivative-producing bacteria.

In some aspects of the invention, an anti-cancer compound is produced from *Tistrella* bacteria. The compound may be isolated directly from the bacteria, or another compound may be isolated from the bacteria from which the anti-cancer compound is then synthesized, either directly or indirectly through one or more other compounds.

Embodiments of the invention include methods and compositions regarding fermentation to produce didemnins and their derivative compounds. Some embodiments include the gene cluster in *Tistrella* for producing didemnins. Although in specific cases the didemnin gene cluster includes *Tistrella* didA, didB, didC, didD, didE, didF, didG, didH, and didI; however, in particular embodiments the didemnin gene cluster includes one or more of *Tistrella* didA, didB, didC, didD, didE, didF, didG, didH, and didI. In at least certain aspects, one or more of the didemnin gene cluster may be transformed into bacteria from another genus, such as *Escherichia*; in particular, one or more of the didemnin gene cluster members may be transferred into *E. coli* for the production of a didemnin or didemnin derivative from *E. coli*, either directly or indirectly.

In particular aspects of the invention, there is included production of didemnins, didemnin precursors, or didemnin derivatives by the *Tistrella mobilis* JAM 14872T (Shi et al., 2002). *Tistrella mobilis* JAM 14872T was cultured and extracted by the same way as the *Tistrella mobilis* strain described herein, and the UPLC-HRMS profile shows that this type strain also produces didemnin B and nordidemnin B.

Anti-cancer compounds of the present invention may be useful for any type of cancer, including at least the following: breast, lung, prostate, colon, pancreatic, blood, brain, liver, spleen, esophageal, ovarian, cervical, kidney, thyroid, rectal, bone, gall bladder, stomach, and so forth. The invention may employed for any type of mammal, including humans, dogs, cats, horses, pigs, sheep, and goats.

In alternative embodiments, the compositions of the invention relate to antiviral and/or immunosuppressive compounds.

In some aspects of the invention, one or more polynucleotides in *Tistrella* (such as one of plasmids 1, 2, 3, or 4 of *Tistrella mobilis*, for example) are able to conjugate with other bacteria. In specific cases, the plasmid transfers to *E. coli* or another bacterium.

In an embodiment of the invention, there is an isolated *Tistrella mobilis* bacterium having Accession Deposit Number NRRL B-50531 with the depository Agricultural Research Service Culture Collection National Center for Agricultural Utilization Research Agricultural Research Service, U.S. Department of Agriculture. In some embodiments, there is an isolated polynucleotide selected from the group consisting of SEQ ID NO:10-25, 42-51, 62-66, and a mixture thereof. In particular embodiments, there is an isolated polypeptide selected from the group consisting of SEQ ID NO:26-41, 52-61, and a mixture thereof.

In specific embodiments, a bacterium comprises at least one genetic modification compared to wild-type, and in certain aspects the genetic modification is in a gene in the didemnin gene cluster. In specific cases, at least one genetic modification is in a condensation, adenylation, thiolation, ketoreductase, ketosynthase, methyltransferase, or thioesterase domain of a gene in the didemnin gene cluster. In certain embodiments, at least one genetic modification is in the ketoreductase or adenylation domains.

In one embodiment of the invention, there is a method of producing a didemnin precursor, didemnin, or didemnin derivative, comprising the steps of a) culturing a host cell harboring bacterial didemnin synthesis genes; and b) recovering said didemnin precursor, didemnin, or didemnin derivative from said host cell. In some cases, the host cell is further defined as a *Tistrella* bacterium, a genetically modified *Tistrella* bacterium compared to wild-type, or *E. coli*. The *Tistrella* bacterium may be *Tistrella mobilis*, in some cases. In particular aspects, the didemnin is selected from the group consisting of didemnin A, didemnin B, didemnin C, didemnin D, didemnin E, didemnin G, didemnin X, didemnin Y, nordidemnin, or a combination thereof. In some cases, the method further comprises modifying the recovered didemnin precursor, didemnin, or didemnin derivative.

In an embodiment of the invention, there is a therapeutic composition comprising in a suitable carrier: at least one isolated didemnin produced by a culture comprising bacteria having Accession Deposit Number NRRL B-50531 with the depository Agricultural Research Service Culture Collection National Center for Agricultural Utilization Research Agricultural Research Service, U.S. Department of Agriculture; at least one didemnin or didemnin derivative produced from a modified bacteria of the bacterial strain having Accession Deposit Number NRRL B-50531 with the depository Agricultural Research Service Culture Collection National Center for Agricultural Utilization Research Agricultural Research Service, U.S. Department of Agriculture; or a mixture thereof.

The foregoing has outlined rather broadly the features and technical advantages of the present invention in order that the detailed description of the invention that follows may be better understood. Additional features and advantages of the invention will be described hereinafter which form the subject of the claims of the invention. It should be appreciated by those skilled in the art that the conception and specific embodiment disclosed may be readily utilized as a basis for modifying or designing other structures for carrying out the same purposes of the present invention. It should also be realized by those skilled in the art that such equivalent constructions do not depart from the spirit and scope of the invention as set forth in the appended claims. The novel features which are believed to be characteristic of the invention, both as to its organization and method of operation, together with further objects and advantages will be better understood from the following description when considered in connection with the accompanying figures. It is to be expressly understood, however, that each of the figures is provided for the purpose of illustration and description only and is not intended as a definition of the limits of the present invention.

BRIEF DESCRIPTION OF THE DRAWINGS

For a more complete understanding of the present invention, reference is now made to the following descriptions taken in conjunction with the accompanying drawings.

DETAILED DESCRIPTION OF THE INVENTION

Figure 1A:
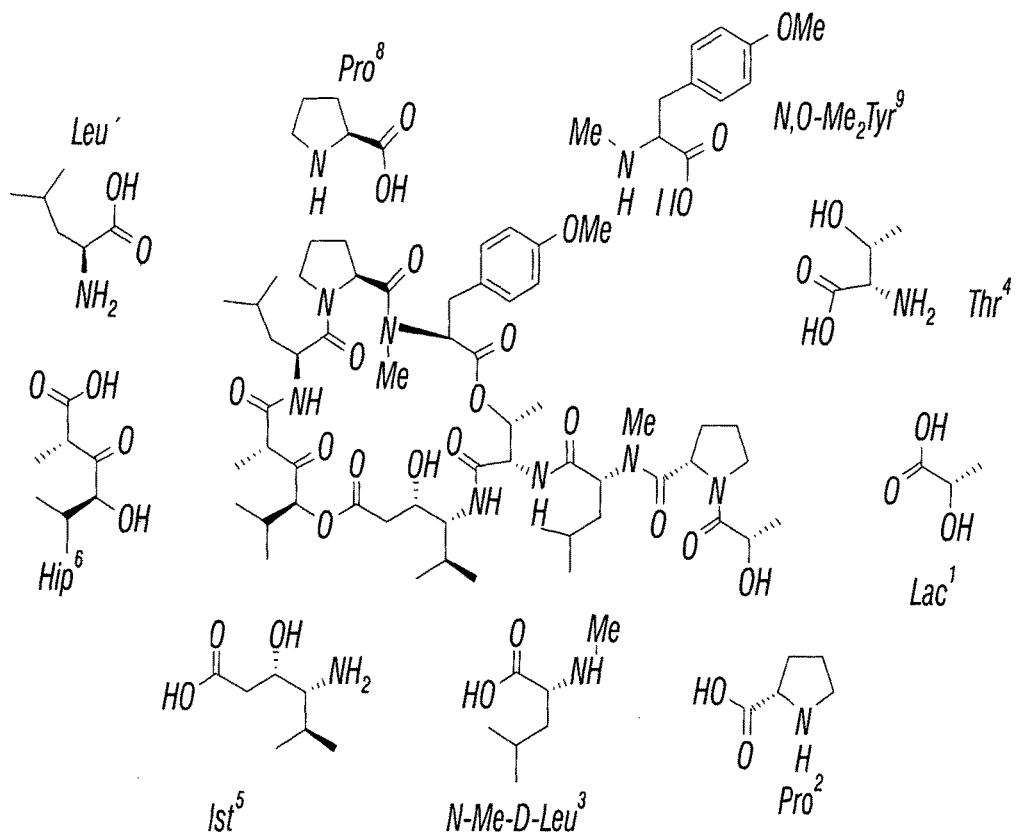
FIGS. 1A and 1B illustrate structures of didemnin B and its exemplary monomers and other representative didemnins.
Figure 1A:
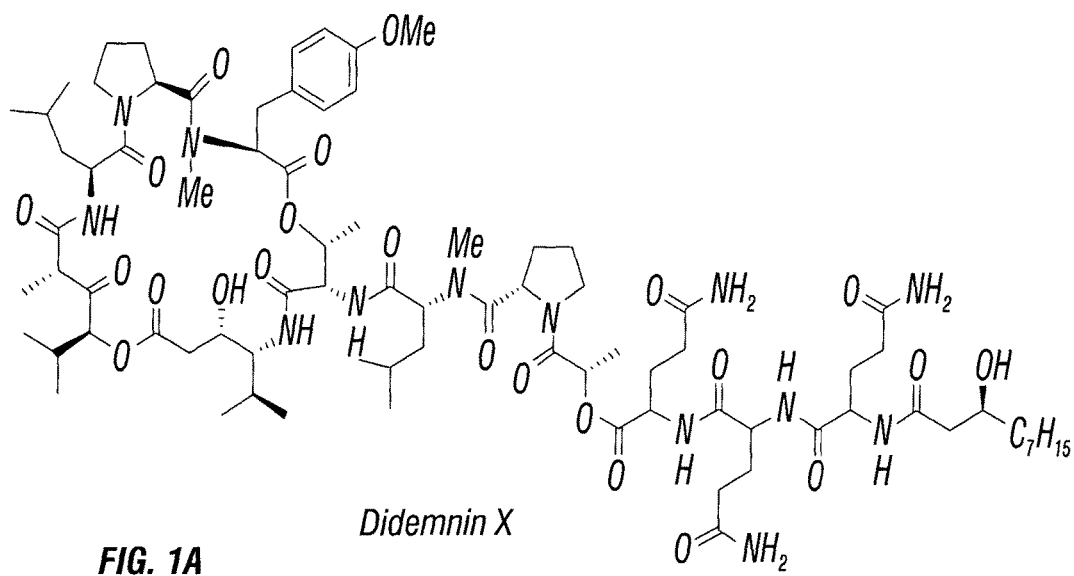
Figure 1A:
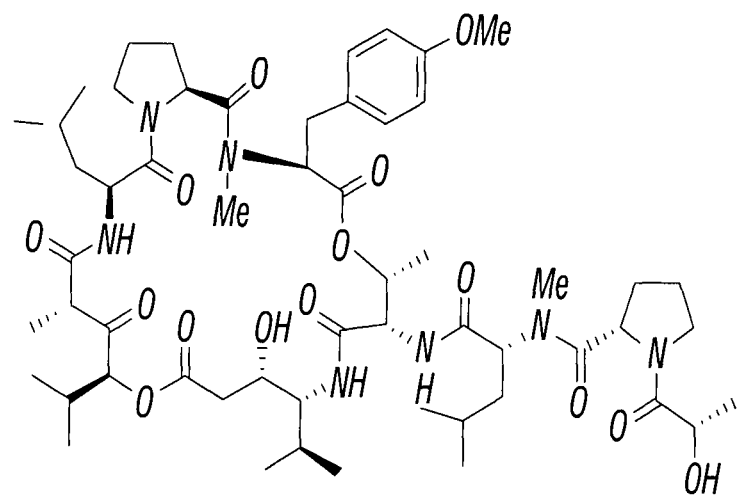
Figure 1A:
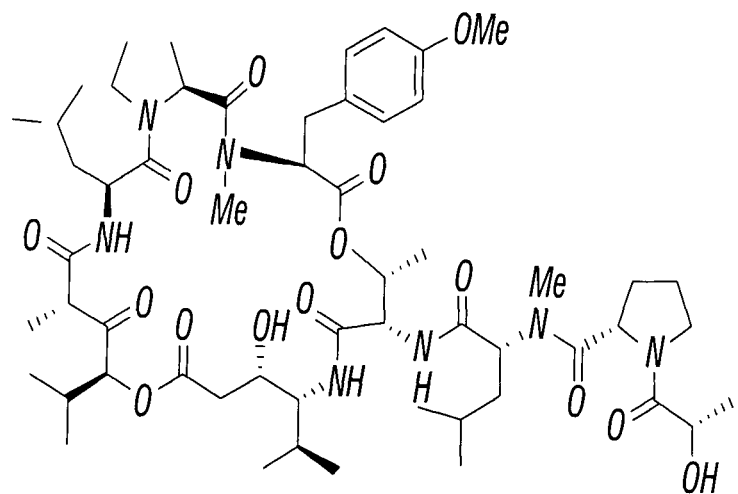
Figure 1B:
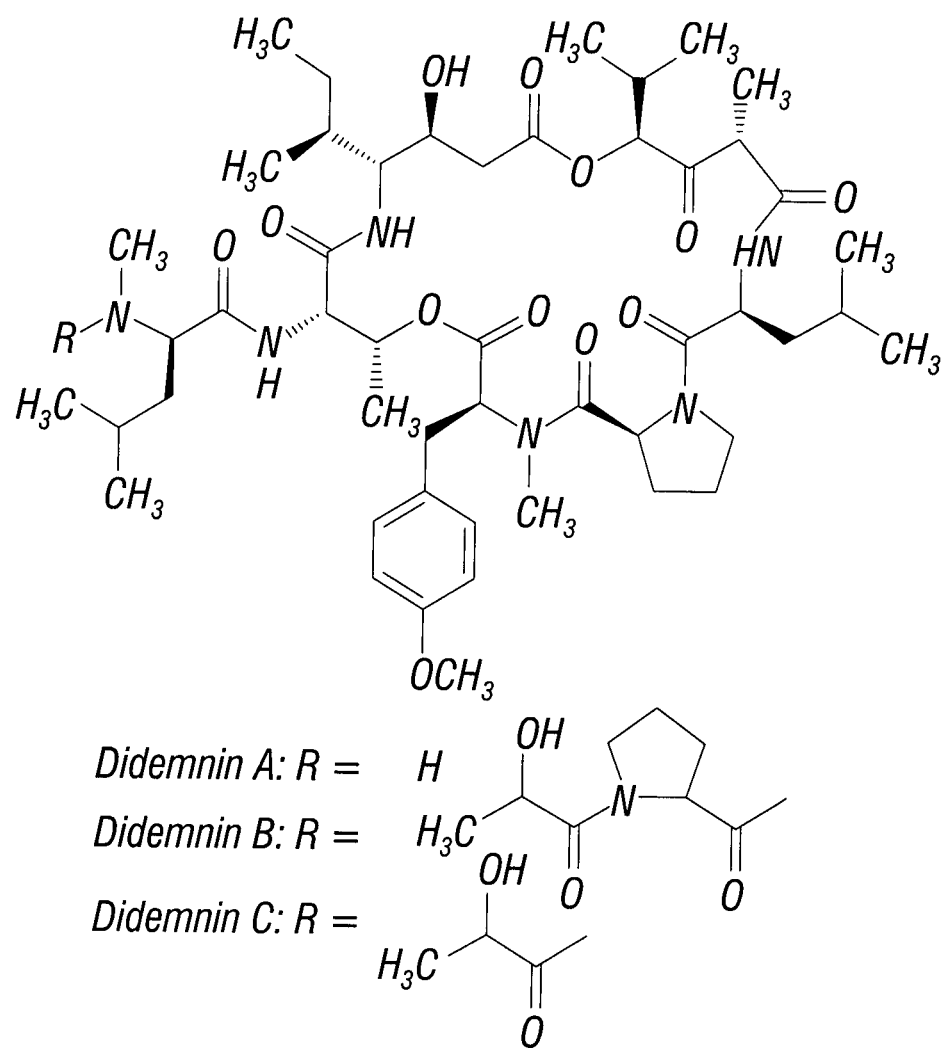

As used herein the specification, "a" or "an" may mean one or more. As used herein in the claim(s), when used in conjunction with the word "comprising", the words "a" or "an" may mean one or more than one. As used herein "another" may mean at least a second or more. In specific embodiments, aspects of the invention may "consist essentially of" or "consist of" one or more sequences of the invention, for example. Some embodiments of the invention may consist of or consist essentially of one or more elements, method steps, and/or methods of the invention. It is contemplated that any method or composition described herein can be implemented with respect to any other method or composition described herein. Embodiments discussed in the context of methods and/or compositions of the invention may be employed with respect to any other method or composition described herein. Thus, an embodiment pertaining to one method or composition may be applied to other methods and compositions of the invention as well.

I. Definitions

The definitions provided in the entire disclosure supersede any conflicting definition in any of the reference that is incorporated by reference herein. The fact that certain terms are defined, however, should not be considered as indicative that any term that is undefined is indefinite. Rather, all terms used are believed to describe the invention in terms such that one of ordinary skill can appreciate the scope and practice the present invention.

The term "didemnin" as used herein refers to a group of cyclic depsipeptides. In specific embodiments, the didemnin has antitumor, antiviral, and/or immunosuppressive activity.

The term "didemnin derivatives" as used herein refers to any molecule constructed based on modification of a didemnin compound. In specific embodiments, the didemnin derivatives have antitumor, antiviral, and/or immunosuppressive activity.

The term "didemnin gene cluster" as used herein refers to a cluster of genes responsible for the biosynthesis of didemnins.

"Effective amount," "Therapeutically effective amount" or "pharmaceutically effective amount" means that amount which, when administered to a subject or patient for treating a disease, is sufficient to effect such treatment for the disease, including to improve at least one symptom of the disease.

The term "growth supporting nutrient medium" is intended to mean any culture media which include, without limitation, carbon sources, nitrogen sources, amino acids, vitamins and minerals.

As used herein, the term "patient" or "subject" or "individual" refers to a living mammalian organism, such as a human, monkey, cow, sheep, goat, dog, cat, mouse, rat, guinea pig, or transgenic species thereof. In certain embodiments, the patient or subject is a primate. Non-limiting examples of human subjects are adults, juveniles, infants and fetuses.

"Prevention" or "preventing" includes: (1) inhibiting the onset of a disease in a subject or patient that may be at risk and/or predisposed to the disease but does not yet experience or display any or all of the pathology or symptomatology of the disease, and/or (2) slowing the onset of the pathology or symptoms of a disease in a subject or patient that may be at risk and/or predisposed to the disease but does not yet experience or display any or all of the pathology or symptoms of the disease. An individual at risk for cancer, for example, may be an individual with a family or personal history or that exhibits one or more known risk factors, such as certain lifestyle habits (for example, smoking) or particular gene-associated mutations (for example, BRCA1 or BRCA2 for breast or ovarian cancer) or particular elevations of a metabolite (elevated prostate-specific antigen (PSA) for prostate cancer).

II. General Embodiments of the Invention

In embodiments of the invention, there are bacteria that produce didemnins or didemnin derivatives, and in particular aspects the bacteria are from the family Rhodospirillales, although in specific aspects the bacteria are from the genus *Tistrella*.

The present invention at least provides a novel *Tistrella mobilis* bacterium; amino acid and polynucleotide sequences of the bacterium; didemnins, didemnin precursors, and/or didemnin derivatives produce therefrom; therapeutic compositions containing the didemnins, didemnin precursors, and/or didemnin derivatives; and/or methods for producing or using the didemnins, didemnin precursors, and/or didemnin derivative compositions.

III. *Tistrella Mobilis* Sequences and the Didemnin Gene Cluster

Embodiments of the invention include isolated polynucleotide and polypeptide sequences from *Tistrella mobilis*, such as those included in SEQ ID NOS:10-61. In some cases, the isolated polynucleotide and polypeptide sequences from Tistrella mobilis are involved in synthesis of one or more didemnins, whereas in other cases the isolated polynucleotide and polypeptide sequences from Tistrella mobilis are not involved in synthesis of one or more didemnins. The isolated polynucleotide or polypeptide sequences may be modified and utilized in a cell or in vitro. In certain cases, the modified polynucleotide or polypeptide sequences are utilized in a Tistrella mobilis or other bacterial or yeast cell. Isolated or modified polynucleotide sequences may be employed in an expression vector.

Tistrella mobilis gene cluster nucleotide sequences include ORF1 (SEQ ID NO:10), ORF2 (SEQ ID NO:11), ORF3 (SEQ ID NO:12), ORF4 (SEQ ID NO:13), ORF5 (SEQ ID NO:14), ORF6 (SEQ ID NO:15), ORF7 (SEQ ID NO:16), ORF8 (SEQ ID NO:17), ORF9 (SEQ ID NO:18), ORF10 (SEQ ID NO:19), ORF11 (SEQ ID NO:20), ORF12 (SEQ ID NO:21), ORF13 (SEQ ID NO:22), ORF14 (SEQ ID NO:23), ORF15 (SEQ ID NO:24), and ORF16 (SEQ ID NO:25). Corresponding Tistrella mobilis gene cluster protein sequences for the respective ORFS is as follows: ORF1 (SEQ ID NO:26), ORF2 (SEQ ID NO:27), ORF3 (SEQ ID NO:28), ORF4 (SEQ ID NO:29), ORF5 (SEQ ID NO:30), ORF6 (SEQ ID NO:31), ORF7 (SEQ ID NO:32), ORF8 (SEQ ID NO:33), ORF9 (SEQ ID NO:34), ORF10 (SEQ ID NO:35), ORF11 (SEQ ID NO:36), ORF12 (SEQ ID NO:37), ORF13 (SEQ ID NO:38), ORF14 (SEQ ID NO:39), ORF15 (SEQ ID NO:40), and ORF16 (SEQ ID NO:41).

Tistrella mobilis didemnin gene cluster nucleotide sequences include one or more of the following: DidA (SEQ ID NO:42); DidB (SEQ ID NO:43), DidC (SEQ ID NO:44), DidD (SEQ ID NO:45), DidE (SEQ ID NO:46), DidF (SEQ ID NO:47), DidG (SEQ ID NO:48), DidH (SEQ ID NO:49), DidI, (SEQ ID NO:50), and DidJ (SEQ ID NO:51). Corresponding Tistrella mobilis didemnin gene cluster protein sequences include one or more of the following: DidA (SEQ ID NO:52); DidB (SEQ ID NO:53), DidC (SEQ ID NO:54), DidD (SEQ ID NO:55), DidE (SEQ ID NO:56), DidF (SEQ ID NO:57), DidG (SEQ ID NO:58), DidH (SEQ ID NO:59), DidI, (SEQ ID NO:60), and DidJ (SEQ ID NO:61).

The whole Tistrella mobilis genome is provided by a chromosomal sequence (SEQ ID NO:62) and four minichromosomes (which may be referred to as plasmids) including plasmid 1 (SEQ ID NO:63), plasmid 2 (SEQ ID NO:64), plasmid 3 (SEQ ID NO:65), and plasmid 4 (SEQ ID NO:66).

In aspects of the invention, the endogenous Tistrella mobilis didemnin gene cluster includes polypeptides that are modular according to the particular domains they employ. They may have one or more of the following domains (one or more) adenylation (A) domain, the thiolation (T) domain, the condensation (C) domain, the ketoreductase (KR) domain, and/or the methyltransferase (MT) domain, for example. For example, didI has a C domain, an A domain, and a T domain, whereas didB has a C, A, T, and KR domain (see FIG. 3). Marahiel et al. (1997) provide a review of peptide synthetases, which is incorporated by reference herein in its entirety.

IV. Didemnins

Didemnins are cyclic depsipeptide compounds (depsipeptide is a peptide in which one or more of the amide (—CONHR—) bonds are replaced by ester (COOR) bonds). Although more than nine didemnins (didemnins A-E, G, X and Y) have been isolated from the extract of the exemplary tunicate Trididemnum solidum, in the prior art didemnin B is the one that possesses the most potent biological activities. It is a strong antiviral agent against both DNA and RNA viruses such as herpes simplex virus type 1, a strong immunosuppressant that shows some potential in skin graft and is also very cytotoxic. Although didemnin B shows strong activity against murine leukemia cells and had completed phase II human clinical trials against adenocarcinoma of the kidney, advanced epithelial ovarian cancer, and metastatic breast cancer, it exhibits high toxicity in human subjects. For review see Vera and Jouillé, 2002.

Didemnin precursors, didemnins, and didemnin derivatives are encompassed in methods and compositions of the invention. Exemplary didemnins that may be generated in the T. mobilis bacterium of the invention may be of any kind, but in specific embodiments they are didemnins A-I, M, X and Y, nordidemnin B, dehydrodidemnin B (Aplidine®), or are one or more of the didemnins described in U.S. Pat. No. 5,294,603, incorporated by reference herein in its entirety. In specific embodiments, didemnin derivatives include N-acyl congeners of didemnin A (DA); several DDB-type analogues of DA in which either pyruvic acid has been replaced (with phenylpyruvic acid or alphaketobutyric acid) or proline at position 8 has been replaced [with L-azetidine-2-carboxylic acid (AZT), L-pipecolic acid (Pip), 1-amino-1-carboxylic cyclopentane ($acc^5$), D-Pro or sarcosine (sar); and the didemnins—X [(R)-3-hydroxy-decanoyl-(Gln)$^3$-Lac-Pro didemnin A]; Y [(R)-3-hydroxy-decanoyl-(Gln)$_4$-Lac-Pro didemnin A]; M (pGlu-Gln-Lac-Pro-didemnin A); N ([Tyr$^5$] didemnin B); nordidemnin N ([Tyr$^5$] nordidemnin B); and epididemnin A ([2S,4R-Hip$^2$] didemnin A). Others include Isodidemnin $A_1$, Didemnin N, Nordidemnin N, Epididemnin A, Acyclodidemnin A, Dihydrodidemnin N, Dihydroepididemnin A, N-Acetyl didemnin A, N,O-Diacetyldidemnin A, N-(D-Prolyl) didemnin A, N-(benzyloxycarbonyl-D-prolyl) didemnin A, N-(D-Prolyl) didemnin A, N-(L-Prolyl) didemnin A, Acetyl$^9$-didemnin B, Propionyl$^9$-didemnin B, Isobutyryl$^9$-didemnin B, L-Ala$^8$-didemnin B, O-Benzyl[L-Ala$^8$]didemnin B, L-Ala$^8$]didemnin B, [D-Pro$^8$]didemnin B, O-Benzyl-[D-pro$^8$]didemnin B, [D-Pro$^o$]didemnin B, [N—(CH$_3$ONsu)didemnin A, O-Acetyldidemnin A, [HexahydroMe$_2$ Tyr$^5$]didemnin A, [Hexahydro-N-MePhe$^5$]didemnin A, [HexahydroMe$_2$ Tyr$^5$] didemnin B, [Hexahydro-N-MePhe$^5$]didemnin B, pyroglutaminyl didemnin B.

Glutaminyl derivatives as described in U.S. Pat. No. 6,841,530, incorporated by reference herein in its entirety, are also encompassed in the invention. Examples of derivatives include pyroglutaminyl didemnin B, O-Benzyldidemnin B, Benzyloxycarbonyl-L-Glutaminyldidemnin B, (Benzyloxycarbonyl-L-Glutaminy)$_2$ Didemnin, Benzyloxycarbonyldidemnin M, Benzyloxycarbony-L-Pyroglutaminyldidemnin B, Pyroglutaminyldidemnin B, Prolydidemnin A, L-(N-Benzyloxycarbonyl-pyroglutaminyl)-L-glutaminyl-didemnin B, N-Benzyloxycarbonyl-L-pyroglutaminyl-didemnin B, Boc-L-prolyl-didemnin A, L-Prolyl-didemnin B (see also US2001/0007855, incorporated by reference herein in its entirety).

In specific aspects, the didemnin is an N-acylated Didemnin A. In particular aspects of the invention, the acyl group of the N-acyl Didemnin A comprises a $C_3$ to $C_8$ group. In certain embodiments, the didemnin is a derivative of Didemnin A (optionally a synthetic derivative), modified at a position selected from the group consisting of position 1, 5, 6, and combinations thereof, by the incorporation of a D-amino acid (for example). In other aspects, the didemnin is a synthetic derivative of Didemnin A, modified to include a Dehydrodidemnin B (DDB) moiety in the linear peptide chain. In particular aspects, the didemnin is selected from the group consisting of phenylpyruv-Pro didemnin A, Pyruv-Sar didemnin A, alpha-ketobutyryl-Pro didemnin A, Pyruv-Azt didemnin A, or Pyruv-D-Pro didemnin A.

In some aspects of the invention, one increases the lipophilicity of a didemnin, such as didemnin A, in its modifications, for example to raise its solubility in the plasma membrane and in at least certain cases increase its activity. In specific aspects, the N-amine of N-methyl D-leucine positions is useful for the addition of hydrophobic groups to didemnin A, for example. From here, one can synthesize a series of N-acylated analogues of didemnin A comprising alkyl chains with 2, 3, 4, 5, 7, 11, 15 or 17 carbon atoms.

Dehydrodidemnin B derivatives which either pyruvic acid has been replaced (with phenylpyruvic acid or -ketobutyric acid, for example) or proline at position 8 has been replaced (with L-azetidine-2-carboxylic acid (AZT), L-pipecolic acid (Pip), 1-amino-1-carboxylic cyclopentane($acc_5$), D-Pro or sarcosine (sar), for example).

Exemplary hydrophobic derivatives of didemnin A may be synthesized by incorporating acyl chains therein didemnin A, ranging from 4 to 18 carbons, for example. Such compounds include N-butyryl didemnin A, N-pentanoyl didemnin A, N-hexanoyl didemnin A, N-octanoyl didemnin A, N-lauroyl didemnin A, N-palmitoyl didemnin A, or N-stearoyl didemnin A.

Three other exemplary derivatives of didemnin A include those in which the amino acids at positions 1, 5, and 6 were replaced with their corresponding D-amino acids. Exemplary compounds include D-Thr$^1$ didemnin A, D-Pro$^5$] didemnin A, and D-MeTyr(Me)$^6$] didemnin A.

Five didemnin A derivatives related to dehydrodidemnin B may be synthesized by introducing DDB-type modifications into their linear peptide chain moieties. Such DDB-type compounds include Phenylpyruv-Pro didemnin A, Pyruv-Sar didemnin A-ketobutyryl-Pro didemnin A, Pyruv-Azt didemnin A, and Pyruv-D-Po didemnin A.

Synthesis of N-acyl analogues may be carried out in solution. Acyl groups may be introduced at the N-methyl-D-leucine unit of didemnin A using a symmetrical anhydride procedure with $C_6$ to $C_{18}$ fatty acids, and an excess of symmetrical anhydride may be required in order to achieve complete acylation. Propionic butyric and pentanoic acids may be introduced using a 3-5 fold excess of their symmetrical anhydride.

The symmetrical anhydrides of fatty acids may be prepared in the conventional manner using EDC. Acylation of didemnin A may be carried out in the presence of a catalytic amount of dimethylamino pyridine (DMAP). Derivatives may be purified on a silica gel column using methanol/chloroform as a eluant. They and others may be characterized using $^1$H NMR spectroscopy and HRFABMS. Exemplary methods of synthesis of didemnin analogs is described in U.S. Pat. No. 5,294,603, which is incorporated by reference herein in its entirety.

Structure elucidation, chemical conversion, biological activities including cytotoxicity, antiviral and immunosuppressive activities and structure-activity relationships may be performed for any didemnin or didemnin derivative of the invention.

V. Production of Modified Organisms for Didemnin Precursors, Didemnins, and/or Didemnin Derivatives, and Compositions Produced Thereby In some embodiments of the invention, one or more host cells (which may be organisms) are modified to produce one or more didemnin precursors, didemnins, or didemnin derivatives. In some cases the organism is from the *Tistrella* genus, such as *Tistrella mobilis*, for example, although in other cases an organism or other cells are modified to produce didemnin precursors, didemnins, or didemnin derivatives.

A. *Tistrella*

In certain embodiments of the invention, a *Tistrella* bacterium is modified to affect the synthesis of one or more endogenous didemnins produced in the native bacterium. In some cases, the modified bacterium is genetically modified (such as by using recombinant technology to mutate or knock out one or more endogenous bacteria genes, including by transforming the bacteria with a polynucleotide construct, for example), although it may also or otherwise be chemically modified (daunorubicin or nitrosoguanidine, for example) and/or physically modified (gamma or ultraviolet radiation, for example).

For genetic modification of *Tistrella* (or other organisms), nucleic acid molecules comprising a mutation of interest or means to generate a mutation of interest) of the present invention can be expressed separately, i.e., inserted into separate vectors for expression. Such vectors are known or can be constructed by those skilled in the art and generally contain all expression elements (e.g., promoters, terminator fragments, enhancer elements, marker genes and other elements as appropriate) necessary to achieve the desired transcription of the sequences. Examples of vectors include viruses such as bacteriophages, baculoviruses, and retroviruses, DNA viruses, cosmids, plasmids, phagemids and other recombination vectors. The vectors can also contain elements for use in either prokaryotic or eukaryotic host systems. One of ordinary skill in the art will know which host systems are compatible with a particular vector. The vectors can be introduced into cells or tissues and expressed by any one of a variety of known methods within the art. Such methods can be found generally described in Sambrook et al. (1989, 1992) Molecular Cloning: A Laboratory Manual, Cold Springs Harbor Laboratory, New York; Ausubel et al. (1989) Current Protocols in Molecular Biology, John Wiley and Sons, Baltimore, Md.; Chang, et al. (1995) Somatic Gene Therapy, CRC Press, Ann Arbor, Mich.; Vega, et al. (1995) Gene Targeting, CRC Press, Ann Arbor, Mich.; Vectors: A Survey of Molecular Cloning Vectors and Their Uses, Butterworths, Boston, Mass. (1988); and include, for example, stable or transient transfection, lipofection, electroporation and infection with recombinant viral vectors. Introduction of nucleic acids by infection offers several advantages over other listed methods. Higher efficiencies can be obtained due to their infectious nature. Moreover, viruses are very specialized and typically infect and propagate in specific cell types. Thus, their natural specificity can be used to target the vectors to specific cell types in vivo or within a tissue or mixed culture of cells. The viral vectors can also be modified with specific receptors or ligands to alter target specificity through receptor mediated events.

B. Non-*Tistrella* Cells

Host cells suitable for introduction and expression of the nucleic acids of the invention may be bacterial; however, yeast (e.g., *Pichia, Saccharomyces*, etc.), mammalian, or insect host cells are also contemplated, as is a cell-free expression system. In particular embodiments, the host cell or culture is bacterial. Exemplary bacterial host cells include *E. coli* as well as *Bacillus* sp.

In cases wherein *Tistrella* is not used as a fermentation or other system for production of modified didemnin and didemnin-related compounds, the host cell may be modified to include one or more proteins suitable for production of at least one didemnin precursor, didemnin, and/or didemnin derivative. In particular, the host cell may be modified to include part or all of a didemnin gene cluster, including one or more of didA-didJ and/or ORF1-16, for example. In specific embodiments, the cell includes ORF1, ORF3, ORF6, ORF 7, ORF 8 and/or ORF 16. In particular aspects, one or more of ORF1, ORF3, ORF6, ORF 7, ORF 8 and/or ORF 16 are involved in the regulation, transport, resistance and other functions of the didemnin gene cluster. In some cases, the host cell may be modified to include a mutated did gene (compared to *Tistrella* wildtype sequence) such that a didemnin derivative may be produced, and it optionally may also include one or more of the endogenous *Tistrella* wildtype did genes. The didemnin derivative may be produced directly therefrom the modified host cell, or a didemnin precursor may be produced and additional synthesis steps may be required following purification of the precursor, for example.

C. Exemplary Modifications of Host Cells

In particular aspects of the invention, a host cell (*Tistrella* or *E. coli*, for example) is modified compared to their respective wild-type counterparts. The modification may be such that one or more endogenous polynucleotides in the host cell become mutated compared to their respective wild-type counterparts. The mutation may be of any kind, including a knockout, knockdown, point, frameshift, inversion, deletion, and so forth. The mutation may be of any kind so as to effect an altered synthesis of one or more of a didemnin precursor, didemnin, or didemnin derivative.

In some cases, one or more mutations are generated in one or more didemnin gene cluster members, including one or more of didA-didJ, and/or in one or more of ORF1-ORF16. In certain cases, a particular region of one or more didemnin gene cluster members is mutated. The region may be of any kind so as to effect an altered synthesis of one or more of a didemnin precursor, didemnin, or didemnin derivative. The affected region may be in the sequence that encodes (one or more) adenylation (A) domain, the thiolation (T) domain, the condensation (C) domain, the ketoreductase (KR) domain, and/or the methyltransferase (MT) domain, for example.

In particular aspects the A domain is modified, for example such that the A domain specificity and/or placement within the non-ribosomal peptide synthetase assembly affects the sequence of the monomers in the nonribosomal peptide. In specific cases, the particular DidA-DidJ genes is modified such that the substrate specificity is different. For example, the DidA A domain may be altered to have substrate specificity other than glutamine, DidC may be altered to have substrate specificity other than proline, and so forth (see Table 3 of predicted normal substrate specificities).

In particular cases, one can genetically modify one or more genes of the didemnin gene cluster such that the pathway generates a didemnin derivative or didemnin precursor that can then be modified following purification of the precursor. For example, one can knock out one or more genes or one or more regions of one or more genes. For example, one can knock out the ketoreductase in DidB so that the pathway produces dehydrodidemnin B. In other exemplary measures, one can replace one of the A domains with another A domain in any of the members of the gene cluster, for example. For example, one can replace one of the A domains with another A domain (for example, one that activate Valine) such that a different didemnin with a Valine residue will be produced.

In some cases, the mutation is generated in the host cell. Following this, the mutant strain can be cultured to produce the desired didemnin precursor, didemnin, or didemnin derivative, and the compound can then be purified (for example, by one or more of extraction, fractionation by normal or reverse phase liquid chromatography, size-exclusion chromatography, reverse-phase HPLC, and so forth). If appropriate, further modifications to the compound may be produced. In some cases, one can culture the mutant strain and wild-type strain and extract them respectively; then, one can compare their respective metabolites, for example by LC-HRMS (high resolution mass spectrometry) and/or NMR to identify or verify production of the expected metabolite.

In alternative embodiments, one can mutagenize a plurality of host cells (including *Tistrella* or *E. coli*) for example and performs a high throughput assay to obtain the mutant. The candidate mutants producing didemnin precursors, didemnins, or didemnin derivatives may be screened for a compound not otherwise obtained from the corresponding wild-type host cell or obtainable to much higher levels than in the corresponding wildtype host cell.

VI. Determination of Didemnin or Didemnin Derivative Structure

In embodiments of the invention, the didemnin or didemnin derivative is isolated and the structure is determined. Although one of skill in the art recognizes routine methods of purifying and determining a chemical structure, in specific cases one may use extraction (including, for example, methanol-toluene (or ethyl acetate or chloroform) extraction), silica gel, preparative thin-layer chromatrography, nuclear magnetic resonance imaging, acid hydrolysis, mass spectrometry, gas chromatography, x-ray crystallography, and a combination thereof.

VII. Exemplary Synthesis Embodiments

In certain cases, a didemnin precursor, didemnin, and/or didemnin derivative compounds is obtained by bacteria or other fermentation methods of the invention and is then processed. The processing may include further purification, although in some embodiments the compound is subject to one or more further synthesis steps to obtain the desired molecule. Any suitable further synthesis steps may be employed in the art and are known to the skilled artisan (for representative examples, see Mayer et al., (1994); Jou et al. (1997)).

In specific aspects of the invention, there is in vitro conversion of didemnin B from *T. mobilis* to dehydrodidemnin B, for example using an oxidizing agent to oxidize the didemnin B to dehydrodidemnin B (see Faulkner D J. Marine pharmacology. (2000) Antonie van Leeuwenhoek 77: 135-145, incorporated by reference herein in its entirety).

Thus, compounds of the present disclosure may be made using the methods known in the art. These methods can be further modified and optimized using the principles and techniques of organic chemistry as applied by a person skilled in the art. Such principles and techniques are taught, for example, in *March's Advanced Organic Chemistry: Reactions, Mechanisms, and Structure* (2007), which is incorporated by reference herein in its entirety.

Compounds encompassed in methods of the invention or produced directly or indirectly there by may contain one or more asymmetrically-substituted carbon or nitrogen atoms, and may be isolated in optically active or racemic form. Thus, all chiral, diastereomeric, racemic form, epimeric form, and all geometric isomeric forms of a structure are intended, unless the specific stereochemistry or isomeric form is specifically indicated. Compounds may occur as racemates and racemic mixtures, single enantiomers, diastereomeric mixtures and individual diastereomers. In some embodiments, a single diastereomer is obtained. The chiral centers of the compounds of the present invention can have the S or the R configuration.

Compounds of the invention may also have the advantage that they may be more efficacious than, be less toxic than, be longer acting than, be more potent than, produce fewer side effects than, be more easily absorbed than, and/or have a better pharmacokinetic profile (e.g., higher oral bioavailability and/or lower clearance) than, and/or have other useful pharmacological, physical, or chemical properties over, compounds known in the prior art, whether for use in the indications stated herein or otherwise.

In addition, atoms making up the compounds of the present invention are intended to include all isotopic forms of such atoms. Isotopes, as used herein, include those atoms having the same atomic number but different mass numbers. By way of general example and without limitation, isotopes of hydrogen include tritium and deuterium, and isotopes of carbon include $^{13}C$ and $^{14}C$.

It should be recognized that the particular anion or cation forming a part of any salt of this invention is not critical, so long as the salt, as a whole, is pharmacologically acceptable. Additional examples of pharmaceutically acceptable salts and their methods of preparation and use are presented in *Handbook of Pharmaceutical Salts: Properties, and Use* (2002), which is incorporated herein by reference.

When used in the context of a chemical group, "hydrogen" means —H; "hydroxy" means —OH; "oxo" means =O; "halo" means independently —F, —Cl, —Br or —I; "amino" means —NH$_2$ (see below for definitions of groups containing the term amino, e.g., alkylamino); "hydroxyamino" means —NHOH; "nitro" means —NO$_2$; imino means =NH (see below for definitions of groups containing the term imino, e.g., alkylimino); "cyano" means —CN; "isocyanate" means —N=C=O; "azido" means —N$_3$; in a monovalent context "phosphate" means —OP(O)(OH)$_2$ or a deprotonated form thereof; in a divalent context "phosphate" means —OP(O)(OH)O— or a deprotonated form thereof; "mercapto" means —SH; "thio" means =S; "thioether" means —S—; "sulfonamido" means —NHS(O)$_2$— (see below for definitions of groups containing the term sulfonamido, e.g., alkylsulfonamido); "sulfonyl" means —S(O)$_2$— (see below for definitions of groups containing the term sulfonyl, e.g., alkylsulfonyl); and "sulfinyl" means —S(O)— (see below for definitions of groups containing the term sulfinyl, e.g., alkylsulfinyl).

In the context of chemical formulas, the symbol "—" means a single bond, "=" means a double bond, and "≡" means triple bond. The symbol "_____" represents an optional bond, which if present is either single or double. The symbol "====" represents a single bond or a double bond. Thus, for example, the structure

includes the structures

, , ,  and

As will be understood by a person of skill in the art, no one such ring atom forms part of more than one double bond. The symbol "⁓", when drawn perpendicularly across a bond indicates a point of attachment of the group. It is noted that the point of attachment is typically only identified in this manner for larger groups in order to assist the reader in rapidly and unambiguously identifying a point of attachment. The symbol "◀▬" means a single bond where the group attached to the thick end of the wedge is "out of the page." The symbol "◀▬▬" means a single bond where the group attached to the thick end of the wedge is "into the page". The symbol "⁓" means a single bond where the conformation (e.g., either R or S) or the geometry is undefined (e.g., either E or Z).

Any undefined valency on an atom of a structure shown in this application implicitly represents a hydrogen atom bonded to the atom. When a group "R" is depicted as a "floating group" on a ring system, for example, in the formula:

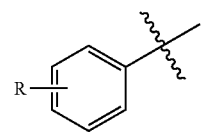

then R may replace any hydrogen atom attached to any of the ring atoms, including a depicted, implied, or expressly defined hydrogen, so long as a stable structure is formed. When a group "R" is depicted as a "floating group" on a fused ring system, as for example in the formula:

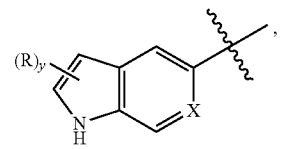

then R may replace any hydrogen attached to any of the ring atoms of either of the fused rings unless specified otherwise. Replaceable hydrogens include depicted hydrogens (e.g., the hydrogen attached to the nitrogen in the formula above), implied hydrogens (e.g., a hydrogen of the formula above that is not shown but understood to be present), expressly defined hydrogens, and optional hydrogens whose presence depends on the identity of a ring atom (e.g., a hydrogen attached to group X, when X equals —CH—), so long as a stable structure is formed. In the example depicted, R may reside on either the 5-membered or the 6-membered ring of the fused ring system. In the formula above, the subscript letter "y" immediately following the group "R" enclosed in parentheses, represents a numeric variable. Unless specified otherwise, this variable can be 0, 1, 2, or any integer greater than 2, only limited by the maximum number of replaceable hydrogen atoms of the ring or ring system.

For the groups and classes below, the following parenthetical subscripts further define the group/class as follows: "(Cn)" defines the exact number (n) of carbon atoms in the group/class. "(C≤n)" defines the maximum number (n) of carbon atoms that can be in the group/class, with the minimum number as small as possible for the group in question, e.g., it is understood that the minimum number of carbon atoms in the group "alkenyl$_{(C≤8)}$," or the class "alkene$_{(C≤8)}$" is two. For example, "alkoxy$_{(C≤10)}$" designates those alkoxy groups having from 1 to 10 carbon atoms (e.g., 1, 2, 3, 4, 5, 6, 7, 8, 9, or 10, or any range derivable therein (e.g., 3 to 10 carbon atoms). (Cn-n') defines both the minimum (n) and maximum number (n') of carbon atoms in the group. Similarly, "alkyl$_{(C2-10)}$" designates those alkyl groups having from 2 to 10 carbon atoms (e.g., 2, 3, 4, 5, 6, 7, 8, 9, or 10, or any range derivable therein (e.g., 3 to 10 carbon atoms)).

The term "saturated" as used herein means the compound or group so modified has no carbon-carbon double and no carbon-carbon triple bonds, except as noted below. The term does not preclude carbon-heteroatom multiple bonds, for example a carbon oxygen double bond or a carbon nitrogen double bond. Moreover, it does not preclude a carbon-carbon double bond that may occur as part of keto-enol tautomerism or imine/enamine tautomerism.

The term "aliphatic" when used without the "substituted" modifier signifies that the compound/group so modified is an acyclic or cyclic, but non-aromatic hydrocarbon compound or group. In aliphatic compounds/groups, the carbon atoms can be joined together in straight chains, branched chains, or non-aromatic rings (alicyclic). Aliphatic compounds/groups can be saturated, that is joined by single bonds (alkanes/alkyl), or unsaturated, with one or more double bonds (alkenes/alkenyl) or with one or more triple bonds (alkynes/alkynyl). When the term "aliphatic" is used without the "substituted" modifier only carbon and hydrogen atoms are present. When the term is used with the "substituted" modifier one or more hydrogen atom has been independently replaced by one of the following exemplary non-limiting functional groups: —OH, —F, —Cl, —Br, —I, —NH$_2$, —NO$_2$, —CO$_2$H, —CO$_2$CH$_3$, —CN, —SH, —OCH$_3$, —OCH$_2$CH$_3$, —C(O)CH$_3$, —N(CH$_3$)$_2$, —C(O)NH$_2$, —B(OH)$_2$, —P(O)(OCH$_3$)$_2$ or —OC(O)CH$_3$.

The term "alkyl" when used without the "substituted" modifier refers to a monovalent saturated aliphatic group with a carbon atom as the point of attachment, a linear or branched, cyclo, cyclic or acyclic structure, and no atoms other than carbon and hydrogen. Thus, as used herein cycloalkyl is a subset of alkyl. The groups —CH$_3$ (Me), —CH$_2$CH$_3$ (Et), —CH$_2$CH$_2$CH$_3$ (n-Pr), —CH(CH$_3$)$_2$ (iso-Pr), —CH(CH$_2$)$_2$ (cyclopropyl), —CH$_2$CH$_2$CH$_2$CH$_3$ (n-Bu), —CH(CH$_3$)CH$_2$CH$_3$ (sec-butyl), —CH$_2$CH(CH$_3$)$_2$ (iso-butyl), —C(CH$_3$)$_3$ (tert-butyl), —CH$_2$C(CH$_3$)$_3$ (neo-pentyl), cyclobutyl, cyclopentyl, cyclohexyl, and cyclohexylmethyl are non-limiting examples of alkyl groups. The term "alkanediyl" when used without the "substituted" modifier refers to a divalent saturated aliphatic group, with one or two saturated carbon atom(s) as the point(s) of attachment, a linear or branched, cyclo, cyclic or acyclic structure, no carbon-carbon double or triple bonds, and no atoms other than carbon and hydrogen. The groups, —CH$_2$— (methylene), —CH$_2$CH$_2$—, —CH$_2$C(CH$_3$)$_2$CH$_2$—, —CH$_2$CH$_2$CH$_2$—, and

are non-limiting examples of alkanediyl groups. The term "alkylidene" when used without the "substituted" modifier refers to the divalent group =CRR' in which R and R' are independently hydrogen, alkyl, or R and R' are taken together to represent an alkanediyl having at least two carbon atoms. Non-limiting examples of alkylidene groups include: =CH$_2$, =CH(CH$_2$CH$_3$), and =C(CH$_3$)$_2$. When the term is used with the "substituted" modifier one or more hydrogen atom has been independently replaced by one of the following exemplary non-limiting functional groups: —OH, —F, —Cl, —Br, —I, —NH$_2$, —NO$_2$, —CO$_2$H, —CO$_2$CH$_3$, —CN, —SH, —OCH$_3$, —OCH$_2$CH$_3$, —C(O)CH$_3$, —N(CH$_3$)$_2$, —C(O)NH$_2$, —B(OH)$_2$, —P(O)(OCH$_3$)$_2$ or —OC(O)CH$_3$. The following groups are non-limiting examples of substituted alkyl groups: —CH$_2$OH, —CH$_2$Cl, —CF$_3$, —CH$_2$CN, —CH$_2$C(O)OH, —CH$_2$C(O)OCH$_3$, —CH$_2$C(O)NH$_2$, —CH$_2$C(O)CH$_3$, —CH$_2$OCH$_3$, —CH$_2$OC(O)CH$_3$, —CH$_2$NH$_2$, —CH$_2$N(CH$_3$)$_2$, and —CH$_2$CH$_2$Cl. The term "fluoroalkyl" is a subset of substituted alkyl, in which one or more hydrogen has been substituted with a fluoro group and no other atoms aside from carbon, hydrogen and fluorine are present. The groups, —CH$_2$F, —CF$_3$, and —CH$_2$CF$_3$ are non-limiting examples of fluoroalkyl groups. An "alkane" refers to the compound H—R, wherein R is alkyl.

The term "aryl" when used without the "substituted" modifier refers to a monovalent unsaturated aromatic group with an aromatic carbon atom as the point of attachment, said carbon atom forming part of a one or more six-membered aromatic ring structure, wherein the ring atoms are all carbon, and wherein the group consists of no atoms other than carbon and hydrogen. If more than one ring is present, the rings may be fused or unfused. As used herein, the term does not preclude the presence of one or more alkyl group (carbon number limitation permitting) attached to the first aromatic ring or any additional aromatic ring present. Non-limiting examples of aryl groups include phenyl (Ph), methylphenyl, (dimethyl)phenyl, —C$_6$H$_4$—CH$_2$CH$_3$ (ethylphenyl), naphthyl, and the monovalent group derived from biphenyl. The term "arenediyl" when used without the "substituted" modifier refers to a divalent aromatic group, with two aromatic carbon atoms as points of attachment, said carbon atoms forming part of one or more six-membered aromatic ring structure(s) wherein the ring atoms are all carbon, and wherein the monovalent group consists of no atoms other than carbon and hydrogen. As used herein, the term does not preclude the presence of one or more alkyl group (carbon number limitation permitting) attached to the first aromatic ring or any additional aromatic ring present. If more than one ring is present, the rings may be fused or unfused. Non-limiting examples of arenediyl groups include:

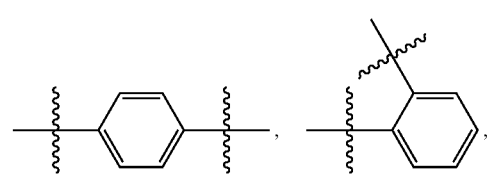

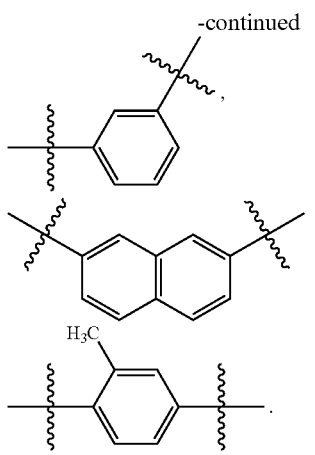

and

When the term "aryl" is used with the "substituted" modifier one or more hydrogen atom has been independently replaced by one of the following exemplary non-limiting functional groups: —OH, —F, —Cl, —Br, —I, —NH$_2$, —NO$_2$, —CO$_2$H, —CO$_2$CH$_3$, —CN, —SH, —OCH$_3$, —OCH$_2$CH$_3$, —C(O)CH$_3$, —N(CH$_3$)$_2$, —C(O)NH$_2$, —B(OH)$_2$, —P(O)(OCH$_3$)$_2$ or —OC(O)CH$_3$. An "arene" refers to the compound H—R, wherein R is aryl.

The term "aralkyl" when used without the "substituted" modifier refers to the monovalent group -alkanediyl-aryl, in which the terms alkanediyl and aryl are each used in a manner consistent with the definitions provided above. Non-limiting examples of aralkyls are: phenylmethyl (benzyl, Bn) and 2-phenyl-ethyl. When the term is used with the "substituted" modifier one or more hydrogen atom has been independently replaced by one of the following exemplary non-limiting functional groups: —OH, —F, —Cl, —Br, —I, —NH$_2$, —NO$_2$, —CO$_2$H, —CO$_2$CH$_3$, —CN, —SH, —OCH$_3$, —OCH$_2$CH$_3$, —C(O)CH$_3$, —N(CH$_3$)$_2$, —C(O)NH$_2$, —B(OH)$_2$, —P(O)(OCH$_3$)$_2$ or —OC(O)CH$_3$. Non-limiting examples of substituted aralkyls are: (3-chlorophenyl)-methyl, and 2-chloro-2-phenyl-eth-1-yl.

The term "heteroaryl" when used without the "substituted" modifier refers to a monovalent aromatic group with an aromatic carbon atom or nitrogen atom as the point of attachment, said carbon atom or nitrogen atom forming part of an aromatic ring structure wherein at least one of the ring atoms is nitrogen, oxygen or sulfur, and wherein the group consists of no atoms other than carbon, hydrogen, aromatic nitrogen, aromatic oxygen and aromatic sulfur. As used herein, the term does not preclude the presence of one or more alkyl group (carbon number limitation permitting) attached to the aromatic ring or any additional aromatic ring present. Non-limiting examples of heteroaryl groups include furanyl, imidazolyl, indolyl, indazolyl (Im), methylpyridyl, oxazolyl, pyridyl, pyrrolyl, pyrimidyl, pyrazinyl, quinolyl, quinazolyl, quinoxalinyl, thienyl, and triazinyl. The term "heteroarenediyl" when used without the "substituted" modifier refers to an divalent aromatic group, with two aromatic carbon atoms, two aromatic nitrogen atoms, or one aromatic carbon atom and one aromatic nitrogen atom as the two points of attachment, said atoms forming part of one or more aromatic ring structure(s) wherein at least one of the ring atoms is nitrogen, oxygen or sulfur, and wherein the divalent group consists of no atoms other than carbon, hydrogen, aromatic nitrogen, aromatic oxygen and aromatic sulfur. As used herein, the term does not preclude the presence of one or more alkyl group (carbon number limitation permitting) attached to the first aromatic ring or any additional aromatic ring present. If more than one ring is present, the rings may be fused or unfused. Non-limiting examples of heteroarenediyl groups include:

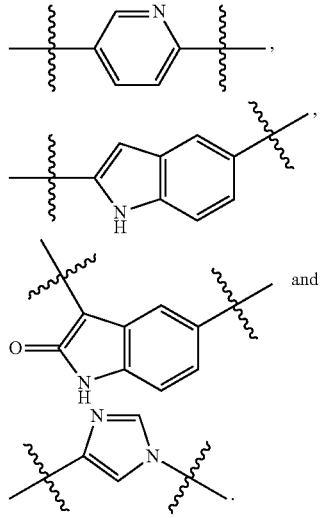

and

When the term is used with the "substituted" modifier one or more hydrogen atom has been independently replaced by one of the following exemplary non-limiting functional groups: —OH, —F, —Cl, —Br, —I, —NH$_2$, —NO$_2$, —CO$_2$H, —CO$_2$CH$_3$, —CN, —SH, —OCH$_3$, —OCH$_2$CH$_3$, —C(O)CH$_3$, —N(CH$_3$)$_2$, —C(O)NH$_2$, —B(OH)$_2$, —P(O)(OCH$_3$)$_2$ or —OC(O)CH$_3$.

The term "acyl" when used without the "substituted" modifier refers to the group —C(O)R, in which R is a hydrogen, alkyl, aryl, aralkyl or heteroaryl, as those terms are defined above. The groups, —CHO, —C(O)CH$_3$ (acetyl, Ac), —C(O)CH$_2$CH$_3$, —C(O)CH$_2$CH$_2$CH$_3$, —C(O)CH(CH$_3$)$_2$, —C(O)CH(CH$_2$)$_2$, —C(O)C$_6$H$_5$, —C(O)C$_6$H$_4$—CH$_3$, —C(O)CH$_2$C$_6$H$_5$, —C(O)(imidazolyl) are non-limiting examples of acyl groups. A "thioacyl" is defined in an analogous manner, except that the oxygen atom of the group —C(O)R has been replaced with a sulfur atom, —C(S)R. When the term is used with the "substituted" modifier one or more hydrogen atom has been independently replaced by one of the following exemplary non-limiting functional groups: —OH, —F, —Cl, —Br, —I, —NH$_2$, —NO$_2$, —CO$_2$H, —CO$_2$CH$_3$, —CN, —SH, —OCH$_3$, —OCH$_2$CH$_3$, —C(O)CH$_3$, —N(CH$_3$)$_2$, —C(O)NH$_2$, —B(OH)$_2$, —P(O)(OCH$_3$)$_2$ or —OC(O)CH$_3$. The groups, —C(O)CH$_2$CF$_3$, —CO$_2$H (carboxyl), —CO$_2$CH$_3$ (methylcarboxyl), —CO$_2$CH$_2$CH$_3$, —C(O)NH$_2$ (carbamoyl), and —CON(CH$_3$)$_2$, are non-limiting examples of substituted acyl groups.

The term "alkoxy" when used without the "substituted" modifier refers to the group —OR, in which R is an alkyl, as that term is defined above. Non-limiting examples of alkoxy groups include: —OCH$_3$, —OCH$_2$CH$_3$, —OCH$_2$CH$_2$CH$_3$, —OCH(CH$_3$)$_2$, —OCH(CH$_2$)$_2$, —O-cyclopentyl, and —O-cyclohexyl. The terms "alkenyloxy", "alkynyloxy", "aryloxy", "aralkoxy", "heteroaryloxy", and "acyloxy", when used without the "substituted" modifier, refers to groups, defined as —OR, in which R is alkenyl, alkynyl, aryl, aralkyl, heteroaryl, and acyl, respectively. Similarly, the term "alkylthio" when used without the "substituted" modifier refers to the group —SR, in which R is an alkyl, as that term is defined above. When the term is used with the "substituted" modifier one or more hydrogen atom has been independently replaced by one of the following exemplary non-limiting functional groups: —OH, —F, —Cl, —Br, —I, —NH$_2$, —NO$_2$, —CO$_2$H, —CO$_2$CH$_3$, —CN, —SH, —OCH$_3$, —OCH$_2$CH$_3$, —C(O)CH$_3$, —N(CH$_3$)$_2$, —C(O)NH$_2$, —B(OH)$_2$, —P(O)(OCH$_3$)$_2$ or —OC(O)CH$_3$. The term "alcohol" corresponds to an alkane, as defined above, wherein at least one of the hydrogen atoms has been replaced with a hydroxy group.

The term "alkylamino" when used without the "substituted" modifier refers to the group —NHR, in which R is an alkyl, as that term is defined above. Non-limiting examples of alkylamino groups include: —NHCH$_3$ and —NHCH$_2$CH$_3$. The term "dialkylamino" when used without the "substituted" modifier refers to the group —NRR', in which R and R' can be the same or different alkyl groups, or R and R' can be taken together to represent an alkanediyl. Non-limiting examples of dialkylamino groups include: —N(CH$_3$)$_2$, —N(CH$_3$)(CH$_2$CH$_3$), and N-pyrrolidinyl. The terms "alkoxyamino", "alkenylamino", "alkynylamino", "arylamino", "aralkylamino", "heteroarylamino", and "alkylsulfonylamino" when used without the "substituted" modifier, refers to groups, defined as —NHR, in which R is alkoxy, alkenyl, alkynyl, aryl, aralkyl, heteroaryl, and alkylsulfonyl, respectively. A non-limiting example of an arylamino group is —NHC$_6$H$_5$. The term "amido" (acylamino), when used without the "substituted" modifier, refers to the group —NHR, in which R is acyl, as that term is defined above. A non-limiting example of an amido group is —NHC(O)CH$_3$. The term "alkylimino" when used without the "substituted" modifier refers to the divalent group =NR, in which R is an alkyl, as that term is defined above. When the term is used with the "substituted" modifier one or more hydrogen atom has been independently replaced by one of the following exemplary non-limiting functional groups: —OH, —F, —Cl, —Br, —I, —NH$_2$, —NO$_2$, —CO$_2$H, —CO$_2$CH$_3$, —CN, —SH, —OCH$_3$, —OCH$_2$CH$_3$, —C(O)CH$_3$, —N(CH$_3$)$_2$, —C(O)NH$_2$, —B(OH)$_2$, —P(O)(OCH$_3$)$_2$ or —OC(O)CH$_3$. The groups —NHC(O)OCH$_3$ and —NHC(O)NHCH$_3$ are non-limiting examples of substituted amido groups.

The term "heterocyclic" or "heterocycle" when used without the "substituted" modifier signifies that the compound/group so modified comprising at least one ring in which at least one ring atom is an element other than carbon. Examples of the non-carbon ring atoms include but are not limited to nitrogen, oxygen, sulfur, boron, phosphorus, arsenic, antimony, germanium, bismuth, silicon and/or tin. Examples of heterocyclic structures include but are not limited to aziridine, azirine, oxirane, epoxide, oxirene, thiirane, episulfides, thiirene, diazirine, oxaziridine, dioxirane, azetidine, azete, oxetane, oxete, thietane, thiete, diazetidine, dioxetane, dioxete, dithietane, dithiete, pyrrolidine, pyrrole, oxolane, furane, thiolane, thiophene, borolane, borole, phospholane, phosphole, arsolane, arsole, stibolane, stibole, bismolane, bismole, silolane, silole, stannolane, stannole, imidazolidine, imidazole, pyrazolidine, pyrazole, imidazoline, pyrazoline, oxazolidine, oxazole, oxazoline, isoxazolidine, isoxazole, thiazolidine, thiazole, thiazoline, isothiazolidine, isothiazole, dioxolane, thithiolane, triazole, furazan, oxadiazole, thiadiazole, dithiazole, tetrazole, piperidine, pyridine, oxane, pyran, thiane, thiopyran, salinane, saline, germinane, germine, stanninane, stannine, borinane, borinine, phosphinane, phosphinine, arsinane, arsinine, piperazine, diazine, morpholine, oxazine, thiomorpholine, thiazine, dioxane, dioxine, dithiane, dithiine, triazine, trioxane, tetrazine, azepane, azepine, oxepane, oxepine, thiepane, thiepine, homopiperazine, diazepine, thiazepine, ozocane, azocine, oxecane, or thiocane. When the term "heterocyclic" is used with the "substituted" modifier one or more hydrogen atom has been independently replaced by one of the following exemplary non-limiting functional groups: —OH, —F, —Cl, —Br, —I, —NH$_2$, —NO$_2$, —CO$_2$H, —CO$_2$CH$_3$, —CN, —SH, —OCH$_3$, —OCH$_2$CH$_3$, —C(O)CH$_3$, —N(CH$_3$)$_2$, —C(O)NH$_2$ or —OC(O)CH$_3$.

As generally used herein "pharmaceutically acceptable" refers to those compounds, materials, compositions, and/or dosage forms which are, within the scope of sound medical judgment, suitable for use in contact with the tissues, organs, and/or bodily fluids of human beings and animals without excessive toxicity, irritation, allergic response, or other problems or complications commensurate with a reasonable benefit/risk ratio.

"Pharmaceutically acceptable salts" means salts of compounds of the present invention which are pharmaceutically acceptable, as defined above, and which possess the desired pharmacological activity. Such salts include acid addition salts formed with inorganic acids such as hydrochloric acid, hydrobromic acid, sulfuric acid, nitric acid, phosphoric acid, and the like; or with organic acids such as 1,2-ethanedisulfonic acid, 2-hydroxyethanesulfonic acid, 2-naphthalenesulfonic acid, 3-phenylpropionic acid, 4,4'-methylenebis(3-hydroxy-2-ene-1-carboxylic acid), 4-methylbicyclo[2.2.2]oct-2-ene-1-carboxylic acid, acetic acid, aliphatic mono- and dicarboxylic acids, aliphatic sulfuric acids, aromatic sulfuric acids, benzenesulfonic acid, benzoic acid, camphorsulfonic acid, carbonic acid, cinnamic acid, citric acid, cyclopentanepropionic acid, ethanesulfonic acid, fumaric acid, glucoheptonic acid, gluconic acid, glutamic acid, glycolic acid, heptanoic acid, hexanoic acid, hydroxynaphthoic acid, lactic acid, laurylsulfuric acid, maleic acid, malic acid, malonic acid, mandelic acid, methanesulfonic acid, muconic acid, o-(4-hydroxybenzoyl)benzoic acid, oxalic acid, p-chlorobenzenesulfonic acid, phenyl-substituted alkanoic acids, propionic acid, p-toluenesulfonic acid, pyruvic acid, salicylic acid, stearic acid, succinic acid, tartaric acid, tertiarybutylacetic acid, trimethylacetic acid, trifluoroacetic acid, trifluormethyl sulfonic (triflic) acid and the like. Pharmaceutically acceptable salts also include base addition salts which may be formed when acidic protons present are capable of reacting with inorganic or organic bases. Acceptable inorganic bases include sodium hydroxide, sodium carbonate, potassium hydroxide, aluminum hydroxide and calcium hydroxide. Acceptable organic bases include, but are not limited to ethanolamine, diethanolamine, triethanolamine, tromethamine, N-methylglucamine and the like. It should be recognized that the particular anion or cation forming a part of any salt of this invention is not critical, so long as the salt, as a whole, is pharmacologically acceptable. Additional examples of pharmaceutically acceptable salts and their methods of preparation and use are presented in *Handbook of Pharmaceutical Salts: Properties, and Use* (P. H. Stahl & C. G. Wermuth eds., Verlag Helvetica Chimica Acta, 2002).

VIII. Pharmaceutical Preparations

Pharmaceutical compositions of the present invention comprise an effective amount of one or more didemnin or didemnin derivative compositions of the invention dissolved or dispersed in a pharmaceutically acceptable carrier. The phrases "pharmaceutical or pharmacologically acceptable" refers to molecular entities and compositions that do not produce an adverse, allergic or other untoward reaction when administered to an animal, such as, for example, a human, as appropriate. The preparation of an pharmaceutical composition that contains at least one composition of the invention or additional active ingredient will be known to those of skill in the art in light of the present disclosure, as exemplified by Remington's Pharmaceutical Sciences, 18th Ed. Mack Printing Company, 1990, incorporated herein by reference. Moreover, for animal (e.g., human) administration, it will be understood that preparations should meet sterility, pyrogenicity, general safety and purity standards as required by FDA Office of Biological Standards.

As used herein, "pharmaceutically acceptable carrier" includes any and all solvents, dispersion media, coatings, surfactants, antioxidants, preservatives (e.g., antibacterial agents, antifungal agents), isotonic agents, absorption delaying agents, salts, preservatives, drugs, drug stabilizers, gels, binders, excipients, disintegration agents, lubricants, sweetening agents, flavoring agents, dyes, such like materials and combinations thereof, as would be known to one of ordinary skill in the art (see, for example, Remington's Pharmaceutical Sciences, 18th Ed. Mack Printing Company, 1990, pp. 1289-1329, incorporated herein by reference). Except insofar as any conventional carrier is incompatible with the active ingredient, its use in the pharmaceutical compositions is contemplated.

The didemnin or didemnin derivative may comprise different types of carriers depending on whether it is to be administered in solid, liquid or aerosol form, and whether it need to be sterile for such routes of administration as injection. The present invention can be administered intravenously, intradermally, transdermally, intrathecally, intraarterially, intraperitoneally, intranasally, intravaginally, intrarectally, topically, intramuscularly, subcutaneously, mucosally, orally, topically, locally, inhalation (e.g., aerosol inhalation), injection, infusion, continuous infusion, localized perfusion bathing target cells directly, via a catheter, via a lavage, in cremes, in lipid compositions (e.g., liposomes), or by other method or any combination of the forgoing as would be known to one of ordinary skill in the art (see, for example, Remington's Pharmaceutical Sciences, 18th Ed. Mack Printing Company, 1990, incorporated herein by reference).

The didemnin or didemnin derivative may be formulated into a composition in a free base, neutral or salt form. Pharmaceutically acceptable salts, include the acid addition salts, e.g., those formed with the free amino groups of a proteinaceous composition, or which are formed with inorganic acids such as for example, hydrochloric or phosphoric acids, or such organic acids as acetic, oxalic, tartaric or mandelic acid. Salts formed with the free carboxyl groups can also be derived from inorganic bases such as for example, sodium, potassium, ammonium, calcium or ferric hydroxides; or such organic bases as isopropylamine, trimethylamine, histidine or procaine. Upon formulation, solutions will be administered in a manner compatible with the dosage formulation and in such amount as is therapeutically effective. The formulations are easily administered in a variety of dosage forms such as formulated for parenteral administrations such as injectable solutions, or aerosols for delivery to the lungs, or formulated for alimentary administrations such as drug release capsules and the like.

Further in accordance with the present invention, the composition of the present invention suitable for administration is provided in a pharmaceutically acceptable carrier with or without an inert diluent. The carrier should be assimilable and includes liquid, semi-solid, i.e., pastes, or solid carriers. Except insofar as any conventional media, agent, diluent or carrier is detrimental to the recipient or to the therapeutic effectiveness of a the composition contained therein, its use in administrable composition for use in practicing the methods of the present invention is appropriate. Examples of carriers or diluents include fats, oils, water, saline solutions, lipids, liposomes, resins, binders, fillers and the like, or combinations thereof. The composition may also comprise various antioxidants to retard oxidation of one or more component. Additionally, the prevention of the action of microorganisms can be brought about by preservatives such as various antibacterial and antifungal agents, including but not limited to parabens (e.g., methylparabens, propylparabens), chlorobutanol, phenol, sorbic acid, thimerosal or combinations thereof.

In accordance with the present invention, the composition is combined with the carrier in any convenient and practical manner, i.e., by solution, suspension, emulsification, admixture, encapsulation, absorption and the like. Such procedures are routine for those skilled in the art.

In a specific embodiment of the present invention, the composition is combined or mixed thoroughly with a semi-solid or solid carrier. The mixing can be carried out in any convenient manner such as grinding. Stabilizing agents can be also added in the mixing process in order to protect the composition from loss of therapeutic activity, i.e., denaturation in the stomach. Examples of stabilizers for use in an the composition include buffers, amino acids such as glycine and lysine, carbohydrates such as dextrose, mannose, galactose, fructose, lactose, sucrose, maltose, sorbitol, mannitol, etc.

In further embodiments, the present invention may concern the use of a pharmaceutical lipid vehicle compositions that include a didemnin or didemnin derivative, one or more lipids, and an aqueous solvent. As used herein, the term "lipid" will be defined to include any of a broad range of substances that is characteristically insoluble in water and extractable with an organic solvent. This broad class of compounds are well known to those of skill in the art, and as the term "lipid" is used herein, it is not limited to any particular structure. Examples include compounds which contain long-chain aliphatic hydrocarbons and their derivatives. A lipid may be naturally occurring or synthetic (i.e., designed or produced by man). However, a lipid is usually a biological substance. Biological lipids are well known in the art, and include for example, neutral fats, phospholipids, phosphoglycerides, steroids, terpenes, lysolipids, glycosphingolipids, glycolipids, sulphatides, lipids with ether and ester-linked fatty acids and polymerizable lipids, and combinations thereof. Of course, compounds other than those specifically described herein that are understood by one of skill in the art as lipids are also encompassed by the compositions and methods of the present invention.

One of ordinary skill in the art would be familiar with the range of techniques that can be employed for dispersing a composition in a lipid vehicle. For example, the didemnin or didemnin derivative may be dispersed in a solution containing a lipid, dissolved with a lipid, emulsified with a lipid, mixed with a lipid, combined with a lipid, covalently bonded to a lipid, contained as a suspension in a lipid, contained or complexed with a micelle or liposome, or otherwise associated with a lipid or lipid structure by any means known to those of ordinary skill in the art. The dispersion may or may not result in the formation of liposomes.

The actual dosage amount of a composition of the present invention administered to an animal patient can be determined by physical and physiological factors such as body weight, severity of condition, the type of disease being treated, previous or concurrent therapeutic interventions, idiopathy of the patient and on the route of administration. Depending upon the dosage and the route of administration, the number of administrations of a preferred dosage and/or an effective amount may vary according to the response of the subject. The practitioner responsible for administration will, in any event, determine the concentration of active ingredient(s) in a composition and appropriate dose(s) for the individual subject.

In certain embodiments, pharmaceutical compositions may comprise, for example, at least about 0.1% of an active compound. In other embodiments, the an active compound may comprise between about 2% to about 75% of the weight of the unit, or between about 25% to about 60%, for example, and any range derivable therein. Naturally, the amount of active compound(s) in each therapeutically useful composition may be prepared is such a way that a suitable dosage will be obtained in any given unit dose of the compound. Factors such as solubility, bioavailability, biological half-life, route of administration, product shelf life, as well as other pharmacological considerations will be contemplated by one skilled in the art of preparing such pharmaceutical formulations, and as such, a variety of dosages and treatment regimens may be desirable.

In other non-limiting examples, a dose may also comprise from about 1 microgram/kg/body weight, about 5 microgram/kg/body weight, about 10 microgram/kg/body weight, about 50 microgram/kg/body weight, about 100 microgram/kg/body weight, about 200 microgram/kg/body weight, about 350 microgram/kg/body weight, about 500 microgram/kg/body weight, about 1 milligram/kg/body weight, about 5 milligram/kg/body weight, about 10 milligram/kg/body weight, about 50 milligram/kg/body weight, about 100 milligram/kg/body weight, about 200 milligram/kg/body weight, about 350 milligram/kg/body weight, about 500 milligram/kg/body weight, to about 1000 mg/kg/body weight or more per administration, and any range derivable therein. In non-limiting examples of a derivable range from the numbers listed herein, a range of about 5 mg/kg/body weight to about 100 mg/kg/body weight, about 5 microgram/kg/body weight to about 500 milligram/kg/body weight, etc., can be administered, based on the numbers described above.

D. Alimentary Compositions and Formulations

In preferred embodiments of the present invention, the composition(s) are formulated to be administered via an alimentary route. Alimentary routes include all possible routes of administration in which the composition is in direct contact with the alimentary tract. Specifically, the pharmaceutical compositions disclosed herein may be administered orally, buccally, rectally, or sublingually. As such, these compositions may be formulated with an inert diluent or with an assimilable edible carrier, or they may be enclosed in hard- or soft-shell gelatin capsule, or they may be compressed into tablets, or they may be incorporated directly with the food of the diet.

In certain embodiments, the active compounds may be incorporated with excipients and used in the form of ingestible tablets, buccal tables, troches, capsules, elixirs, suspensions, syrups, wafers, and the like (Mathiowitz et al., 1997; Hwang et al., 1998; U.S. Pat. Nos. 5,641,515; 5,580,579 and 5,792,451, each specifically incorporated herein by reference in its entirety). The tablets, troches, pills, capsules and the like may also contain the following: a binder, such as, for example, gum tragacanth, acacia, cornstarch, gelatin or combinations thereof; an excipient, such as, for example, dicalcium phosphate, mannitol, lactose, starch, magnesium stearate, sodium saccharine, cellulose, magnesium carbonate or combinations thereof; a disintegrating agent, such as, for example, corn starch, potato starch, alginic acid or combinations thereof; a lubricant, such as, for example, magnesium stearate; a sweetening agent, such as, for example, sucrose, lactose, saccharin or combinations thereof; a flavoring agent, such as, for example peppermint, oil of wintergreen, cherry flavoring, orange flavoring, etc. When the dosage unit form is a capsule, it may contain, in addition to materials of the above type, a liquid carrier. Various other materials may be present as coatings or to otherwise modify the physical form of the dosage unit. For instance, tablets, pills, or capsules may be coated with shellac, sugar, or both. When the dosage form is a capsule, it may contain, in addition to materials of the above type, carriers such as a liquid carrier. Gelatin capsules, tablets, or pills may be enterically coated. Enteric coatings prevent denaturation of the composition in the stomach or upper bowel where the pH is acidic. See, e.g., U.S. Pat. No. 5,629,001. Upon reaching the small intestines, the basic pH therein dissolves the coating and permits the composition to be released and absorbed by specialized cells, e.g., epithelial enterocytes and Peyer's patch M cells. A syrup of elixir may contain the active compound sucrose as a sweetening agent methyl and propylparabens as preservatives, a dye and flavoring, such as cherry or orange flavor. Of course, any material used in preparing any dosage unit form should be pharmaceutically pure and substantially non-toxic in the amounts employed. In addition, the active compounds may be incorporated into sustained-release preparation and formulations.

For oral administration the compositions of the present invention may alternatively be incorporated with one or more excipients in the form of a mouthwash, dentifrice, buccal tablet, oral spray, or sublingual orally-administered formulation. For example, a mouthwash may be prepared incorporating the active ingredient in the required amount in an appropriate solvent, such as a sodium borate solution (Dobell's Solution). Alternatively, the active ingredient may be incorporated into an oral solution such as one containing sodium borate, glycerin and potassium bicarbonate, or dispersed in a dentifrice, or added in a therapeutically-effective amount to a composition that may include water, binders, abrasives, flavoring agents, foaming agents, and humectants. Alternatively the compositions may be fashioned into a tablet or solution form that may be placed under the tongue or otherwise dissolved in the mouth.

Additional formulations which are suitable for other modes of alimentary administration include suppositories. Suppositories are solid dosage forms of various weights and shapes, usually medicated, for insertion into the rectum. After insertion, suppositories soften, melt or dissolve in the cavity fluids. In general, for suppositories, traditional carriers may include, for example, polyalkylene glycols, triglycerides or combinations thereof. In certain embodiments, suppositories may be formed from mixtures containing, for example, the active ingredient in the range of about 0.5% to about 10%, and preferably about 1% to about 2%.

E. Parenteral Compositions and Formulations

In further embodiments, the composition may be administered via a parenteral route. As used herein, the term "parenteral" includes routes that bypass the alimentary tract. Specifically, the pharmaceutical compositions disclosed herein may be administered for example, but not limited to intravenously, intradermally, intramuscularly, intraarterially, intrathecally, subcutaneous, or intraperitoneally U.S. Pat.

Nos. 6,7537,514, 6,613,308, 5,466,468, 5,543,158; 5,641,515; and 5,399,363 (each specifically incorporated herein by reference in its entirety).

Solutions of the active compounds as free base or pharmacologically acceptable salts may be prepared in water suitably mixed with a surfactant, such as hydroxypropylcellulose. Dispersions may also be prepared in glycerol, liquid polyethylene glycols, and mixtures thereof and in oils. Under ordinary conditions of storage and use, these preparations contain a preservative to prevent the growth of microorganisms. The pharmaceutical forms suitable for injectable use include sterile aqueous solutions or dispersions and sterile powders for the extemporaneous preparation of sterile injectable solutions or dispersions (U.S. Pat. No. 5,466,468, specifically incorporated herein by reference in its entirety). In all cases the form must be sterile and must be fluid to the extent that easy injectability exists. It must be stable under the conditions of manufacture and storage and must be preserved against the contaminating action of microorganisms, such as bacteria and fungi. The carrier can be a solvent or dispersion medium containing, for example, water, ethanol, polyol (i.e., glycerol, propylene glycol, and liquid polyethylene glycol, and the like), suitable mixtures thereof, and/or vegetable oils. Proper fluidity can be maintained, for example, by the use of a coating, such as lecithin, by the maintenance of the required particle size in the case of dispersion and by the use of surfactants. The prevention of the action of microorganisms can be brought about by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

For parenteral administration in an aqueous solution, for example, the solution should be suitably buffered if necessary and the liquid diluent first rendered isotonic with sufficient saline or glucose. These particular aqueous solutions are especially suitable for intravenous, intramuscular, subcutaneous, and intraperitoneal administration. In this connection, sterile aqueous media that can be employed will be known to those of skill in the art in light of the present disclosure. For example, one dosage may be dissolved in isotonic NaCl solution and either added hypodermoclysis fluid or injected at the proposed site of infusion, (see for example, "Remington's Pharmaceutical Sciences" 15th Edition, pages 1035-1038 and 1570-1580). Some variation in dosage will necessarily occur depending on the condition of the subject being treated. The person responsible for administration will, in any event, determine the appropriate dose for the individual subject. Moreover, for human administration, preparations should meet sterility, pyrogenicity, general safety and purity standards as required by FDA Office of Biologics standards.

Sterile injectable solutions are prepared by incorporating the active compounds in the required amount in the appropriate solvent with various of the other ingredients enumerated above, as required, followed by filtered sterilization. Generally, dispersions are prepared by incorporating the various sterilized active ingredients into a sterile vehicle which contains the basic dispersion medium and the required other ingredients from those enumerated above. In the case of sterile powders for the preparation of sterile injectable solutions, the preferred methods of preparation are vacuum-drying and freeze-drying techniques which yield a powder of the active ingredient plus any additional desired ingredient from a previously sterile-filtered solution thereof. A powdered composition is combined with a liquid carrier such as, e.g., water or a saline solution, with or without a stabilizing agent.

F. Miscellaneous Pharmaceutical Compositions and Formulations

In other preferred embodiments of the invention, the active compound may be formulated for administration via various miscellaneous routes, for example, topical (i.e., transdermal) administration, mucosal administration (intranasal, vaginal, etc.) and/or inhalation.

Pharmaceutical compositions for topical administration may include the active compound formulated for a medicated application such as an ointment, paste, cream or powder. Ointments include all oleaginous, adsorption, emulsion and water-solubly based compositions for topical application, while creams and lotions are those compositions that include an emulsion base only. Topically administered medications may contain a penetration enhancer to facilitate adsorption of the active ingredients through the skin. Suitable penetration enhancers include glycerin, alcohols, alkyl methyl sulfoxides, pyrrolidones and luarocapram. Possible bases for compositions for topical application include polyethylene glycol, lanolin, cold cream and petrolatum as well as any other suitable absorption, emulsion or water-soluble ointment base. Topical preparations may also include emulsifiers, gelling agents, and antimicrobial preservatives as necessary to preserve the active ingredient and provide for a homogenous mixture. Transdermal administration of the present invention may also comprise the use of a "patch". For example, the patch may supply one or more active substances at a predetermined rate and in a continuous manner over a fixed period of time.

In certain embodiments, the pharmaceutical compositions may be delivered by eye drops, intranasal sprays, inhalation, and/or other aerosol delivery vehicles. Methods for delivering compositions directly to the lungs via nasal aerosol sprays has been described e.g., in U.S. Pat. Nos. 5,756,353 and 5,804,212 (each specifically incorporated herein by reference in its entirety). Likewise, the delivery of drugs using intranasal microparticle resins (Takenaga et al., 1998) and lysophosphatidyl-glycerol compounds (U.S. Pat. No. 5,725,871, specifically incorporated herein by reference in its entirety) are also well-known in the pharmaceutical arts. Likewise, transmucosal drug delivery in the form of a polytetrafluoroetheylene support matrix is described in U.S. Pat. No. 5,780,045 (specifically incorporated herein by reference in its entirety).

The term aerosol refers to a colloidal system of finely divided solid of liquid particles dispersed in a liquefied or pressurized gas propellant. The typical aerosol of the present invention for inhalation will consist of a suspension of active ingredients in liquid propellant or a mixture of liquid propellant and a suitable solvent. Suitable propellants include hydrocarbons and hydrocarbon ethers. Suitable containers will vary according to the pressure requirements of the propellant. Administration of the aerosol will vary according to subject's age, weight and the severity and response of the symptoms.

IX. Combination Therapy

In some embodiments, in order to increase the effectiveness of a didemnin or didemnin derivative, it may be desirable to combine these compositions with other agents effective in the treatment of hyperproliferative disease, such as anti-cancer agents. An "anti-cancer" agent is capable of negatively affecting cancer in a subject, for example, by killing cancer cells, inducing apoptosis in cancer cells, reducing the growth rate of cancer cells, reducing the incidence or number of metastases, reducing tumor size, inhibiting tumor growth, reducing the blood supply to a tumor or cancer cells, promoting an immune response against cancer cells or a tumor, preventing or inhibiting the progression of cancer, or increasing the lifespan of a subject with cancer. More generally, these other compositions would be provided in a combined amount effective to kill or inhibit proliferation of the cell. This process may involve contacting the cells with the didemnin or didemnin derivative and the agent(s) or multiple factor(s) at the same time. This may be achieved by contacting the cell with a single composition or pharmacological formulation that includes both agents, or by contacting the cell with two distinct compositions or formulations, at the same time, wherein one composition includes the expression construct and the other includes the second agent(s).

Tumor cell resistance to chemotherapy and radiotherapy agents represents a major problem in clinical oncology. One goal of current cancer research is to find ways to improve the efficacy of chemo- and radiotherapy by combining it with other therapy. In the context of the present invention, it is contemplated that a didemnin or didemnin derivative could be used in conjunction with chemotherapeutic, radiotherapeutic, or immunotherapeutic intervention, for example.

The didemnin or didemnin derivative therapy may precede or follow the other agent treatment by intervals ranging from minutes to weeks. In embodiments where the other agent and expression construct are applied separately to the cell, one would generally ensure that a significant period of time did not expire between the time of each delivery, such that the agent and didemnin or didemnin derivative would still be able to exert an advantageously combined effect on the cell. In such instances, it is contemplated that one may contact the cell with both modalities within about 12-24 h of each other and, more preferably, within about 6-12 h of each other. In some situations, it may be desirable to extend the time period for treatment significantly, however, where several d (2, 3, 4, 5, 6 or 7) to several wk (1, 2, 3, 4, 5, 6, 7 or 8) lapse between the respective administrations.

Various combinations may be employed, didemnin or didemnin derivative therapy is "A" and the secondary agent, such as radio- or chemotherapy (for example), is "B":

A/B/A B/A/B B/B/A A/A/B A/B/B B/A/A A/B/B/B B/A/ B/B
B/B/B/A B/B/A/B A/A/B/B A/B/A/B A/B/B/A B/B/A/A
B/A/B/A B/A/A/B A/A/A/B B/A/A/A A/B/A/A A/A/B/A

Administration of the therapeutic didemnin or didemnin derivative of the present invention to a patient will follow general protocols for the administration of chemotherapeutics, taking into account the toxicity, if any, of the vector. It is expected that the treatment cycles would be repeated as necessary. It also is contemplated that various standard therapies, as well as surgical intervention, may be applied in combination with the described hyperproliferative cell therapy.

A. Chemotherapy

Cancer therapies also include a variety of combination therapies with both chemical and radiation based treatments. Combination chemotherapies include, for example, cisplatin (CDDP), carboplatin, procarbazine, mechlorethamine, cyclophosphamide, camptothecin, ifosfamide, melphalan, chlorambucil, busulfan, nitro surea, dactinomycin, daunorubicin, doxorubicin, bleomycin, plicomycin, mitomycin, etoposide (VP16), tamoxifen, raloxifene, estrogen receptor binding agents, taxol, gemcitabien, navelbine, farnesyl-protein tansferase inhibitors, transplatinum, 5-fluorouracil, vincristin, vinblastin and methotrexate, or any analog or derivative variant of the foregoing.

B. Radiotherapy

Other factors that cause DNA damage and have been used extensively include what are commonly known as γ-rays, X-rays, and/or the directed delivery of radioisotopes to tumor cells. Other forms of DNA damaging factors are also contemplated such as microwaves and UV-irradiation. It is most likely that all of these factors effect a broad range of damage on DNA, on the precursors of DNA, on the replication and repair of DNA, and on the assembly and maintenance of chromosomes. Dosage ranges for X-rays range from daily doses of 50 to 200 roentgens for prolonged periods of time (3 to 4 wk), to single doses of 2000 to 6000 roentgens. Dosage ranges for radioisotopes vary widely, and depend on the half-life of the isotope, the strength and type of radiation emitted, and the uptake by the neoplastic cells.

The terms "contacted" and "exposed," when applied to a cell, are used herein to describe the process by which a therapeutic construct and a chemotherapeutic or radiotherapeutic agent are delivered to a target cell or are placed in direct juxtaposition with the target cell. To achieve cell killing or stasis, both agents are delivered to a cell in a combined amount effective to kill the cell or prevent it from dividing.

C. Immunotherapy

Immunotherapeutics, generally, rely on the use of immune effector cells and molecules to target and destroy cancer cells. The immune effector may be, for example, an antibody specific for some marker on the surface of a tumor cell. The antibody alone may serve as an effector of therapy or it may recruit other cells to actually effect cell killing. The antibody also may be conjugated to a drug or toxin (chemotherapeutic, radionuclide, ricin A chain, cholera toxin, pertussis toxin, etc.) and serve merely as a targeting agent. Alternatively, the effector may be a lymphocyte carrying a surface molecule that interacts, either directly or indirectly, with a tumor cell target. Various effector cells include cytotoxic T cells and NK cells.

Immunotherapy, thus, could be used as part of a combined therapy, in conjunction with didemnin or didemnin derivative therapy. The general approach for combined therapy is discussed below. Generally, the tumor cell must bear some marker that is amenable to targeting, i.e., is not present on the majority of other cells. Many tumor markers exist and any of these may be suitable for targeting in the context of the present invention. Common tumor markers include carcinoembryonic antigen, prostate specific antigen, urinary tumor associated antigen, fetal antigen, tyrosinase (p97), gp68, TAG-72, HMFG, Sialyl Lewis Antigen, MucA, MucB, PLAP, estrogen receptor, laminin receptor, erb B and p155.

D. Genes

In yet another embodiment, the secondary treatment is a gene therapy in which a therapeutic polynucleotide is administered before, after, or at the same time as the didemnin or didemnin derivative. Delivery of didemnin or a didemnin derivative with a vector encoding one of a therapeutic gene product will have a combined anti-hyperproliferative effect on target tissues. Alternatively, a single vector encoding both genes may be used. A variety of proteins are encompassed within the invention, including inducers of cellular proliferation, inhibitors of cellular proliferation, or regulators of programmed cell death, for example.

E. Surgery

Approximately 60% of persons with cancer will undergo surgery of some type, which includes preventative, diagnostic or staging, curative and palliative surgery. Curative surgery is a cancer treatment that may be used in conjunction with other therapies, such as the treatment of the present invention, chemotherapy, radiotherapy, hormonal therapy, gene therapy, immunotherapy and/or alternative therapies.

Curative surgery includes resection in which all or part of cancerous tissue is physically removed, excised, and/or destroyed. Tumor resection refers to physical removal of at least part of a tumor. In addition to tumor resection, treatment by surgery includes laser surgery, cryosurgery, electrosurgery, and miscopically controlled surgery (Mohs' surgery). It is further contemplated that the present invention may be used in conjunction with removal of superficial cancers, precancers, or incidental amounts of normal tissue.

Upon excision of part of all of cancerous cells, tissue, or tumor, a cavity may be formed in the body. Treatment may be accomplished by perfusion, direct injection or local application of the area with an additional anti-cancer therapy. Such treatment may be repeated, for example, every 1, 2, 3, 4, 5, 6, or 7 days, or every 1, 2, 3, 4, and 5 weeks or every 1, 2, 3, 4, 5, 6, 7, 8, 9, 10, 11, or 12 months. These treatments may be of varying dosages as well.

F. Other Agents

It is contemplated that other agents may be used in combination with the present invention to improve the therapeutic efficacy of treatment. These additional agents include immunomodulatory agents, agents that affect the upregulation of cell surface receptors and GAP junctions, cytostatic and differentiation agents, inhibitors of cell adhesion, or agents that increase the sensitivity of the hyperproliferative cells to apoptotic inducers. Immunomodulatory agents include tumor necrosis factor; interferon alpha, beta, and gamma; IL-2 and other cytokines; F42K and other cytokine analogs; or MIP-1, MIP-1beta, MCP-1, RANTES, and other chemokines. It is further contemplated that the upregulation of cell surface receptors or their ligands such as Fas/Fas ligand, DR4 or DR5/TRAIL would potentiate the apoptotic inducing abilities of the present invention by establishment of an autocrine or paracrine effect on hyperproliferative cells. Increases intercellular signaling by elevating the number of GAP junctions would increase the anti-hyperproliferative effects on the neighboring hyperproliferative cell population. In other embodiments, cytostatic or differentiation agents can be used in combination with the present invention to improve the anti-hyerproliferative efficacy of the treatments. Inhibitors of cell adehesion are contemplated to improve the efficacy of the present invention. Examples of cell adhesion inhibitors are focal adhesion kinase (FAKs) inhibitors and Lovastatin. It is further contemplated that other agents that increase the sensitivity of a hyperproliferative cell to apoptosis, such as the antibody c225, could be used in combination with the present invention to improve the treatment efficacy.

Hormonal therapy may also be used in conjunction with the present invention or in combination with any other cancer therapy previously described. The use of hormones may be employed in the treatment of certain cancers such as breast, prostate, ovarian, or cervical cancer to lower the level or block the effects of certain hormones such as testosterone or estrogen. This treatment is often used in combination with at least one other cancer therapy as a treatment option or to reduce the risk of metastases.

X. Kits of the Invention

Any of the compositions described herein may be comprised in a kit, including, for example, one or more bacteria, media reagents, and so forth. In some embodiments, one or more reagents to assist in fermentation of didemnin in bacteria is provided in a kit. In certain aspects, one or more compounds for use in preparing a didemnin derivative from an endogenously produced *Tistrella* didemnin is included in the kit.

The kits may comprise a suitably aliquoted composition of the present invention. The components of the kits may be packaged either in aqueous media or in lyophilized form, where appropriate. The container means of the kits will generally include at least one vial, test tube, flask, bottle, syringe or other container means, into which a component may be placed, and preferably, suitably aliquoted. Where there are more than one component in the kit, the kit also will generally contain a second, third or other additional container into which the additional components may be separately placed. However, various combinations of components may be comprised in a vial. The kits of the present invention also will typically include a means for containing the kit component(s) in close confinement for commercial sale. Such containers may include injection or blow molded plastic containers into which the desired vials are retained.

However, the components of the kit may be provided as dried powder(s). When reagents and/or components are provided as a dry powder, the powder can be reconstituted by the addition of a suitable solvent. It is envisioned that the solvent may also be provided in another container means.

EXAMPLES

The following examples are included to demonstrate preferred embodiments of the invention. It should be appreciated by those of skill in the art that the techniques disclosed in the examples which follow represent techniques discovered by the inventor to function well in the practice of the invention, and thus can be considered to constitute preferred modes for its practice. However, those of skill in the art should, in light of the present disclosure, appreciate that many changes can be made in the specific embodiments which are disclosed and still obtain a like or similar result without departing from the spirit and scope of the invention.

Example 1

Exemplary Methods

Strain, Fermentation and Isolation of Didemnin Compounds

*Tistrella mobilis* was isolated from seawater collected from the Red Sea during a 2009 research cruise. Its crude extract showed remarkable cytotoxicity on HeLa cells in a bioactive compound screening of Red Sea bacteria. *T. mobilis* was grown on GYP medium [10 g of glucose/4 g of yeast extract/2 g of peptone/17 g of sea salts/1 liter of deionized water] using 50-liter stirred fermenters at 25° C. for 72 h. At the end of fermentation, ethyl acetate was added to the culture to extract the metabolites. The crude extract was then fractionated by reverse-phase C18 liquid chromatography and eluted with increasing amounts of methanol in water. The active fraction was further purified by semi-preparative reverse-phase HPLC with 63% acetonitrile in water at a flow rate of 3 milliliter per minute. Didemnin B and nordidemnin B were eluted at 25 and 22 minute respectively.

Genome Sequencing, Annotation, and Analysis

The nucleotide sequence of the *T. mobilis* genome was determined by using a massively parallel pyrosequencing technology (Roche 454 GS FLX). 112 contigs (>500 bp) with a total size of 6.4 Mb were assembled from 315,496 reads (average length of 334 bp) using Newbler software of the 454 suite package, providing an 18.4-fold coverage. In addition, 2,625,640 sequences with average length 115 bps of mate-pair produced by the Illumina sequencing system were mapped to the genome sequence to promote sequence quality and construct a scaffold. All the contig relationships within scaffolds were validated by PCR, and the relationship among scaffolds was determined by multiplex PCR. Gaps were filled by sequencing PCR products. The final sequence assembly was carried out using phred/phrap/consed package (see the World Wide website of the Genome Center at the University of Washington), and the low sequence quality region was resequenced. The final error rate of genome sequence was 0.28 per 100,000 bases.

Protein-coding sequences (CDS) were determined by combining the prediction results of Glimmer 3.02 and Z-Curve programs. Functional annotation of CDS were performed by searching the NCBI non-redundant protein database and KEGG protein database. tRNA genes were predicted with tRNAScan-SE (v1.23). Protein domain prediction and COG assignment were performed by RPS-BLAST using the NCBI CDD library.

In Silico Analysis of Didemnin Biosynthetic Gene Cluster and Other NRPS in *T. mobilis* Genome The roles of the proteins, in embodiments of the invention, in the didemnin gene cluster were assigned using protein-protein BLAST and Pfam analysis. The NRPS A domain specificity was predicted using online program NRPSpredictor (Rausch 2005). The nucleotide sequences of the gene cluster can be deposited at GenBank®, for example.

Example 2

General Genome Feature of *Tistrella mobilis* and Associated NRPS Gene Clusters

Isolation of Didemnins from *Tistrella mobilis*

Figure 2:
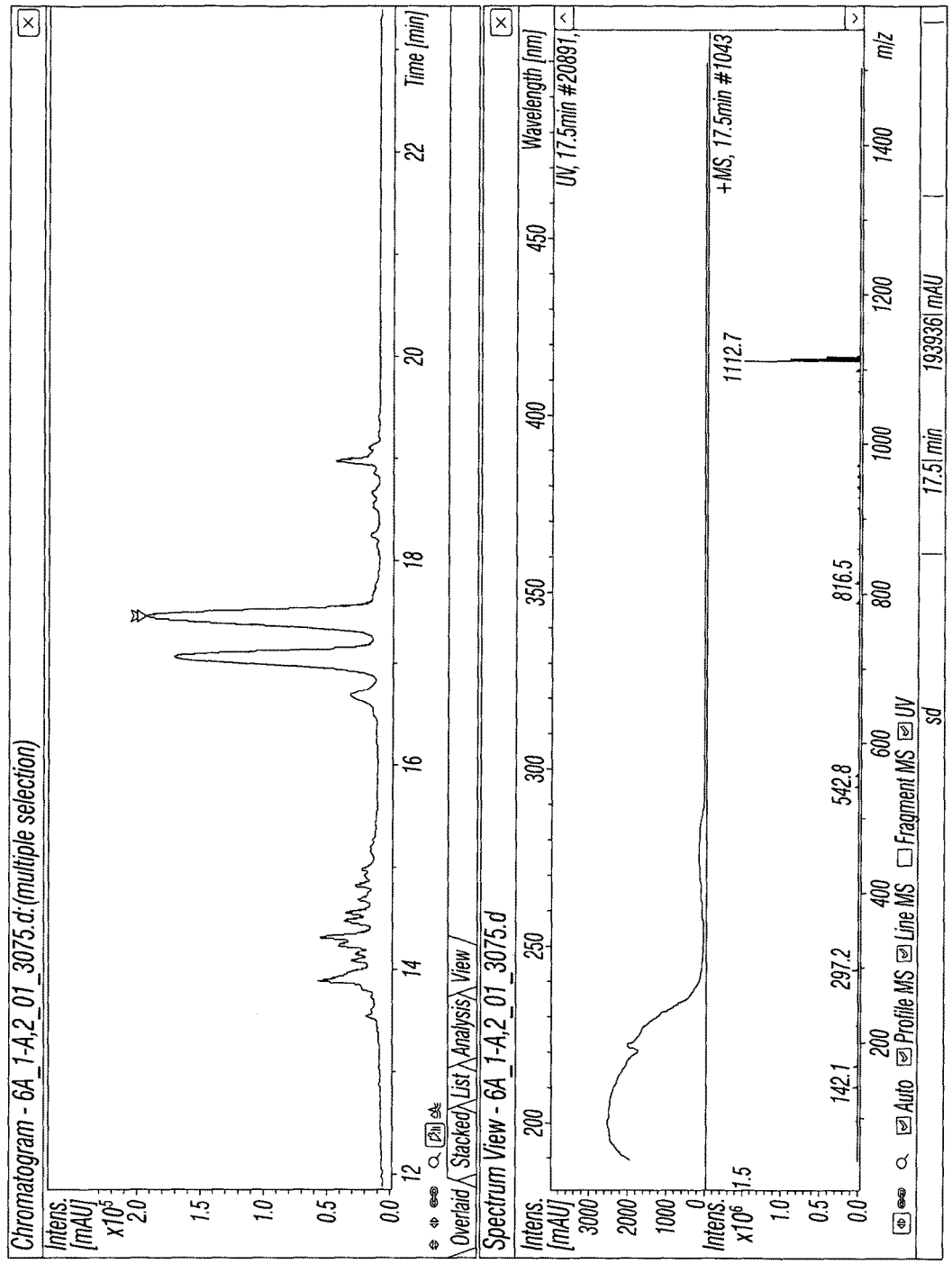
FIG. 2 provides detection of didemnin B (upper panel) and nordidemnin B (lower panel) in one of the fractions of *Tistrella mobilis* crude extract using UPLC-HRMS analysis.
Figure 2:
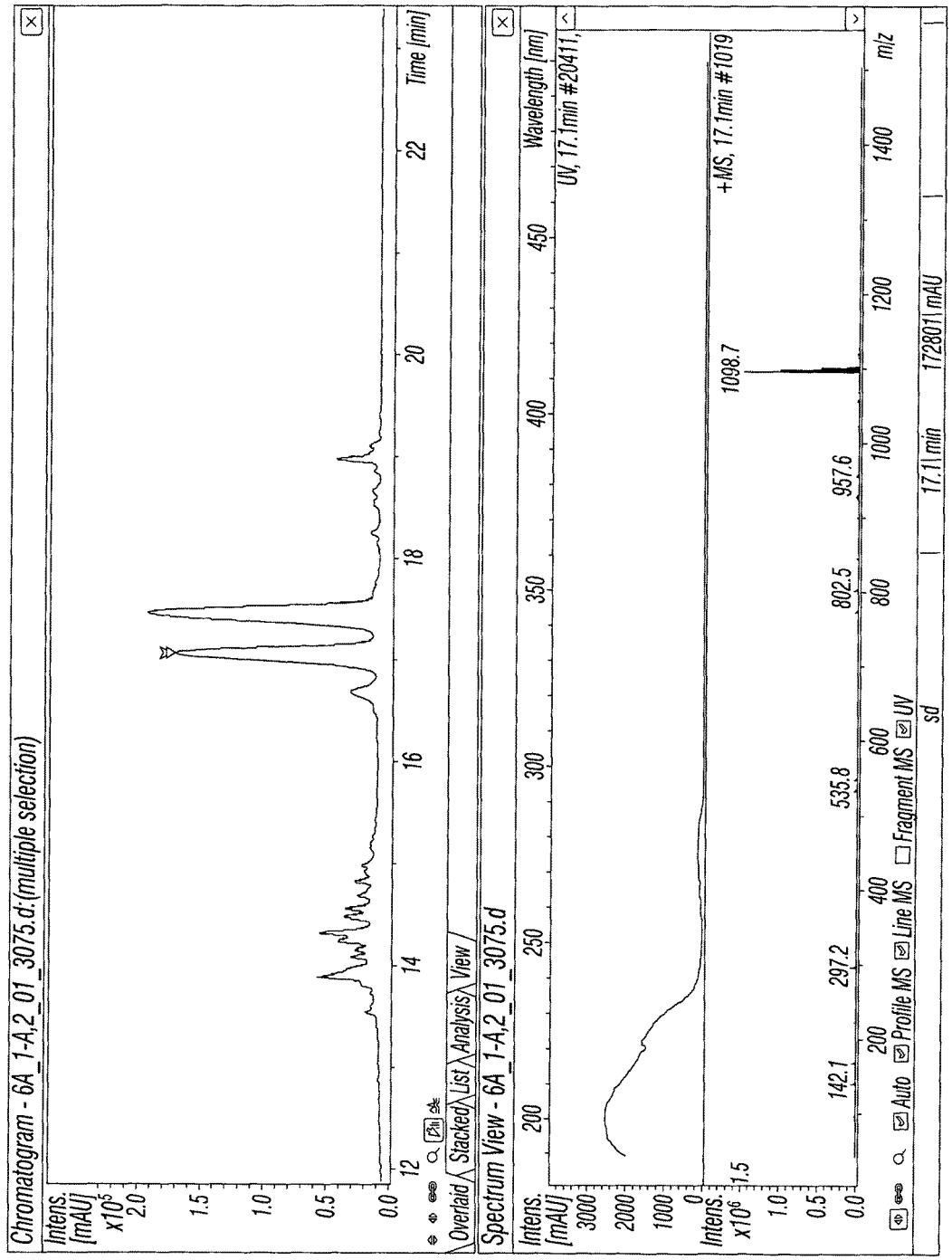

The bacterium was noted for its astonishing cytotoxic activity during a screening program of bacteria isolated from the Red Sea for cytotoxic activity. Its ethyl acetate crude extract of culture broth could kill the HeLa cells at a concentration lower than 1 ng/ml. The bacterium was then fermented to 70 l and the ethyl acetate extract was subjected to reverse phase column chromatography using 15%, 30%, 45%, 60%, 70%, 90% and 100% methanol in water, respectively. Fractions eluted using 60% and 70% showed strong cytotoxic activity using HCT-116 human colon carcinoma cell. One active fraction was identified with peptide signals, using $^1$H-NMR analysis and MS analysis to reveal two separate peaks with [M+H] of 1098.7 and 1112.7, respectively (FIG. 2). We purified both compounds using semi-preparative HPLC and both of them showed strong cytotoxic activity at a concentration of 0.074 ng/ml. Using NMR, MS and the AntiMarin database, we identified these two compounds to be didemnin B and nordidemnin B. A pure form didemnin B was acquired from Prof. Chris Ireland at the University of California, Santa Cruz, who with coworkers, isolated it from the tunicate *Trididemnum solidum*. This sample was used to compare its NMR spectral data with the present data and to further confirm that the compound isolated from *T. mobilis* was didemnin B. Moreover, other fractions from *T. mobilis* also exhibited similar bioactivity and LC-MS analysis showed the presence of other didemnins, including didemnin A, and didemnin C, at trace amounts. This is consistent with the fact that didemnin B and nordidemnin B were the most abundant in the *Trididemnum* tunicates.

Biosynthetic Pathways of Didemnins

The putative biosynthetic gene cluster for didemnins contains 26 ORFs (Table 2).

TABLE 2

Deduced functions of the proteins in the didemnin biosynthetic gene cluster

| gene | Amino acid aa) | Sequence similarity/organism | Proposed function | Identity/similarity | GenBank accession no. |
|---|---|---|---|---|---|
| orf1 | 261 | thioesterase, *Actinomadura kijaniata* | Thioesterase | 41%, 54% | ACB46473 |
| orf2 | 483 | band 7 protein, *Methylobacter tundripaludum* SV96 | | 50%, 68% | ZP_07653046 |
| orf3 | 560 | cyclic peptide transporter, *Methylobacter tundripaludum* SV96 | transporter | 48%, 68% | ZP_07653047 |
| orf4 | 70 | No hits | | | |
| orf5 | 190 | GTPase domain-containing protein, *Methylobacter tundripaludum* SV96 | | 39%, 57% | ZP_07653048 |
| orf6 | 987 | hydrophobic/amphiphilic exporter-1, *Azospirillum* sp. B510 | Resistance | 38%, 56% | YP_003450508 |
| orf7 | 377 | secretion protein, *Azospirillum* sp. B510 | Resistance | 28%, 47% | YP_003450507 |
| didA | 2123 | OciA protein, *Planktothrix rubescens* NIVA-CYA 98 | NRPS (C A T C A T) | 29%, 40% | CAQ48254 |
| didB | 1796 | linear gramicidin synthetase subunit D, *Stigmatella aurantiaca* DW4/3-1 | NPRS (C A KR T) | 36%, 48% | ZP_01459555 |
| didC | 1330 | NRPS, *Myxococcus xanthus* DK 1622 | NRPS (C A T C*) | 41%, 52% | YP_632257 |
| didD | 3853 | amino acid adenylation domain protein, *Streptomyces violaceusniger* Tu 4113 | NRPS (C A M T C* C A T C A T) | 39%, 50% | ZP_07603194 |
| didE | 1705 | amino acid adenylation domain protein, *Acetivibrio cellulolyticus* CD2 | NRPS/PKS (KS KR T C) | 36%, 53% | ZP_07325073 |
| didF | 1613 | HctF, *Lyngbya majuscula* | NRPS (A* A KR T) | 35%, 52% | AAY42398 |
| didG | 1413 | NRPS/PKS, *Amycolatopsis mediterranei* U32 | PKS (KS M T) | 46%, 56% | YP_003765866 |
| didH | 1286 | NRPS/PKS, *Myxococcus xanthus* DK 1622 | NRPS (C A T C*) | 39%, 53% | YP_631961 |

TABLE 2-continued

Deduced functions of the proteins in the didemnin biosynthetic gene cluster

| gene | Amino acid aa) | Sequence similarity/organism | Proposed function | Identity/ similarity | GenBank accession no. |
|---|---|---|---|---|---|
| didI | 873 | NRPS, *Myxococcus xanthus* DK 1622 | NRPS (C A T) | 39%, 52% | YP_632257 |
| didJ | 2163 | amino acid adenylation domain protein, *Lyngbya majuscula* 3L | NRPS (C A M M T TE) | 36%, 53% | ZP_08431746 |
| orf8 | 77 | MbtH domain-containing protein, *Herpetosiphon aurantiacus* ATCC 23779 | MbtH-like protein | 80%, 89% | YP_001542806 |
| orf9 | 68 | hypothetical protein, *Acidovorax* sp. JS42 | | 79%, 91% | YP_986866 |
| orf10 | 45 | No hits | | | |
| orf11 | 60 | No hits | | | |
| orf12 | 190 | hypothetical protein, *Acidovorax* sp. JS42 | | 94%, 97% | YP_986861 |
| orf13 | 75 | hypothetical protein, *Acidovorax* sp. JS42 | | 98%, 100% | YP_004387524 |
| orf14 | 324 | CAAX amino terminal protease family, *Synechococcus* sp. PCC 7335 | | 30%, 49% | ZP_05035401 |
| orf15 | 398 | cyanate transport system protein, *Pseudomonas syringae* pv. *syringae* 642 | | 40%, 52% | ZP_07265073 |
| orf16 | 255 | GntR family transcriptional regulator, *Chromobacterium violaceum* ATCC 12472 | Regulation | 39%, 55% | NP_903400 |

Figure 3:
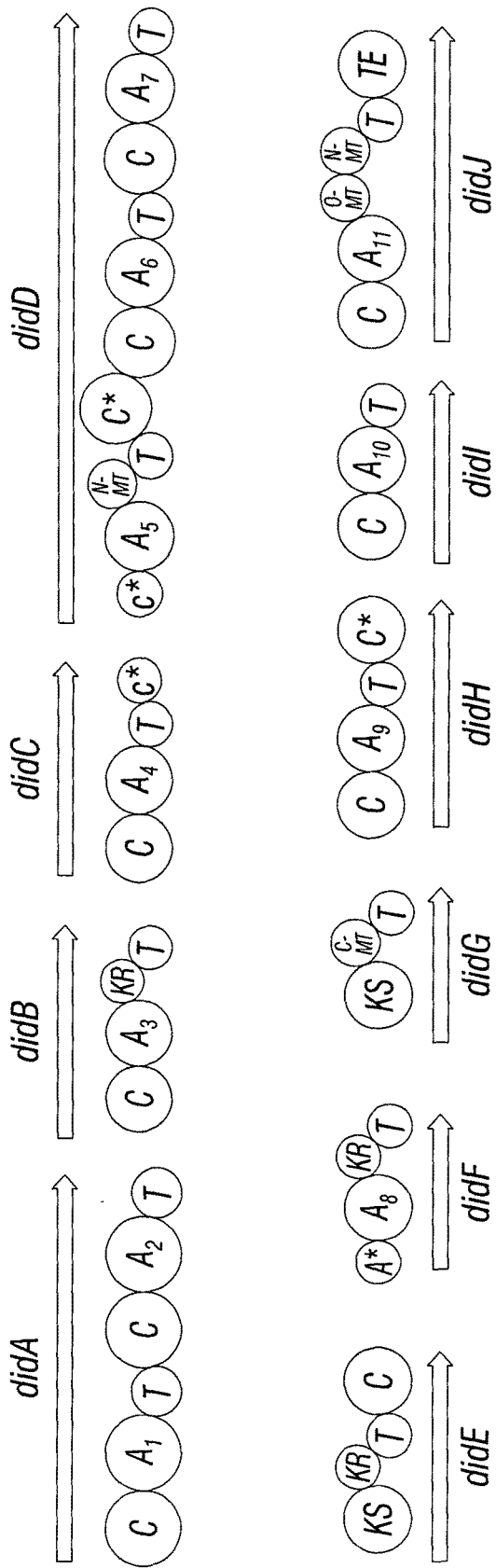
FIG. 3 shows organization of didemnin NRPS-PKS system.

Ten of them, didA to didJ, are most likely to be involved in the biosynthesis of didemnins (FIG. 3). All of them encode for non-ribosomal peptide synthetase (NRPS) except didE and didG. Most NRPS are modular enzymes that use an assembly line strategy to synthesize nonribosomal peptides. A typical module in the NRPS assembly line usually has a minimal of three domains: the adenylation domain (A) activates a specific amino acid via the formation of an acyl-AMP; the activated form of the amino acid is then loaded to an adjacent thiolation (T) domain; and the condensation (C) domain catalyzes peptide bond formation. In addition to these three basic domains, different tailoring domains, such as ketoreductase (KR) domains or methyltransferase (MT) domains, are sometimes present in NRPS modules. These tailoring domains make modification of the amino acids and they are one of the main reasons that many non-ribosomal peptides contain non-proteinogenic amino acid momoners. Most NRPS generally follow a colinearity principle wherein the A domain specificity and placement within the NRPS assembly line dictates the sequence of the monomers in the nonribosomal peptide (Marahiel et al. 1997; Fischbach and Walsh 2006). Analysis of the substrate specificity of the A domains by NPRSpredictor can substantially help match the A domains with the corresponding amino acid substrate. There are a total of 11 A domains in the eight NRPS in the didemnin gene clusters and it is the specificity of these A domains that leads us to postulate that this gene cluster is responsible for didemnin synthesis (Table 3).

| protein | Adenylation domain | 10 amino acid code | Substrate | Identity, % |
|---|---|---|---|---|
| DidA | $A_1$ | DAWQFGLIDK (SEQ ID NO: 1) | Glutamine | 100 |
| DidA | $A_2$ | DAWQFGLIDK (SEQ ID NO: 1) | Glutamine | 100 |
| DidB | $A_3$ | DHPWIAETVK (SEQ ID NO: 2) | (pyruvic acid) | |
| DidC | $A_4$ | DVQFAAQVVK (SEQ ID NO: 3) | Proline | 90 |
| DidD | $A_5$ | DAWFLGHVVK (SEQ ID NO: 4) | Leucine | 90 |
| DidD | $A_6$ | DFWNIGMVHK (SEQ ID NO: 5) | Threonine | 100 |
| DidD | $A_7$ | DAFFLGITFK (SEQ ID NO: 6) | Ile | 90 |
| DidF | $A_8$ | No code | (2-oxoisovaleric acid) | |
| DidH | $A_9$ | DAWFLGNVVK (SEQ ID NO: 7) | Leucine | 100 |
| DidI | $A_{10}$ | DVQFAAQVVK (SEQ ID NO: 8) | Proline | 90 |
| DidJ | $A_{11}$ | DASTLAAVCK (SEQ ID NO: 9) | Tyrosine | 90 |

For example, the inventors found that in at least certain aspects the A domain of DidC activates proline while the first two A domains in DidD activate leucine and threonine, respectively. A fragment of the didemnin B happens to contain these three amino acids in the same sequence as they are activated by the corresponding A domains. Moreover, the leucine in the didemnin B has an N-terminal methyl group and this matches well with the fact that there is also a methylation domain right next to the A domain activating leucine. In a similar way, the inventors found the A domains in DidH, DidI and DidJ in certain embodiments activate leucine, proline and tyrosine. DidI contains a MT tailoring domain that will convert proline into N-methyl proline while DidJ contains two MT domains, one N-methyltransferase and one O-methyltransferase, which may respectively add a methyl group on the amine and hydroxyl group of the tyrosine. Leucine, N-methyl proline and N,O-dimethyl tyrosine together make another fragment of the didemnin B.

Figure 4:
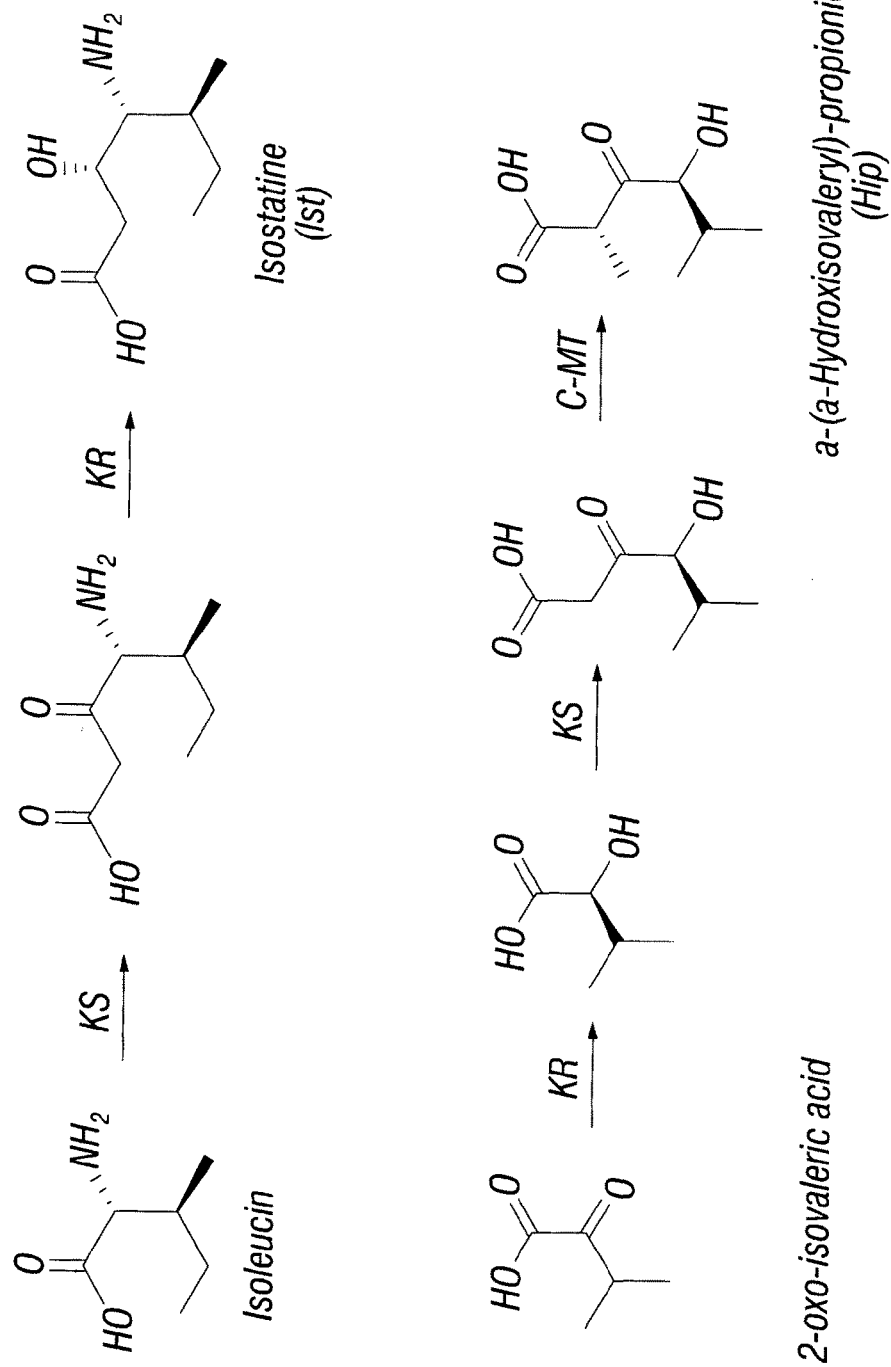
FIG. 4 illustrates an exemplary incorporation of the two monomers Ist and Hip into didemnin B. Reactions are simplified by taking out the thiol-tethered peptidyl intermediates.
Figure 5:
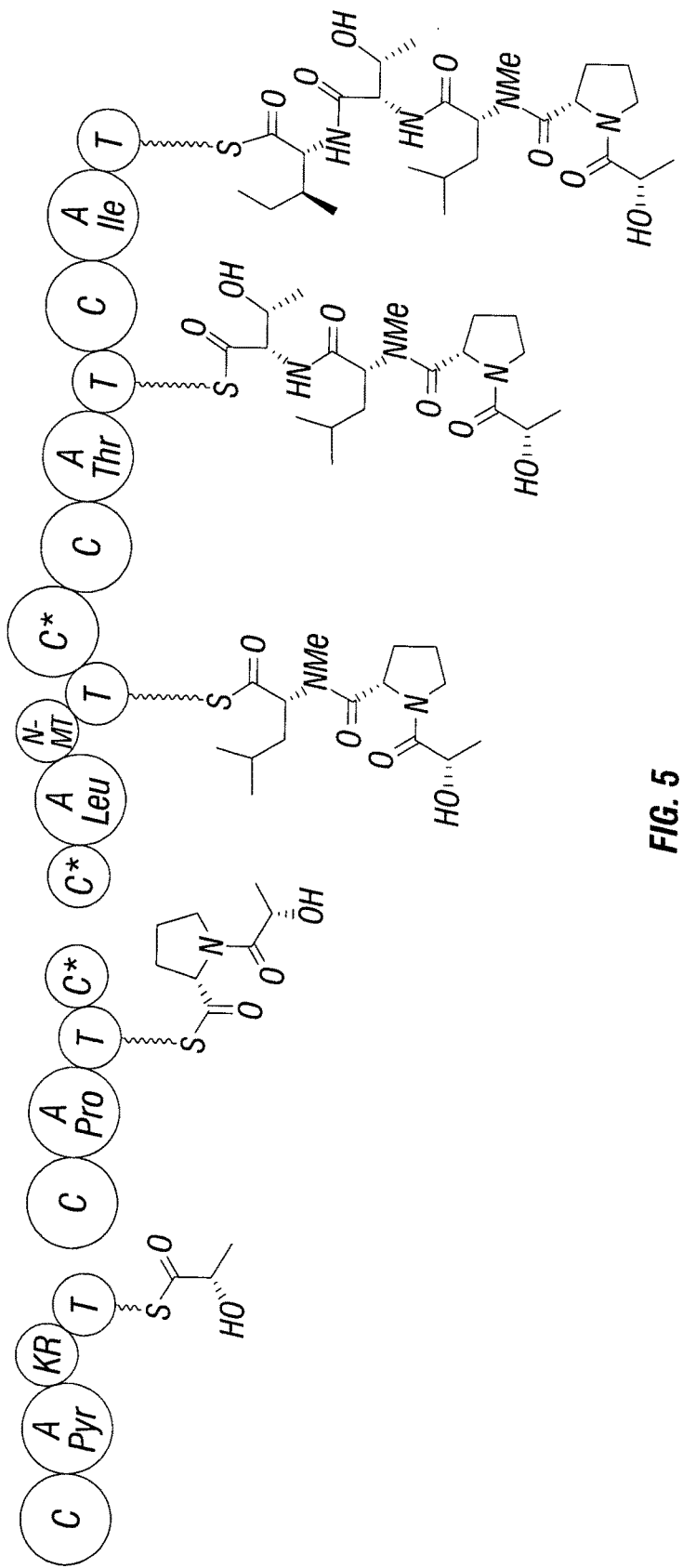
FIG. 5 shows an exemplary biosynthetic pathway of didemnin B. C: condensation domain. A: adenylation domain. T: thiolation domain. KR: ketoreductase domain. KS: ketosynthase domain. MT: methyl transferase domain. TE: thioesterase domain.
Figure 5:
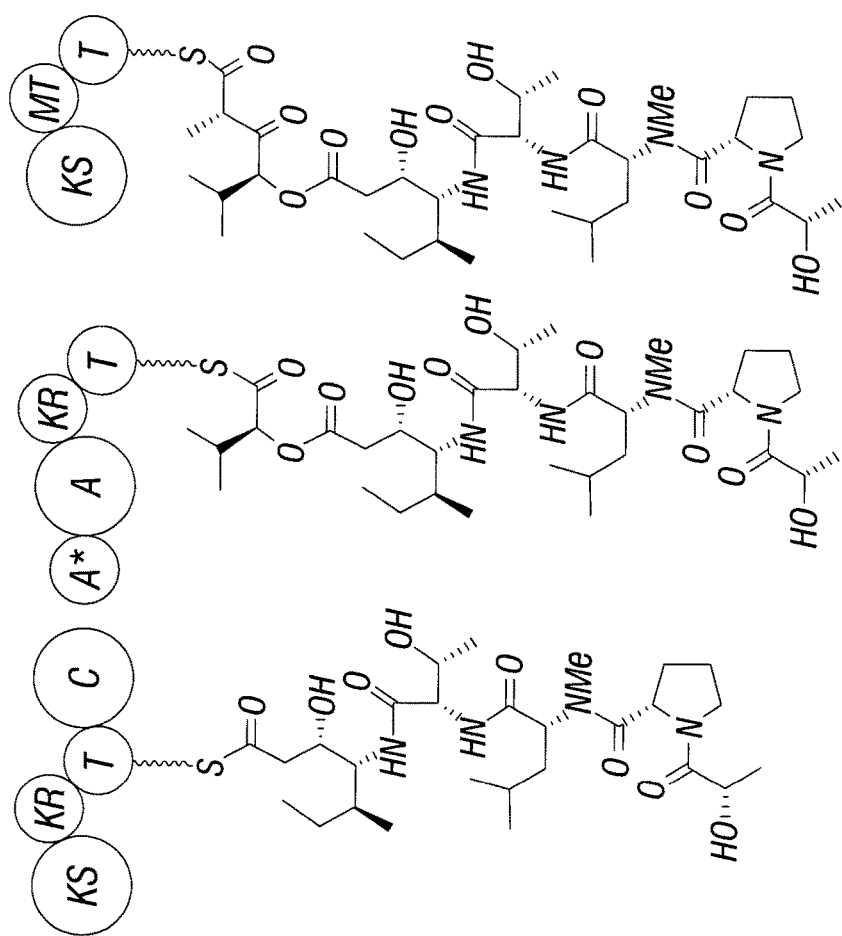
Figure 5:
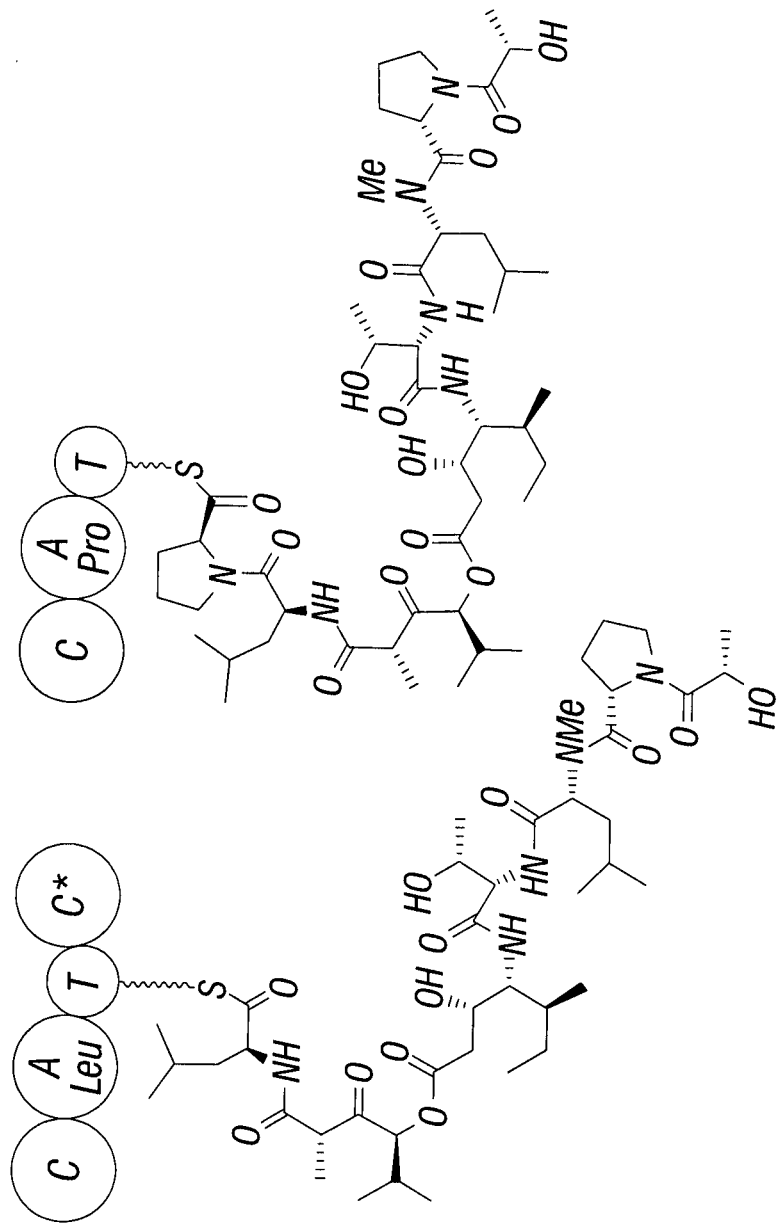
Figure 5:
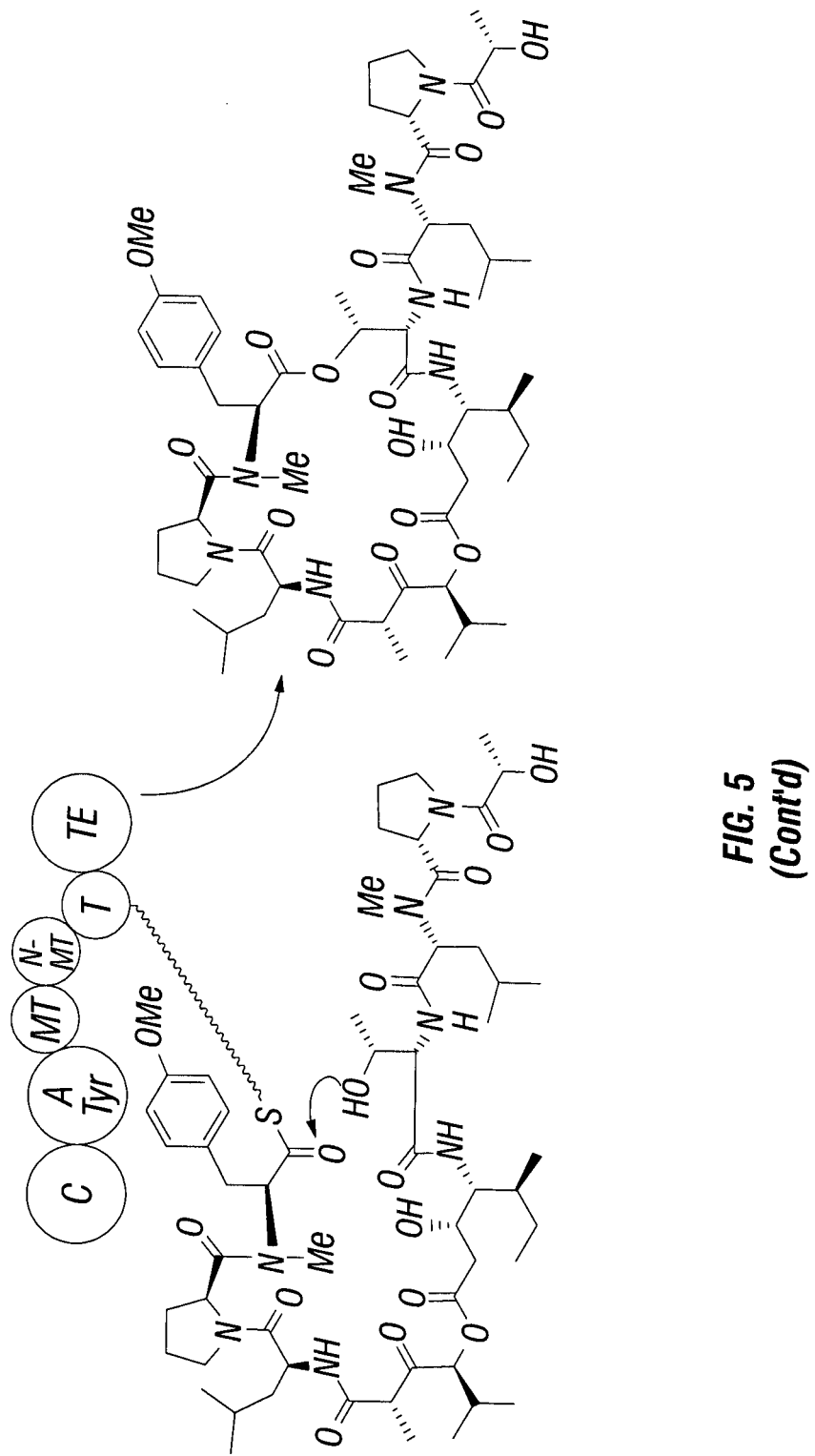

The remaining monomers of the didemnin B are a lactic acid (Lac), an isostatine (Ist) and an α-(α-hydroxyisovaleryl)-propionic acid (Hip). According to the colinearity rule, DidB, which contains four domains (C-A-KR-T), should be the module that feeds the lactic acid into didemnin B. Although NRPSpredictor fails to predict a reliable substrate for the didB A domain, BLAST search of its sequence shows that it is highly similar to one of the A domains found in the valinomycin gene cluster. According to Chen (2006), this A domain may activate pyruvic acid. The pyruvic acid is then reduced to lactic acid, which is also a monomer of valinomycin. Therefore, the A domain in DidB may first activate pyruvic acid and the KR domain then comes to reduce the pyruvic acid to lactic acid, which is exactly the same scenario in the vancomycin gene cluster. The third A domain in DidD is most likely to activate isoleucine according to the code specificity analysis. Downstream to DidD is a hybrid polyketide sythetase/nonribosomal protein synthetase (PKS/NRPS) protein DidE comprising of a Ketosynthase domain (KS), a Ketoreductase (KR), a thiolation domain (T) and a condensation domain (C). It can be hypothesized that the after isoleucine is incorporated, the intermediate molecule bearing the isoleucine goes through a round of PKS reaction which contains two steps: 1) addition of a 2-carbon unit as a common PKS chain elongation step possibly using a malonyl-CoA as a substrate, and 2) the carbonyl group of the isoleucine is reduced to a hydroxyl group. This series of reactions can then explain the existence of the monomer Ist in the didemnin B molecule. However, the above PKS system features as the "AT-less" PKS system as no acyltransferase can be found in this module. Moreover, no stand alone AT genes can be found in the entire didemnin gene cluster and its vicinity, which is a very rare phenomenon in "AT-less" PKS systems as normally at least one stand alone AT gene can be found in the vicinity that functions in trans to catalyze the activation of the substrate, which most of the time would be a malonyl-CoA. Nevertheless, in certain aspects the Ist monomer is added through the joint effect of a NRPS module and a hybrid PKS/NPRS module. It is unlikely that a single step in which an A domain specifically activates Ist catalyzes the reaction as predicted by Salomon et al. (2004). Downstream of the didD gene are didE and didF, the former is a NRPS gene while the latter is a PKS gene. The A domain in DidE does not have a code specified for any known substrate, yet its amino acid sequence shares 43% identity and 60% similarity with that of the first adenylation domain of HetE of the cyanobacterium *Lyngbya majuscule* that produces the cyclic peptide hectochlorin. Ramaswamy et al. (2007) used the ATP-PPi exchange activity assay to demonstrate that the first A domain of HetE can activate 2-oxo-isovaleric acid. Therefore the A domain in DidE may first activate the 2-oxo-isovaleric acid, which is then reduced in situ by a KR domain in DidE to 2-hydroxyisovaleric acid (2-Hiv). The KS domain of DidF then adds a 2-carbon unit to the C-terminus of Hiv and the MT domain in DidF catalyzes the addition of a methyl group. The net outcome of this cascade of reactions is the incorporation of the monomer Hip into didemnin molecules (FIG. 4). This is very similar to the scenario of the addition of Ist in which a joint effort of two proteins eventually catalyze the addition of the necessary monomer into the final molecule. Finally, in some aspects the thioesterase domain of the DidJ catalyzes the macrocyclization between the hydroxyl group on the side chain of threonine residue and the thioester group of T domain bound tyrosine residue, resulting in the release of the mature cyclic depsipeptide didemnin compounds. Therefore, in certain embodiments of the invention didB to didJ are responsible for the biosynthesis of didemnin B (FIG. 5).

Apart from didemnin B, the inventors also isolated nordidemnin B, which contains the monomer norstatine, a very similar derivative of isostatine. Since the A domains usually have some flexibility in activating similar substrates, valine, instead of isoleucine, may also be activated by the third A domain of DidD and together with DidE, norstatine may therefore be incorporated to produce nordidemnin B, in some embodiments. Upstream of didB, didA encodes two modules of NRPS with the C-A-T-C-A-T domain organization. Both A domains have specified codes to activate glutamine. There are some other didemnins which have multiple glutamine residues preceding the lactic residue, such as didemnin X (FIG. 1) and didemnin Y. In some cases with didA, this gene cluster produces didemnin X or didemnin Y. Similar to plipastatin, didemnin X and didemnin Y are both N-acylated. It has been reported that the first C domain in the initiation module may catalyze the N-acylation of the first amino acid in some NRPS systems (Imker et al. 2010). However, further studies are performed to characterize this. Apart from didemnin B and nordidemnin B, the inventors also used UPLC-HRMS to detect many other didemnin derivatives, such as didemnin A and didemnin C by growing *T. mobilis* in different culture media or with different culture durations.

Additional ORFs in the Didemnin Gene Cluster

Besides the synthesis of didemnins, other genes that are possibly involved in the regulation, resistance and transport of the didemnins are also found in the didemnin gene cluster. Orf1, which encodes a type II thioesterase, may regenerate the misprimed NPRS which are inactive to ensure the NRPS assembly line is functional. Orf3, orf6 and orf7 all encode proteins related to the transport and secretion of the cyclic peptide and they may be responsible for the secretion of didemnins. As secretion and self-resistance are often related, they may also function as self-resistance genes to protect the producer. Orf8 encodes an MbtH-like protein that is a common resident of various NRPS systems. Although the precise function of MbtH-like proteins in NRPS systems has not been revealed, in specific aspects they play an important role in the production of many non-ribosomal peptides as indicated by Lautru et al., (2007). Orf16 encodes a Gnt-family transcription factor and this is the only transcription-related gene that can be found in the vicinity of the didemnin biosynthetic gene cluster. As GntR family transcription factors usually, though not always act as repressive regulators (Chen et al, 2010), orf16 may participate in the regulation of the biosynthesis of didemnins. It is also reasonable as overproduction of complicated didemnins could cause a huge waste of energy for the bacterium. Although didemnins have been reported for their potent cytotoxic, antivirus, immunosuppressive activities, the real ecological function of these compounds for the producing bacterium is unknown. To synthesize such complicated molecules, the bacterium has to invest considerable energy with good reason.

Manipulation of the Didemnin Gene Cluster

There are huge incentives to manipulate the didemnin gene cluster as didemnins other than didemnin B or nordidemnin B could be produced from this gene cluster. For example, there might be a way to produce dehydrodidemnin B (Aplidine), which is a promising antitumor drug currently in clinical trials (Le Tourneau et al. 2010, Mateos et al. 2010). The only difference between dehydrodidemnin B and didemnin B is that the former has a pyruvic acid monomer while the latter has a lactic acid. If the ketoreductase domain in didB can be knocked out, then the incorporated pyruvic acid will not be reduced to lactic acid and consequently, dehydrodidemnin B may be expected to be produced. Upon construction of the corresponding deletion mutant, there may be an alternative way to produce dehydrodidemnin B other than chemical synthesis, and the cost could be substantially reduced. In addition, as more than 10 mg/L didemnin B and nordidemnin B can be harvested from fermentation of Tistrella mobilis using a simple medium for as short as 3 days, improvement of the culture conditions may further increase the production of the didemnins. Because of their large molecular weight and high lipophilicity, purification of the didemnins is quite simple by chromatographic separation, for example, which in turn can provide the starting material to semisynthesize dehydrodidemnin B. Furthermore, genetic engineering of the didemnin gene cluster provides novel didemnin compounds with improved biological activities.

Example 3

Other Didemnins Produced by Tistrella Mobilis

Figure 6:
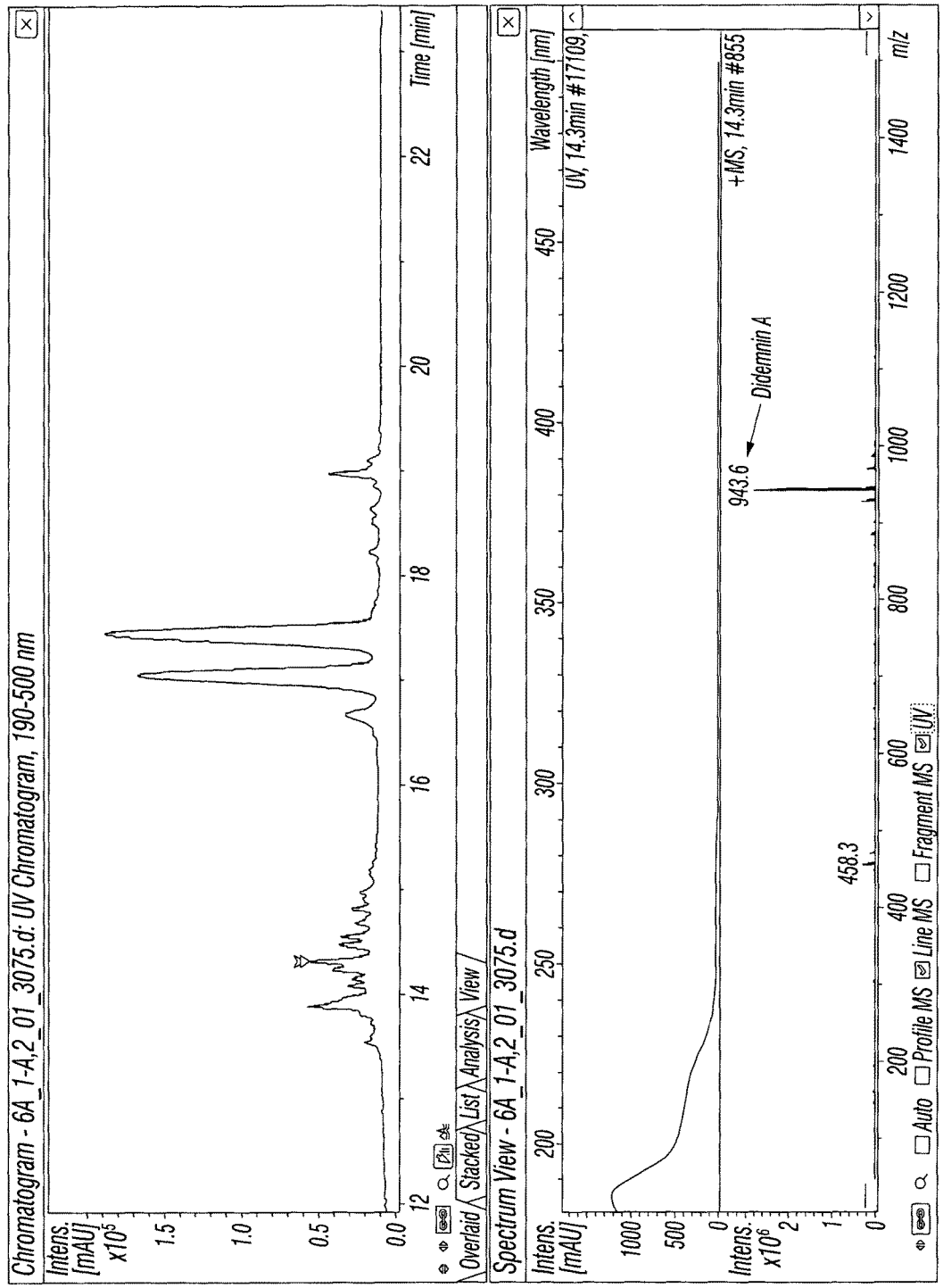
FIG. 6 shows detection of didemnin A from *Tistrella mobilis*.
Figure 7A:
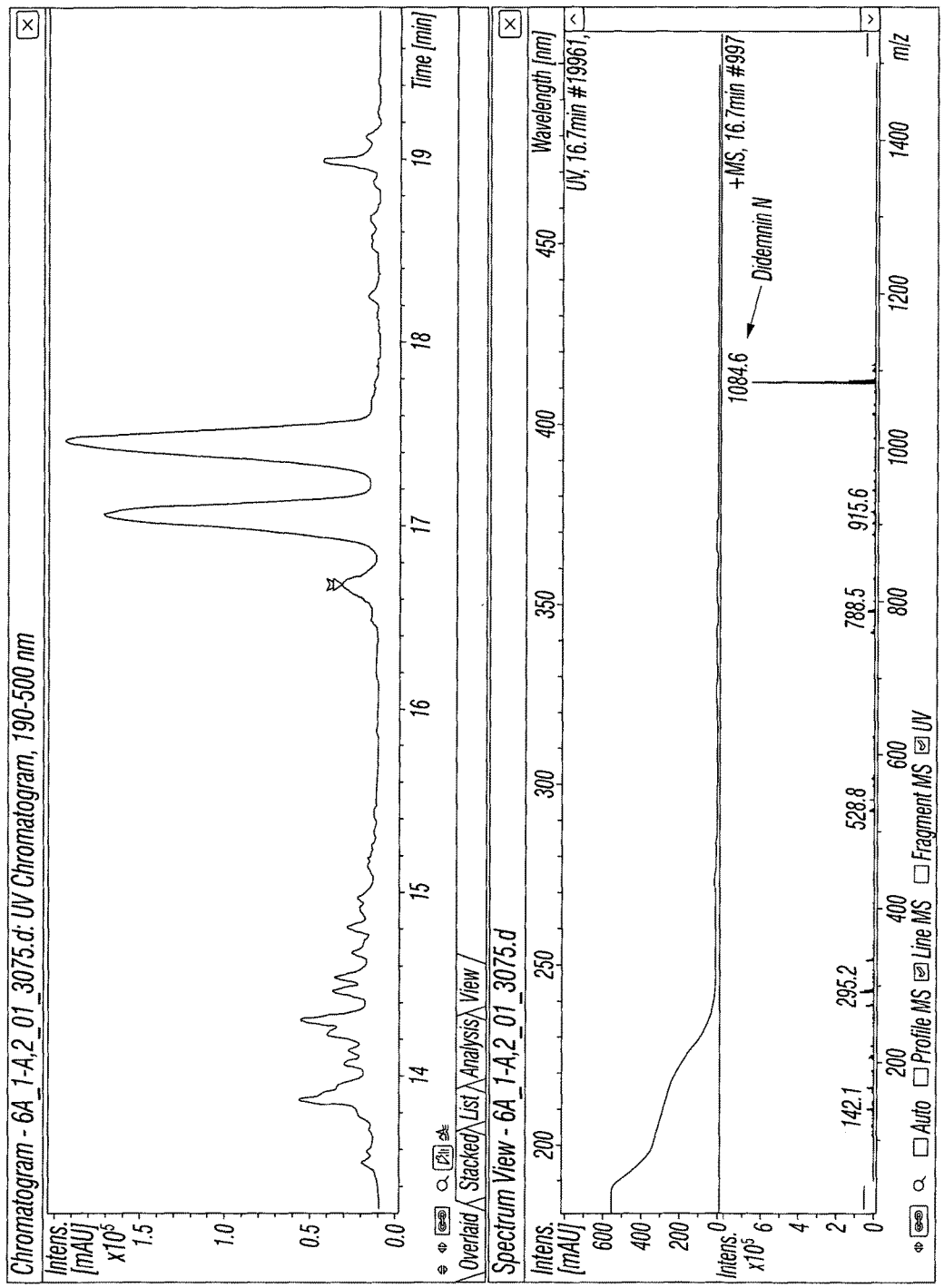
FIGS. 7A and 7B show detection of didemnin N and nordidemnin A from *Tistrella mobilis*.
Figure 7B:
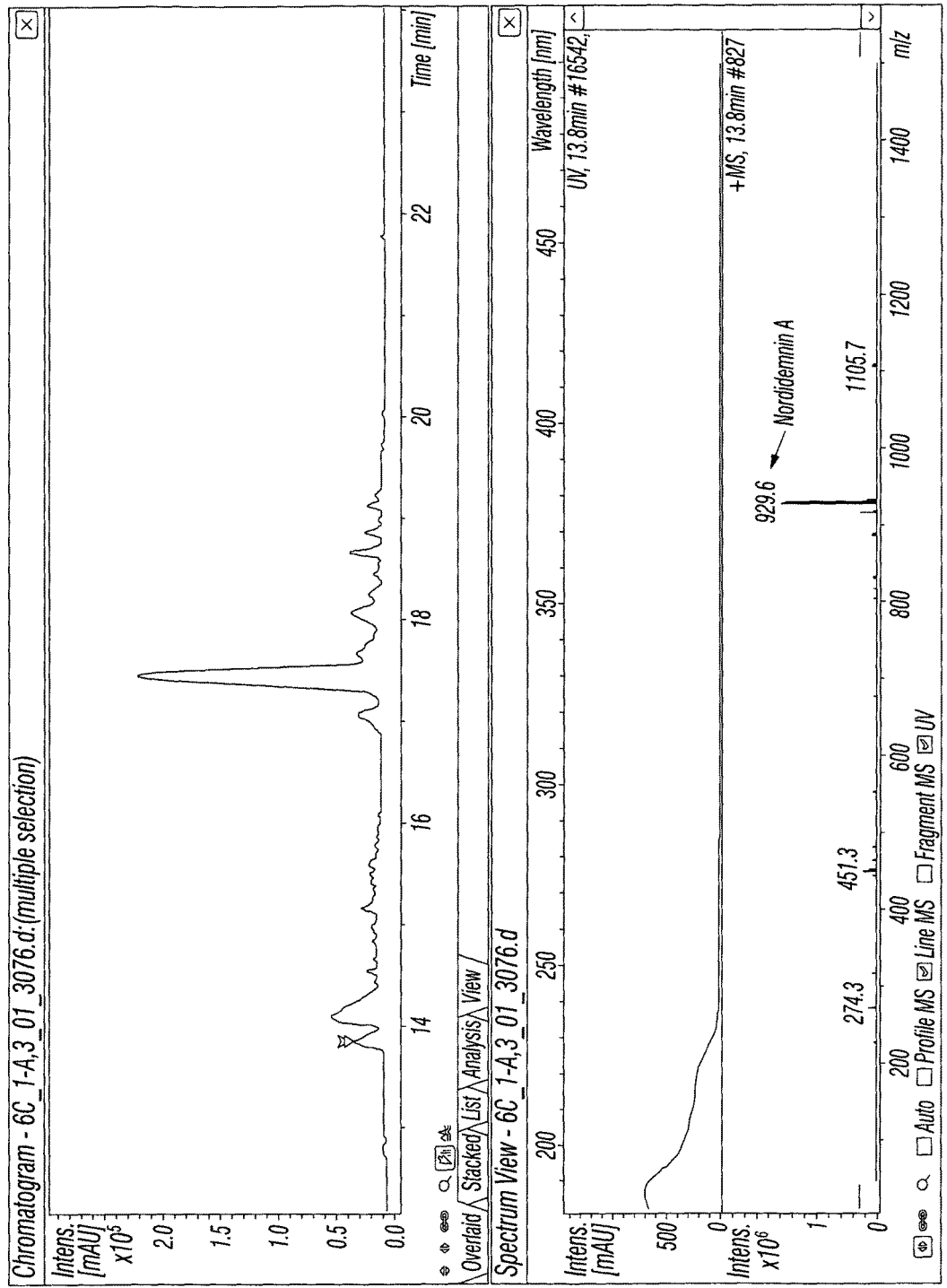
Figure 8A:
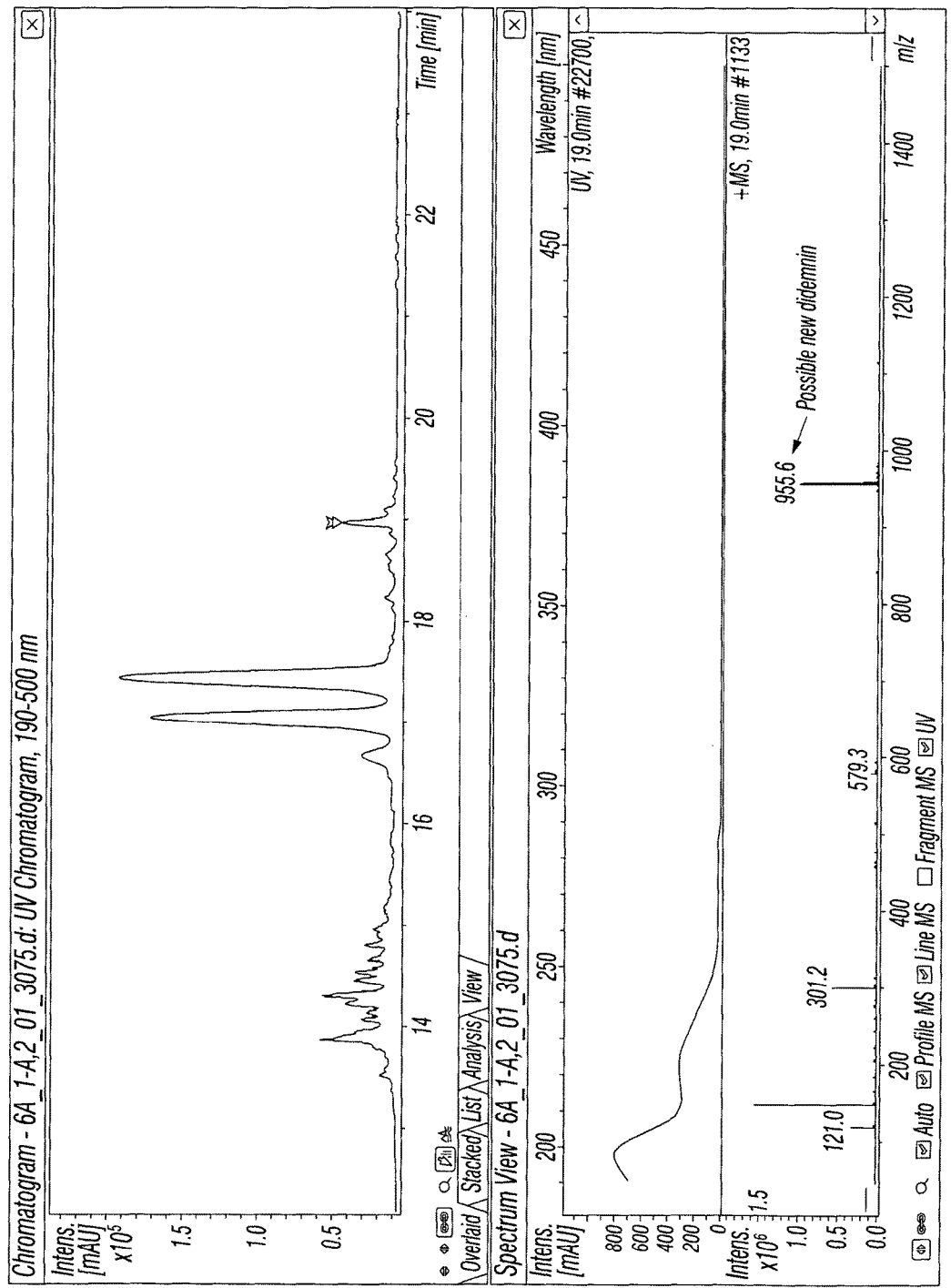
FIGS. 8A and 8B show detection of two new didemnins from *Tistrella mobilis*.
Figure 8B:
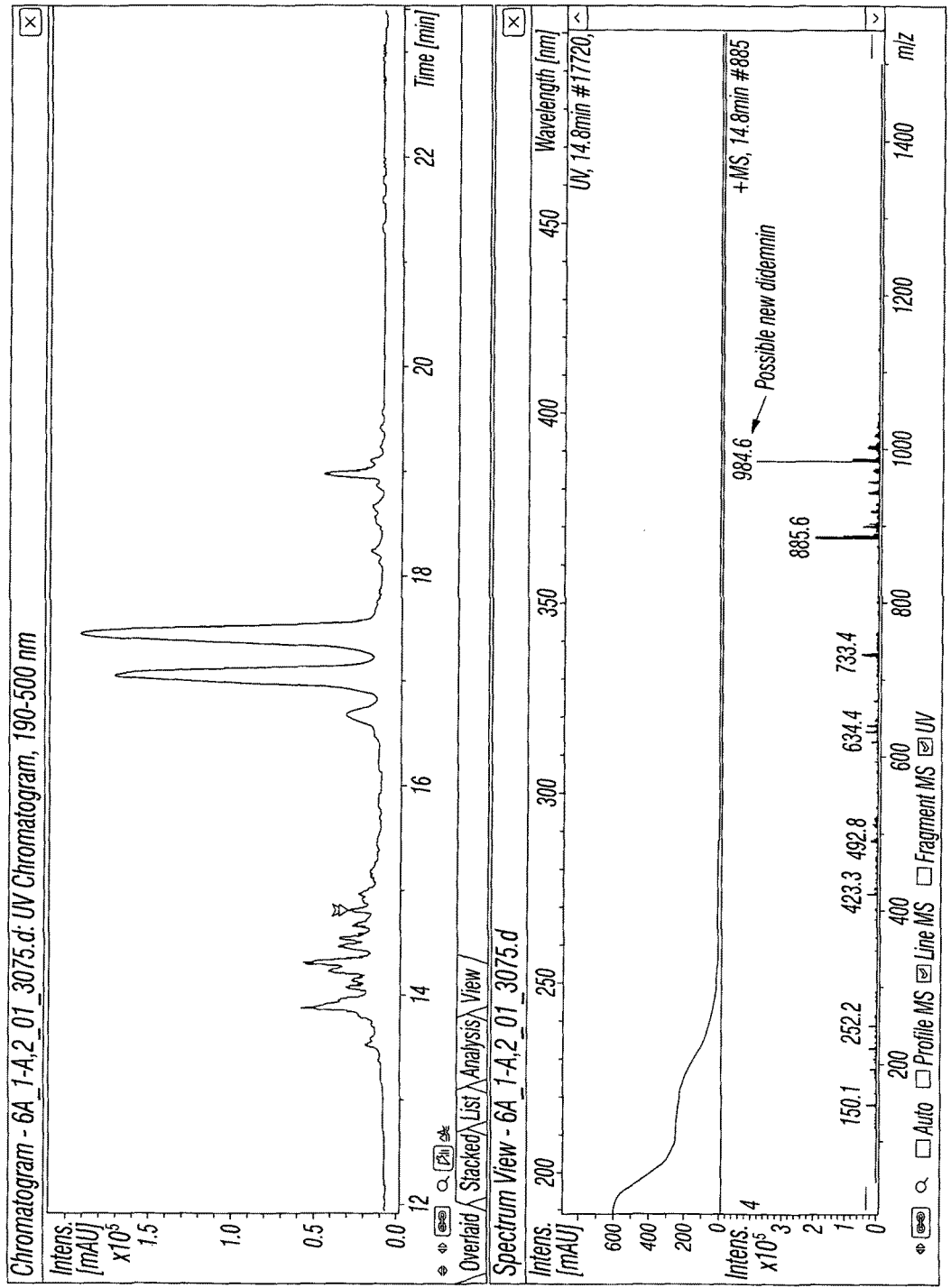

In particular aspects of the invention, there are didemnins other than didemnin B and nordidemninB from *Tistrella mobilis*. As shown in FIGS. 6, 7A, and 7B using UPLC-HRMS, there was detection of some other didemnins such as didemnin A, nordidemnin A and didemnin N. In certain aspects, there are new didemnins with similar molecular weights but different from all reported didemnins (see FIGS. 8A and 8B). They also have similar UV absorption patterns to didemnins.

| Name | Formula | Molecular weight | Reference | Source |
|---|---|---|---|---|
| Didemnin A | C49H78N6O12 | 943.177 | Crampton, S. L. et al., Cancer Res., 44 (1984) 1796; M.B. Hossain et al., Internat. J. Peptide Protein Res. 47 (1996) 20-27 | Trididemnum sp. |
| Didemnin B | C57H89N7O15 | 1,112.35 | Crampton. S. L. et al., Cancer Res., 44 (1984) 1796; | Trididemnum sp. |
| Didemnin C | C52H82N6O14 | 1,015.24 | Rinehart, K. L. et al., Science, 212 (1981) 933; | Trididemnum spp. |
| Prolyldidenmin A | C54H85N7O13 | 1,040.29 | Schmidt, U. et al., Tetrahedron Lett., 29, 4407-8 1988 | |
| didemnin D | C77H118N14O23 | 1,607.84 | Rinehart KL Kishore V Bible KC Sakai R Sullins DW Li K-M J. Nat. Prod. 1988 51 1-21 | Chordata Trididemnum solidum |
| didemnin E | C72H110N12O21 | 1,479.71 | Rinehart KL Kishore V Bible KC Sakai R Sullins DW Li K-M J. Nat. Prod. 1988 51 1-21 | Chordata Trididemnum solidum |
| didemnin G | C58H89N7O16 | 1,140.36 | K. L. Rinehart, 2nd Euroconf. Marine Nat. Prod., 1999 Santiago d. Comp., | Trididemnum solidum |
| isodidemnin-1 | C57H89N7O15 | 1,112.35 | Guyot M Davoust D Morel E C. R. Acad. Sci. P Ser. II 1987 305 681-686 | Chordata Trididemnum cyanophorum |
| nordidemnin B | C56H87N7O15 | 1,098.33 | McKee TC Ireland CM Lindquist N Fenical W Tetrahedron Lett. 1989 30 3053-3056 | Chordata Trididemnum solidum |
| didemnin M | C67H102N10O19 | 1,351.58 | Sakai R Stroh JG Sullins DW Rinehart KL J. Am. Chem. Soc. 1995 117 3734-3748 | Chordata Trididemnum solidum |
| didemnin N | C55H85N7O15 | 1,084.30 | Sakai R Stroh JG Sullins DW Rinehart KL J. Am. Chem. Soc. 1995 117 3734-3748 | Chordata Trididemnum solidum |
| didemnin X | C82H131N13O23 | 1,666.99 | Sakai R Stroh JG Sullins DW Rinehart KL J. Am. Chem. Soc. 1995 117 3734-3748 | Chordata Trididemnum solidum |
| didemnin Y | C87H139N15O25 | 1,795.12 | Sakai R Stroh JG Sullins DW Rinehart KL J. Am. Chem. Soc. 1995 117 3734-3748 | Chordata Trididemnum solidum |
| nordidemnin N | C54H83N7O15 | 1,070.27 | Sakai R Stroh JG Sullins DW Rinehart KL J. Am. Chem. Soc. 1995 117 3734-3748 | Chordata Trididemnum solidum |
| epididemnin A1 | C49H78N6O12 | 943.177 | Sakai R Stroh JG Sullins DW Rinehart KL J. Am. Chem. Soc. 1995 117 3734-3748 | Chordata Trididemnum solidum |
| acyclodidemnin A | C49H80N6O13 | 961.192 | Sakai R Stroh JG Sullins DW Rinehart KL J. Am. Chem. Soc. 1995 117 3734-3748 | Chordata Trididemnum solidum |
| [tyr5]didemnin B | C55H85N7O15 | 1,084.30 | Aboumansour E Boulanger A Badre A Bonnard I Banaigs B Combaut G Francisco C Tetrahedron 1995 51 12591-12600 | Chordata Trididemnum cyanophorum |
| [D-pro4]didemnin B | C57H89N7O15 | 1,112.35 | Aboumansour E Boulanger A Badre A Bonnard I Banaigs B Combaut G Francisco C Tetrahedron 1995 51 12591-12600 | Chordata Trididemnum cyanophorum |
| didemnin H | C67H102N10O19 | 1,351.58 | Boulanger A Abou-Mansour E Badre A Banaigs B Combaut G Francisco C Tetrahedron Lett. 1994 35 4345-4348 | Chordata Trididemnum cyanophorum |
| dehydrodidemnin B | C57H87N7O15 | 1,110.34 | Rinehart KL Lithgow-Bertelloni AM Ruffles GK PCT Int. Appl. 1991 0 0 | Chordata Aplidium albicans |
| [Hysp2]didemnin B | C58H91N7O15 | 1,126.38 | Banaigs B Mansour EA Bonnard I Boulanger A Francisco C Tetrahedron 1999 55 9559-9574 | Chordata Aplidium albicans, Chordata Trididemnum cyanophorum, Chordata Trididemnum solidum |
| [Hap2]didemnin B | C54H83N7O15 | 1,070.27 | Banaigs B Mansour EA Bonnard I Boulanger A Francisco C Tetrahedron 1999 55 9559-9574 | Chordata Aplidium albicans, Chordata Trididemnum cyanophorum, Chordata Trididemnum solidum |

Example 4

Sequence Information

The following table provides annotation of the *Tistrella mobilis* genome (including plasmids 1-4 (P1-P4)).

| Locus | Gene | Product | Start | End | Strand | Length |
|---|---|---|---|---|---|---|
| P1.orf0001 | dhbF | Amino acid adenylation | 1 | 3501 | 1 | 3501 |
| P1.orf0002 | | HNH endonuclease domain-containing protein | 3566 | 4135 | 2 | 570 |
| P1.orf0003 | | conserved hypothetical protein | 4297 | 4632 | 1 | 336 |
| P1.orf0004 | | conserved hypothetical protein | 4675 | 4920 | 1 | 246 |
| P1.orf0005 | | conserved hypothetical protein | 4910 | 5203 | 2 | 294 |
| P1.orf0006 | | Tetratricopeptide TPR_4 | 5622 | 7493 | 3 | 1872 |
| P1.orf0007 | | hypothetical protein | 7712 | 7870 | 2 | 159 |
| P1.orf0008 | | 2-nitropropane dioxygenase NPD | 10299 | 9328 | −1 | 972 |
| P1.orf0009 | | cytochrome B561 | 10869 | 10303 | −1 | 567 |
| P1.orf0010 | | TPR repeat-containing protein | 11116 | 12300 | 1 | 1185 |
| P1.orf0011 | arcB | ornithine cyclodeaminase | 13363 | 12311 | −2 | 1053 |
| P1.orf0012 | arcB | arginase | 14343 | 13360 | −1 | 984 |
| P1.orf0013 | | hypothetical protein | 15282 | 14491 | −1 | 792 |
| P1.orf0014 | | transcriptional regulator | 15452 | 15904 | 2 | 453 |
| P1.orf0015 | | D-aminoacylase | 16007 | 17512 | 2 | 1506 |
| P1.orf0016 | cobW | Cobalamin biosynthesis protein CobW | 17509 | 18474 | 1 | 966 |
| P1.orf0017 | kipR | transcriptional regulator, IclR family | 18495 | 19313 | 3 | 819 |
| P1.orf0018 | | transposase | 19680 | 19988 | 3 | 309 |
| P1.orf0019 | | transposase, IS4 | 20131 | 20361 | 1 | 231 |
| P1.orf0020 | recF | DNA replication and repair protein recF | 20617 | 22251 | 1 | 1635 |
| P1.orf0021 | yagA | integrase catalytic subunit | 24237 | 23488 | −1 | 750 |
| P1.orf0022 | dadA | D-amino-acid dehydrogenase (DadA-like) | 25991 | 24768 | −3 | 1224 |
| P1.orf0023 | gsiA | putative ABC transporter, ATP-binding protein | 27732 | 26053 | −1 | 1680 |
| P1.orf0024 | | putative ABC transporter, permease protein | 28582 | 27737 | −2 | 846 |
| P1.orf0025 | | putative ABC transporter, permease protein | 29522 | 28803 | −3 | 720 |
| P1.orf0026 | | binding-protein-dependent transport systems inner membrane component | 28809 | 28582 | −1 | 228 |
| P1.orf0027 | | putative ABC transporter, periplasmic binding protein | 31211 | 29595 | −3 | 1617 |
| P1.orf0028 | baeS | two component sensor histidine kinase, AdeS | 32657 | 31479 | −3 | 1179 |
| P1.orf0029 | | putative transcriptional regulator ycf27 | 33415 | 32654 | −2 | 762 |
| P1.orf0030 | | conserved hypothetical protein | 33688 | 34317 | 1 | 630 |
| P1.orf0031 | | conserved hypothetical protein | 34400 | 35098 | 2 | 699 |
| P1.orf0032 | | conserved hypothetical protein | 36007 | 35186 | −2 | 822 |
| P1.orf0033 | | hypothetical protein | 36386 | 36081 | −3 | 306 |
| P1.orf0034 | | Sulfatase-modifying factor | 36553 | 37887 | 1 | 1335 |
| P1.orf0035 | | Meiotically up-regulated gene 158 protein | 37915 | 38916 | 1 | 1002 |
| P1.orf0036 | | putative transcriptional regulator | 39030 | 39296 | 3 | 267 |
| P1.orf0037 | | conserved hypothetical protein | 39293 | 39718 | 2 | 426 |
| P1.orf0038 | | conserved hypothetical protein | 40110 | 39703 | −1 | 408 |
| P1.orf0039 | | conserved hypothetical protein | 40969 | 40127 | −2 | 843 |
| P1.orf0040 | | hypothetical protein | 41084 | 40953 | −3 | 132 |
| P1.orf0041 | | conserved hypothetical protein | 41113 | 41679 | 1 | 567 |
| P1.orf0042 | | conserved hypothetical protein | 41718 | 42971 | 3 | 1254 |
| P1.orf0043 | yciE | conserved hypothetical protein | 42989 | 44128 | 2 | 1140 |
| P1.orf0044 | | TPR repeat | 45084 | 44143 | −1 | 942 |
| P1.orf0045 | | conserved hypothetical protein | 45365 | 45081 | −3 | 285 |
| P1.orf0046 | | aspartyl/asparaginyl beta-hydroxylase | 46396 | 45362 | −2 | 1035 |
| P1.orf0047 | asnB | Asparagine synthase (glutamine-hydrolyzing) | 48329 | 46389 | −3 | 1941 |
| P1.orf0048 | | hypothetical protein | 48512 | 48342 | −3 | 171 |
| P1.orf0049 | | transcriptional regulator, AsnC family | 49221 | 48742 | −1 | 480 |
| P1.orf0050 | | conserved hypothetical protein | 49373 | 50158 | 2 | 786 |
| P1.orf0051 | | L-carnitine dehydratase/bile acid-inducible protein F | 51309 | 50179 | −1 | 1131 |
| P1.orf0052 | exoD | putative exopolysaccharide synthesis protein | 51530 | 52174 | 2 | 645 |
| P1.orf0053 | | sensory box/GGDEF family protein | 54320 | 52131 | −3 | 2190 |
| P1.orf0054 | | PEBP family protein | 54541 | 56367 | 1 | 1827 |
| P1.orf0055 | | hypothetical protein | 56514 | 56780 | 3 | 267 |
| P1.orf0056 | | inositol-1-monophosphatase | 56949 | 57809 | 3 | 861 |
| P1.orf0057 | | hypothetical protein | 58072 | 57815 | −2 | 258 |
| P1.orf0058 | feaR | AraC family transcriptional regulator | 58256 | 59380 | 2 | 1125 |
| P1.orf0059 | | hypothetical protein | 59582 | 59920 | 2 | 339 |
| P1.orf0060 | | hypothetical protein | 60233 | 59958 | −3 | 276 |
| P1.orf0061 | | conserved hypothetical protein | 60341 | 60535 | 2 | 195 |
| P1.orf0062 | | hypothetical protein | 61819 | 60983 | −2 | 837 |
| P1.orf0063 | | conserved hypothetical protein | 62520 | 61816 | −1 | 705 |
| P1.orf0064 | | hypothetical protein | 63257 | 62658 | −3 | 600 |
| P1.orf0065 | | hypothetical protein | 63988 | 63254 | −2 | 735 |
| P1.orf0066 | | conserved hypothetical protein | 65137 | 64061 | −2 | 1077 |
| P1.orf0067 | | conserved hypothetical protein | 66168 | 65134 | −1 | 1035 |
| P1.orf0068 | | vgrG protein | 68924 | 66195 | −3 | 2730 |
| P1.orf0069 | | conserved hypothetical protein | 69570 | 69058 | −1 | 513 |
| P1.orf0070 | | conserved hypothetical protein | 71219 | 69567 | −3 | 1653 |
| P1.orf0071 | | ABC transporter, permease protein | 72438 | 71212 | −1 | 1227 |
| P1.orf0072 | macB | Macrolide export ATP-binding/permease protein | 73142 | 72438 | −3 | 705 |
| P1.orf0073 | | ppkA-related protein | 75115 | 73139 | −2 | 1977 |
| P1.orf0074 | | serine/threonine kinase | 76542 | 75115 | −1 | 1428 |
| P1.orf0075 | prpC | Ser/Thr protein phosphatase | 77305 | 76535 | −2 | 771 |

-continued

| Locus | Gene | Product | Start | End | Strand | Length |
|---|---|---|---|---|---|---|
| P1.orf0076 | | conserved hypothetical protein | 78018 | 77302 | −1 | 717 |
| P1.orf0077 | | conserved hypothetical protein | 81725 | 78000 | −3 | 3726 |
| P1.orf0078 | ytxE | conserved hypothetical protein | 83263 | 81725 | −2 | 1539 |
| P1.orf0079 | | conserved hypothetical protein | 84610 | 83267 | −2 | 1344 |
| P1.orf0080 | | type VI secretion lipoprotein, VC_A0113 family | 85178 | 84669 | −3 | 510 |
| P1.orf0081 | | FHA domain-containing protein | 86617 | 85211 | −2 | 1407 |
| P1.orf0082 | | type VI secretion ATPase, ClpV1 family | 89264 | 86661 | −3 | 2604 |
| P1.orf0083 | | type VI secretion system protein ImpH | 90365 | 89334 | −3 | 1032 |
| P1.orf0084 | | type VI secretion system protein ImpG | 92216 | 90375 | −3 | 1842 |
| P1.orf0085 | | type VI secretion system protein ImpF | 92731 | 92213 | −2 | 519 |
| P1.orf0086 | | type VI secretion system protein ImpE | 93597 | 92728 | −1 | 870 |
| P1.orf0087 | | type VI secretion system protein ImpC | 95063 | 93663 | −3 | 1401 |
| P1.orf0088 | | type VI secretion system protein ImpC | 96576 | 95080 | −1 | 1497 |
| P1.orf0089 | | type VI secretion protein | 97115 | 96582 | −3 | 534 |
| P1.orf0090 | | impA-related N-terminal protein | 98317 | 97175 | −2 | 1143 |
| P1.orf0091 | | peptidase S1 and S6, chymotrypsin/Hap | 99083 | 98634 | −3 | 450 |
| P1.orf0092 | hcp1 | conserved hypothetical protein | 99418 | 99891 | 1 | 474 |
| P1.orf0093 | | hypothetical protein | 100070 | 100681 | 2 | 612 |
| P1.orf0094 | | hypothetical protein | 100695 | 101285 | 3 | 591 |
| P1.orf0095 | | VgrG protein | 101290 | 103272 | 1 | 1983 |
| P1.orf0096 | | hypothetical protein | 103322 | 104083 | 2 | 762 |
| P1.orf0097 | | conserved hypothetical protein | 104130 | 104543 | 3 | 414 |
| P1.orf0098 | rhsC | putative rhs-related transmembrane protein | 104548 | 109017 | 1 | 4470 |
| P1.orf0099 | | conserved hypothetical protein | 109034 | 109873 | 2 | 840 |
| P1.orf0100 | | conserved hypothetical protein | 109983 | 110342 | 3 | 360 |
| P1.orf0101 | | Ribosomal protein L7/L12 C-terminal domain. | 110467 | 110853 | 1 | 387 |
| P1.orf0102 | | hypothetical protein | 110962 | 111171 | 1 | 210 |
| P1.orf0103 | | hypothetical protein | 111187 | 111699 | 1 | 513 |
| P1.orf0104 | | conserved hypothetical protein | 111745 | 112572 | 1 | 828 |
| P1.orf0105 | | conserved hypothetical protein | 112700 | 113104 | 2 | 405 |
| P1.orf0106 | | conserved hypothetical protein | 113104 | 113838 | 1 | 735 |
| P1.orf0107 | treY | malto-oligosyltrehalose synthase | 113999 | 116740 | 2 | 2742 |
| P1.orf0108 | | lipolytic enzyme | 117759 | 116767 | −1 | 993 |
| P1.orf0109 | paiB | transcriptional repressor of sporulation and degradative enzyme production | 117861 | 118490 | 3 | 630 |
| P1.orf0110 | | Metallophosphoesterase | 119313 | 118522 | −1 | 792 |
| P1.orf0111 | ywfA | putative transporter protein | 119527 | 120717 | 1 | 1191 |
| P1.orf0112 | ybfI | AraC family transcriptional regulator | 120779 | 121609 | 2 | 831 |
| P1.orf0113 | | conserved hypothetical protein | 121817 | 121620 | −3 | 198 |
| P1.orf0114 | | conserved hypothetical protein | 122207 | 121902 | −3 | 306 |
| P1.orf0115 | | putative addiction module antidote protein, CopG/Arc/MetJ family | 122540 | 122764 | 2 | 225 |
| P1.orf0116 | | plasmid stabilization system protein | 122765 | 123076 | 2 | 312 |
| P1.orf0117 | | conserved hypothetical protein | 123161 | 124144 | 2 | 984 |
| P1.orf0118 | ywjA | ABC transporter, nucleotide binding/ATPase protein | 125820 | 124108 | −1 | 1713 |
| P1.orf0119 | fhuB | transport system permease protein | 126404 | 125895 | −3 | 510 |
| P1.orf0120 | fhuB | transport system permease protein | 127864 | 126395 | −2 | 1470 |
| P1.orf0121 | fhuD | Iron(3+)-hydroxamate-binding protein fhuD | 128711 | 127857 | −3 | 855 |
| P1.orf0122 | fhuC | iron-hydroxamate transporter ATP-binding subunit | 129528 | 128731 | −1 | 798 |
| P1.orf0123 | fhuA | ferrichrome receptor precursor protein | 131773 | 129539 | −2 | 2235 |
| P1.orf0124 | msmR | transcriptional regulator, AraC family | 132821 | 131928 | −3 | 894 |
| P1.orf0125 | | Regulator of cell morphogenesis and NO signaling | 133622 | 132918 | −3 | 705 |
| P1.orf0126 | | GCN5-related N-acetyltransferase | 134591 | 133734 | −3 | 858 |
| P1.orf0127 | appF | putative dipeptide ABC transporter, ATP-binding protein | 135640 | 134654 | −2 | 987 |
| P1.orf0128 | | Oligopeptide/dipeptide transporter domain family protein | 136449 | 135637 | −1 | 813 |
| P1.orf0129 | ddpC | ABC transporter permease protein 1 | 137342 | 136446 | −3 | 897 |
| P1.orf0130 | ddpB | binding-protein dependent transport system inner membrane protein | 138361 | 137339 | −2 | 1023 |
| P1.orf0131 | hbpA | extracellular solute-binding protein family 5 | 140053 | 138434 | −2 | 1620 |
| P1.orf0132 | soxC | DszC-like desulfurization enzyme | 141285 | 140104 | −1 | 1182 |
| P1.orf0133 | soxA | flavin-dependent oxidoreductase | 142712 | 141282 | −3 | 1431 |
| P1.orf0134 | hcaR | transcriptional regulator, LysR family | 144315 | 143398 | −1 | 918 |
| P1.orf0135 | | short-chain dehydrogenase/reductase SDR | 144452 | 145222 | 2 | 771 |
| P1.orf0136 | catD | carboxylesterase | 146146 | 145223 | −2 | 924 |
| P1.orf0137 | | conserved hypothetical protein | 146388 | 147218 | 3 | 831 |
| P1.orf0138 | | acyl-CoA dehydrogenase | 147267 | 148451 | 3 | 1185 |
| P1.orf0139 | | hypothetical protein | 146396 | 146217 | −3 | 180 |
| P1.orf0140 | | acyl-CoA dehydrogenase family protein | 148483 | 149682 | 1 | 1200 |
| P1.orf0141 | | hypothetical protein | 150210 | 149764 | −1 | 447 |
| P1.orf0142 | parA | Cobyrinic acid ac-diamide synthase | 151061 | 150207 | −3 | 855 |
| P1.orf0143 | | hypothetical protein | 151289 | 151116 | −3 | 174 |
| P1.orf0144 | | transcriptional regulator, CopG family | 151688 | 151413 | −3 | 276 |

-continued

| Locus | Gene | Product | Start | End | Strand | Length |
|---|---|---|---|---|---|---|
| P1.orf0145 | mtnC | 2,3-diketo-5-methylthio-1-phosphopentane phosphatase | 152572 | 151757 | −2 | 816 |
| P1.orf0146 | mtnD | acireductone dioxygenase ARD | 153107 | 152562 | −3 | 546 |
| P1.orf0147 | mtnB | methylthioribulose-1-phosphate dehydratase | 153733 | 153104 | −2 | 630 |
| P1.orf0148 | | replication protein A | 156147 | 157436 | 3 | 1290 |
| P1.orf0149 | | hypothetical protein | 156098 | 155670 | −3 | 429 |
| P1.orf0150 | | hypothetical protein | 158775 | 159935 | 3 | 1161 |
| P1.orf0151 | | conserved hypothetical protein | 159979 | 166170 | 1 | 6192 |
| P1.orf0152 | dctB | two-component sensor histidine kinase protein | 166326 | 168158 | 3 | 1833 |
| P1.orf0153 | dctD | two component, sigma54 specific, transcriptional regulator, Fis family | 168155 | 169513 | 2 | 1359 |
| P1.orf0154 | | TRAP transporter solute receptor, TAXI family protein | 169676 | 170662 | 2 | 987 |
| P1.orf0155 | | TRAP transporter, 4TM/12TM fusion protein | 170765 | 172939 | 2 | 2175 |
| P1.orf0156 | | 3-methylcrotonoyl-CoA carboxylase beta subunit | 174655 | 173048 | −2 | 1608 |
| P1.orf0157 | Pcca | putative acyl-CoA carboxylase, Biotin/lipoyl carrier domain | 175185 | 174652 | −1 | 534 |
| P1.orf0158 | pycA | acetyl/propionyl CoA carboxylase alpha subunit | 176739 | 175264 | −1 | 1476 |
| P1.orf0159 | citE | Citryl-CoA lyase | 177666 | 176746 | −1 | 921 |
| P1.orf0160 | | dehydratase | 178133 | 177663 | −3 | 471 |
| P1.orf0161 | | short-chain dehydrogenase/reductase SDR | 178304 | 179137 | 2 | 834 |
| P1.orf0162 | IVD | Isovaleryl-CoA dehydrogenase | 180424 | 179222 | −2 | 1203 |
| P1.orf0163 | livF | ABC transporter related protein | 181236 | 180448 | −1 | 789 |
| P1.orf0164 | | putative branched-chain amino acid transport system substrate-binding protein | 182524 | 181244 | −2 | 1281 |
| P1.orf0165 | braE | inner-membrane translocator | 183668 | 182595 | −3 | 1074 |
| P1.orf0166 | braD | inner-membrane translocator | 184561 | 183674 | −2 | 888 |
| P1.orf0167 | | AMP-dependent synthetase and ligase | 186533 | 184563 | −3 | 1971 |
| P1.orf0168 | braF | ABC transporter related protein | 187335 | 186523 | −1 | 813 |
| P1.orf0169 | fadR | TetR family transcriptional regulator | 188519 | 187803 | −3 | 717 |
| P1.orf0170 | | hypothetical protein | 188784 | 189266 | 3 | 483 |
| P1.orf0171 | tetR | Tetracycline repressor protein class H | 189987 | 189301 | −1 | 687 |
| P1.orf0172 | eutQ | Ethanolamine utilization protein eutQ | 190133 | 190513 | 2 | 381 |
| P1.orf0173 | ordL | FAD dependent oxidoreductase | 190510 | 191829 | 1 | 1320 |
| P1.orf0174 | yiiZ | deoxycytidine triphosphate (dCTP) deaminase | 191903 | 192943 | 2 | 1041 |
| P1.orf0175 | | TRAP-type C4-dicarboxylate transport system small permease component | 192995 | 193501 | 2 | 507 |
| P1.orf0176 | siaT | putative DctM (C4-dicarboxylate permease, large subunit) | 193503 | 194792 | 3 | 1290 |
| P1.orf0177 | | hypothetical protein | 195002 | 195325 | 2 | 324 |
| P1.orf0178 | | conserved hypothetical protein | 195425 | 195892 | 2 | 468 |
| P1.orf0179 | | TetR family transcriptional regulator | 196517 | 195846 | −3 | 672 |
| P1.orf0180 | yesF | oxidoreductase yesF | 196619 | 197461 | 2 | 843 |
| P1.orf0181 | calB | aldehyde dehydrogenase | 198848 | 197430 | −3 | 1419 |
| P1.orf0182 | | TetR family transcriptional regulator | 199683 | 199045 | −1 | 639 |
| P1.orf0183 | | conserved hypothetical protein | 199899 | 200906 | 3 | 1008 |
| P1.orf0184 | | putative pyridoxine 5'-phosphate oxidase | 201927 | 201238 | −1 | 690 |
| P1.orf0185 | | LysR family transcriptional regulator | 202044 | 202982 | 3 | 939 |
| P1.orf0186 | | conserved hypothetical protein | 204005 | 202992 | −3 | 1014 |
| P1.orf0187 | | conserved hypothetical protein | 204591 | 203998 | −1 | 594 |
| P1.orf0188 | cydB | cytochrome d ubiquinol oxidase, subunit II | 206024 | 204870 | −3 | 1155 |
| P1.orf0189 | cydA | cytochrome D ubiquinol oxidase, subunit I | 207644 | 206031 | −3 | 1614 |
| P1.orf0190 | cydC | transport ATP-binding protein CYDC | 209417 | 207732 | −3 | 1686 |
| P1.orf0191 | cydD | ABC transporter, CydDC cysteine exporter (CydDC-E) family, permease/ATP-binding protein CydD | 211018 | 209444 | −2 | 1575 |
| P1.orf0192 | | hypothetical protein | 211079 | 211204 | 2 | 126 |
| P1.orf0193 | dcrA | methyl-accepting chemotaxis protein | 211329 | 213422 | 3 | 2094 |
| P1.orf0194 | | putative araC-like transcription regulator | 214364 | 213435 | −3 | 930 |
| P1.orf0195 | yusZ | short-chain dehydrogenase/reductase SDR | 214465 | 215220 | 1 | 756 |
| P1.orf0196 | ubiE | Methyltransferase type 11 | 216154 | 215240 | −2 | 915 |
| P1.orf0197 | | major facilitator transporter | 217467 | 216211 | −1 | 1257 |
| P1.orf0198 | fyuA | TonB-dependent receptor | 219740 | 217473 | −3 | 2268 |
| P1.orf0199 | pchR | regulatory protein Pchr | 220674 | 219814 | −1 | 861 |
| P1.orf0200 | | hypothetical protein | 221164 | 220736 | −2 | 429 |
| P1.orf0201 | | hypothetical protein | 221470 | 221198 | −2 | 273 |
| P1.orf0202 | | transposase, IS4 | 222251 | 221904 | −3 | 348 |
| P1.orf0203 | | PilT domain-containing protein | 222699 | 222268 | −1 | 432 |
| P1.orf0204 | | conserved hypothetical protein | 222905 | 222696 | −3 | 210 |
| P1.orf0205 | | conserved hypothetical protein | 223604 | 223110 | −3 | 495 |
| P1.orf0206 | dhkJ | multi-sensor hybrid histidine kinase | 228426 | 223648 | −1 | 4779 |
| P1.orf0207 | ybaR | sulphate transporter | 229028 | 230536 | 2 | 1509 |
| P1.orf0208 | | putative addiction module antidote protein, CopG/Arc/MetJ family | 230716 | 230997 | 1 | 282 |
| P1.orf0209 | | hypothetical protein | 231751 | 231569 | −2 | 183 |

-continued

| Locus | Gene | Product | Start | End | Strand | Length |
|---|---|---|---|---|---|---|
| P1.orf0210 | | hypothetical protein | 232640 | 232413 | −3 | 228 |
| P1.orf0211 | malQ | glycoside hydrolase family protein | 234541 | 232637 | −2 | 1905 |
| P1.orf0212 | glgX | glycogen debranching enzyme GlgX | 238557 | 234628 | −1 | 3930 |
| P1.orf0213 | | glycogen branching enzyme | 240732 | 238567 | −1 | 2166 |
| P1.orf0214 | treS | trehalose synthase | 244194 | 240808 | −1 | 3387 |
| P1.orf0215 | aam1 | alpha amylase catalytic region | 247202 | 244200 | −3 | 3003 |
| P1.orf0216 | | hypothetical protein | 247741 | 247244 | −2 | 498 |
| P1.orf0217 | | hypothetical protein | 247736 | 247966 | 2 | 231 |
| P1.orf0218 | | cyclase/dehydrase | 248034 | 248840 | 3 | 807 |
| P1.orf0219 | otsB | trehalose-phosphatase | 248837 | 249631 | 2 | 795 |
| P1.orf0220 | otsA | alpha,alpha-trehalose-phosphate synthase (UDP-forming) | 249734 | 251275 | 2 | 1542 |
| P1.orf0221 | | TRAP dicarboxylate transporter, DctM subunit | 252686 | 251367 | −3 | 1320 |
| P1.orf0222 | | TRAP dicarboxylate transporter, DctQ subunit | 253240 | 252683 | −2 | 558 |
| P1.orf0223 | yiaO | TRAP dicarboxylate family transporter, DctP subunit | 254661 | 253585 | −1 | 1077 |
| P1.orf0224 | mvaA | hydroxymethylglutaryl-CoA reductase, degradative | 256027 | 254723 | −2 | 1305 |
| P1.orf0225 | ydcR | GntR family transcriptional regulator | 256219 | 257616 | 1 | 1398 |
| P1.orf0226 | | AraC family transcriptional regulator | 258898 | 257852 | −2 | 1047 |
| P1.orf0227 | | Extracellular ligand-binding receptor | 259239 | 260420 | 3 | 1182 |
| P1.orf0228 | livH | inner-membrane translocator | 260507 | 261364 | 2 | 858 |
| P1.orf0229 | livM | inner-membrane translocator | 261376 | 262317 | 1 | 942 |
| P1.orf0230 | braF | ABC transporter related protein | 262314 | 263063 | 3 | 750 |
| P1.orf0231 | livF | ABC transporter related protein | 263060 | 263761 | 2 | 702 |
| P1.orf0232 | | acetyl-CoA acyltransferase | 263771 | 265003 | 2 | 1233 |
| P1.orf0233 | lcfB | Acyl-CoA synthetase (AMP-forming)/AMP-acid ligase II | 265013 | 266563 | 2 | 1551 |
| P1.orf0234 | fadD | AMP-binding enzyme | 266573 | 268081 | 2 | 1509 |
| P1.orf0235 | SCP2 | lipid-transfer protein | 268098 | 269279 | 3 | 1182 |
| P1.orf0236 | | 3-oxoacyl-[acyl-carrier protein] reductase | 269276 | 270085 | 2 | 810 |
| P1.orf0237 | | conserved hypothetical protein | 270216 | 270575 | 3 | 360 |
| P1.orf0238 | | F440524_38 putative alcohol dehydrogenase | 270819 | 270637 | −1 | 183 |
| P1.orf0239 | | conserved hypothetical protein | 270867 | 271124 | 3 | 258 |
| P1.orf0240 | | addiction module toxin, RelE/StbE family | 271121 | 271423 | 2 | 303 |
| P1.orf0241 | | putative Alcohol dehydrogenase, (ADH) | 271793 | 271398 | −3 | 396 |
| P1.orf0242 | | hypothetical protein | 271927 | 271802 | −2 | 126 |
| P1.orf0243 | dhkJ | multi-sensor hybrid histidine kinase | 272012 | 276670 | 2 | 4659 |
| P1.orf0244 | adhA | Alcohol dehydrogenase GroES domain protein | 277765 | 276710 | −2 | 1056 |
| P1.orf0245 | yjfF | inner-membrane translocator | 278908 | 277865 | −2 | 1044 |
| P1.orf0246 | ytfT | sugar ABC transporter permease protein | 279921 | 278908 | −1 | 1014 |
| P1.orf0247 | ytfR | sugar ABC transporter ATP-binding protein | 281503 | 279995 | −2 | 1509 |
| P1.orf0248 | ytfQ | periplasmic binding protein/LacI transcriptional regulator | 282545 | 281586 | −3 | 960 |
| P1.orf0249 | Galm | aldose 1-epimerase | 283693 | 282674 | −2 | 1020 |
| P1.orf0250 | yvrE | Smp-30/Cgr1 family protein | 284592 | 283690 | −1 | 903 |
| P1.orf0251 | aldH | dehydrogenase | 285562 | 284582 | −2 | 981 |
| P1.orf0252 | aldH | NAD-dependent aldehyde dehydrogenase | 286131 | 285559 | −1 | 573 |
| P1.orf0253 | gal | putative d-galactose 1-dehydrogenase protein | 287110 | 286163 | −2 | 948 |
| P1.orf0254 | ilvD | dihydroxy-acid dehydratase | 288839 | 287097 | −3 | 1743 |
| P1.orf0255 | | fumarylacetoacetate (FAA) hydrolase | 289859 | 288858 | −3 | 1002 |
| P1.orf0256 | xylH | inner membrane permease of D-xylose ABC transporter | 291069 | 289864 | −1 | 1206 |
| P1.orf0257 | araG | ABC transporter related protein | 292603 | 291041 | −2 | 1563 |
| P1.orf0258 | chvE | putative sugar uptake ABC transporter periplasmic solute-binding protein precursor | 293736 | 292666 | −1 | 1071 |
| P1.orf0259 | gbpR | transcriptional regulator protein, LysR family (possibly activator of the expression of chvE protein) | 293961 | 294938 | 3 | 978 |
| P1.orf0260 | | conserved hypothetical protein | 295016 | 295489 | 2 | 474 |
| P1.orf0261 | | LysR family transcriptional regulator | 296609 | 297565 | 2 | 957 |
| P1.orf0262 | | Alcohol dehydrogenase zinc-binding domain protein | 296536 | 295508 | −2 | 1029 |
| P1.orf0263 | | conserved hypothetical protein | 297888 | 297619 | −1 | 270 |
| P1.orf0264 | | conserved hypothetical protein | 298075 | 297848 | −2 | 228 |
| P1.orf0265 | | TetR family transcriptional regulator | 298803 | 298174 | −1 | 630 |
| P1.orf0266 | mdmC | O-methyltransferase mdmC | 298931 | 299602 | 2 | 672 |
| P1.orf0267 | | major facilitator superfamily transporter | 299655 | 300839 | 3 | 1185 |
| P1.orf0268 | | conserved hypothetical protein | 300897 | 301634 | 3 | 738 |
| P1.orf0269 | acrF | acriflavin resistance protein | 305336 | 302289 | −3 | 3048 |
| P1.orf0270 | | efflux transporter, RND family, MFP subunit | 306451 | 305336 | −2 | 1116 |
| P1.orf0271 | lmrA | transcriptional regulator | 306540 | 307115 | 3 | 576 |
| P1.orf0272 | vdlC | short chain dehydrogenase | 307162 | 307977 | 1 | 816 |
| P1.orf0273 | TRR1 | FAD-dependent pyridine nucleotide-disulphide oxidoreductase | 308915 | 307995 | −3 | 921 |
| P1.orf0274 | ywnA | transcriptional regulator, BadM/Rrf2 family | 309078 | 309569 | 3 | 492 |
| P1.orf0275 | | putative effector of murein hydrolase | 310317 | 309583 | −1 | 735 |

-continued

| Locus | Gene | Product | Start | End | Strand | Length |
|---|---|---|---|---|---|---|
| P1.orf0276 | | hypothetical protein | 310717 | 310310 | −2 | 408 |
| P1.orf0277 | pmrA | major facilitator transporter | 311875 | 310790 | −2 | 1086 |
| P1.orf0278 | folE | GTP cyclohydrolase I | 312630 | 312004 | −1 | 627 |
| P1.orf0279 | | conserved hypothetical protein | 313395 | 312655 | −1 | 741 |
| P1.orf0280 | | conserved hypothetical protein | 313853 | 314236 | 2 | 384 |
| P1.orf0281 | | conserved hypothetical protein | 314242 | 315081 | 1 | 840 |
| P1.orf0282 | | arylmalonate decarboxylase | 315223 | 315966 | 1 | 744 |
| P1.orf0283 | ydhC | transcriptional regulator, GntR family | 315981 | 316685 | 3 | 705 |
| P1.orf0284 | | putative acyl-CoA transferase/carnitine dehydratase | 316686 | 317882 | 3 | 1197 |
| P1.orf0285 | yngG | Hydroxymethylglutaryl-CoA lyase | 317894 | 318838 | 2 | 945 |
| P1.orf0286 | gbas | conserved hypothetical protein | 318835 | 319149 | 1 | 315 |
| P1.orf0287 | | isochorismatase hydrolase | 319182 | 319835 | 3 | 654 |
| P1.orf0288 | mauR | LysR family transcriptional regulator | 319929 | 320825 | 3 | 897 |
| P1.orf0289 | yajO | putative oxidoreductase | 321960 | 320899 | −1 | 1062 |
| P1.orf0290 | | conserved hypothetical protein | 322495 | 322088 | −2 | 408 |
| P1.orf0291 | | WD40-like repeat | 323353 | 322676 | −2 | 678 |
| P1.orf0292 | | conserved hypothetical protein | 324680 | 323472 | −3 | 1209 |
| P1.orf0293 | | hypothetical protein | 325200 | 325018 | −1 | 183 |
| P1.orf0294 | braC | branched chain amino acid ABC transporter periplasmic ligand-binding protein | 325402 | 326541 | 1 | 1140 |
| P1.orf0295 | braD | ABC branched chain amino acid family transporter, inner membrane subunit | 326563 | 327480 | 1 | 918 |
| P1.orf0296 | braE | High-affinity branched-chain amino acid transport system permease protein braE | 327562 | 328494 | 1 | 933 |
| P1.orf0297 | braF | branched-chain amino acid ABC transporter ATPase | 328491 | 329318 | 3 | 828 |
| P1.orf0298 | braG | High-affinity branched-chain amino acid transport ATP-binding protein braG | 329323 | 330018 | 1 | 696 |
| P1.orf0299 | | putative hydrolase | 330037 | 330909 | 1 | 873 |
| P1.orf0300 | yfdE | L-carnitine dehydratase/bile acid-inducible protein F | 331052 | 332284 | 2 | 1233 |
| P1.orf0301 | | hypothetical protein | 332281 | 333126 | 1 | 846 |
| P1.orf0302 | namA | putative FMN oxidoreductase | 333123 | 334307 | 3 | 1185 |
| P1.orf0303 | | MscS mechanosensitive ion channel | 335475 | 334321 | −1 | 1155 |
| P1.orf0304 | yagR | aldehyde oxidase and xanthine dehydrogenase molybdopterin binding | 337817 | 335520 | −3 | 2298 |
| P1.orf0305 | yagS | molybdopterin dehydrogenase FAD-binding | 338830 | 337814 | −2 | 1017 |
| P1.orf0306 | yagT | oxidoreductase | 339306 | 338830 | −1 | 477 |
| P1.orf0307 | | hypothetical protein | 339700 | 339341 | −2 | 360 |
| P1.orf0308 | | conserved hypothetical protein | 339834 | 340160 | 3 | 327 |
| P1.orf0309 | | pyridoxal phosphate biosynthetic protein PdxJ | 340527 | 340315 | −1 | 213 |
| P1.orf0310 | | cold-shock DNA-binding domain-containing protein | 340993 | 340799 | −2 | 195 |
| P1.orf0311 | | DNA ligase D | 343739 | 341301 | −3 | 2439 |
| P1.orf0312 | | Ku domain-containing protein | 344647 | 343745 | −2 | 903 |
| P1.orf0313 | | conserved hypothetical protein | 344803 | 345087 | 1 | 285 |
| P1.orf0314 | mntH | NADPH-dependent FMN reductase | 345091 | 345735 | 1 | 645 |
| P1.orf0315 | yhdF | Short-chain dehydrogenase/reductase SDR | 346645 | 345794 | −2 | 852 |
| P1.orf0316 | | hypothetical protein | 346993 | 347313 | 1 | 321 |
| P1.orf0317 | cmoB | putative SAM-dependent methyltransferase | 348091 | 347378 | −2 | 714 |
| P1.orf0318 | | topoisomerase IB | 349134 | 348118 | −1 | 1017 |
| P1.orf0319 | Uxs1 | NAD-dependent epimerase/dehydratase | 350294 | 349191 | −3 | 1104 |
| P1.orf0320 | | conserved hypothetical protein | 351465 | 350305 | −1 | 1161 |
| P1.orf0321 | | conserved hypothetical protein | 352556 | 351462 | −3 | 1095 |
| P1.orf0322 | | conserved hypothetical protein | 353707 | 352553 | −2 | 1155 |
| P1.orf0323 | | glycosyl transferase, group 1 | 354876 | 353704 | −1 | 1173 |
| P1.orf0324 | | radical SAM domain-containing protein | 356162 | 354864 | −3 | 1299 |
| P1.orf0325 | rfbE | NAD-dependent epimerase/dehydratase | 358207 | 356159 | −2 | 2049 |
| P1.orf0326 | | NAD-dependent epimerase/dehydratase | 359322 | 358204 | −1 | 1119 |
| P1.orf0327 | rpoE | ECF subfamily RNA polymerase sigma-24 factor | 360114 | 359527 | −1 | 588 |
| P1.orf0328 | | conserved hypothetical protein | 361269 | 360760 | −1 | 510 |
| P1.orf0329 | cc4 | cytochrome c, class I | 362430 | 361306 | −1 | 1125 |
| P1.orf0330 | | Cytochrome c oxidase caa3-type, assembly factor CtaG-related protein | 363092 | 362427 | −3 | 666 |
| P1.orf0331 | | transmembrane prediction | 363451 | 363089 | −2 | 363 |
| P1.orf0332 | ctaD | cytochrome c oxidase, subunit I | 365985 | 363466 | −1 | 2520 |
| P1.orf0333 | ctaC | cytochrome c oxidase, subunit II | 367010 | 365982 | −3 | 1029 |
| P1.orf0334 | gcd | glucose dehydrogenase | 369412 | 367016 | −2 | 2397 |
| P1.orf0335 | | hypothetical protein | 369479 | 369637 | 2 | 159 |
| P1.orf0336 | | conserved hypothetical protein | 370254 | 370700 | 3 | 447 |
| P1.orf0337 | | conserved hypothetical protein | 371128 | 371805 | 1 | 678 |
| P1.orf0338 | | conserved hypothetical protein | 373405 | 373043 | −2 | 363 |
| P1.orf0339 | | prevent-host-death family protein | 373714 | 373454 | −2 | 261 |
| P1.orf0340 | gabD | Aldehyde Dehydrogenase | 375058 | 373802 | −2 | 1257 |

-continued

| Locus | Gene | Product | Start | End | Strand | Length |
|---|---|---|---|---|---|---|
| P1.orf0341 | gsiA | oligopeptide ABC superfamily ATP binding cassette transporter, ABC protein | 376993 | 375308 | −2 | 1686 |
| P1.orf0342 | | Putative peptide transport system permease protein | 377814 | 376990 | −1 | 825 |
| P1.orf0343 | | binding-protein-dependent transport systems inner membrane component | 378769 | 377825 | −2 | 945 |
| P1.orf0344 | | acyl-coenzyme A: 6-aminopenicillanic-acid-acyltransferase precursor | 379943 | 378822 | −3 | 1122 |
| P1.orf0345 | | beta-alanine-pyruvate transaminase | 381420 | 380041 | −1 | 1380 |
| P1.orf0346 | yjjM | GntR family transcriptional regulator | 382417 | 381500 | −2 | 918 |
| P1.orf0347 | bam | Indoleacetamide hydrolase | 382501 | 383991 | 1 | 1491 |
| P1.orf0348 | | poly(aspartic acid) hydrolase | 384006 | 384872 | 3 | 867 |
| P1.orf0349 | | ABC superfamily ATP binding cassette transporter substrate-binding protein | 385008 | 386591 | 3 | 1584 |
| P1.orf0350 | | transposase, mutator type | 387405 | 387115 | −1 | 291 |
| P1.orf0351 | | transposase, mutator type | 388310 | 387405 | −3 | 906 |
| P1.orf0352 | | conserved hypothetical protein | 388987 | 389457 | 1 | 471 |
| P1.orf0353 | | conserved hypothetical protein | 390709 | 389783 | −2 | 927 |
| P1.orf0354 | | conserved hypothetical protein | 391494 | 390706 | −1 | 789 |
| P1.orf0355 | | plasmid maintenance system antidote protein, XRE family | 392861 | 393004 | 2 | 144 |
| P1.orf0356 | | type II restriction enzyme, methylase subunit | 393001 | 393192 | 1 | 192 |
| P1.orf0357 | hsdR | type I restriction-modification system restriction subunit | 393202 | 396231 | 1 | 3030 |
| P1.orf0358 | | putative restriction modification system specificity subunit | 396266 | 397510 | 2 | 1245 |
| P1.orf0359 | prrC | anticodon nuclease | 397507 | 398736 | 1 | 1230 |
| P1.orf0360 | | type I restriction-modification system, M subunit | 398733 | 400355 | 3 | 1623 |
| P1.orf0361 | | integrase, catalytic region | 400892 | 401353 | 2 | 462 |
| P1.orf0362 | xerC | phage integrase family protein | 402015 | 402977 | 3 | 963 |
| P1.orf0363 | | conserved hypothetical protein | 403509 | 402967 | −1 | 543 |
| P1.orf0364 | | conserved hypothetical protein | 403679 | 405373 | 2 | 1695 |
| P1.orf0365 | | conserved hypothetical protein | 405379 | 407313 | 1 | 1935 |
| P1.orf0366 | | conserved hypothetical protein | 407310 | 408947 | 3 | 1638 |
| P1.orf0367 | | Cold-shock DNA-binding domain protein | 408944 | 411208 | 2 | 2265 |
| P1.orf0368 | | conserved hypothetical protein | 411205 | 412182 | 1 | 978 |
| P1.orf0369 | | conserved hypothetical protein | 416011 | 412664 | −2 | 3348 |
| P1.orf0370 | al2 | CRISPR-associated protein | 416875 | 418866 | 1 | 1992 |
| P1.orf0371 | | CRISPR-associated protein | 418867 | 419184 | 1 | 318 |
| P1.orf0372 | | selenide, water dikinase | 419865 | 420392 | 3 | 528 |
| P1.orf0373 | ybfL | transposase, is4 family | 420664 | 421710 | 1 | 1047 |
| P1.orf0374 | parA | partition protein ParA | 422509 | 423213 | 1 | 705 |
| P1.orf0375 | | hypothetical protein | 423411 | 423569 | 3 | 159 |
| P1.orf0376 | | hypothetical protein | 423954 | 424079 | 3 | 126 |
| P1.orf0377 | gluA | F213463_1 cellobiase CelA precursor | 424429 | 426300 | 1 | 1872 |
| P1.orf0378 | | maleate cis-trans isomerase protein | 427582 | 426830 | −2 | 753 |
| P1.orf0379 | icaR | putative TetR family transcriptional regulator | 427725 | 428483 | 3 | 759 |
| P1.orf0380 | | conserved hypothetical protein | 428775 | 428515 | −1 | 261 |
| P1.orf0381 | | glyoxalase/bleomycin resistance protein/dioxygenase | 429479 | 428775 | −3 | 705 |
| P1.orf0382 | | conserved hypothetical protein | 430769 | 429501 | −3 | 1269 |
| P1.orf0383 | | conserved hypothetical protein | 431298 | 430777 | −1 | 522 |
| P1.orf0384 | vioD | putative monooxygenase, FAD/NAD(P)-binding domain | 432452 | 431295 | −3 | 1158 |
| P1.orf0385 | dhbE | AMP-dependent synthetase and ligase | 434172 | 432484 | −1 | 1689 |
| P1.orf0386 | icaR | putative transcriptional regulator | 434976 | 434275 | −1 | 702 |
| P1.orf0387 | yiaO | Bacterial extracellular solute-binding protein, family 7 | 435118 | 436176 | 1 | 1059 |
| P1.orf0388 | | conserved hypothetical protein | 436161 | 436919 | 3 | 759 |
| P1.orf0389 | siaT | TRAP transporter, DctM-like membrane protein | 436879 | 438048 | 1 | 1170 |
| P1.orf0390 | | putative Aminoglycoside phosphotransferase | 439093 | 438071 | −2 | 1023 |
| P1.orf0391 | tam | trans-aconitate methyltransferase | 439218 | 439982 | 3 | 765 |
| P1.orf0392 | gst | glutathione S-transferase protein | 440001 | 440609 | 3 | 609 |
| P1.orf0393 | gloA | lactoylglutathione lyase | 441036 | 440632 | −1 | 405 |
| P1.orf0394 | | conserved hypothetical protein | 441639 | 441223 | −1 | 417 |
| P1.orf0395 | acrR | TetR family transcriptional regulator | 441721 | 442362 | 1 | 642 |
| P1.orf0396 | ifcA | fumarate reductase | 443799 | 442378 | −1 | 1422 |
| P1.orf0397 | namA | NADH: flavin oxidoreductase/NADH oxidase | 443958 | 444935 | 3 | 978 |
| P1.orf0398 | yvoA | transcriptional regulator | 445026 | 445901 | 3 | 876 |
| P1.orf0399 | | branched-chain amino acid transport system substrate-binding protein | 446000 | 447223 | 2 | 1224 |
| P1.orf0400 | braD | branched-chain amino acid ABC transporter permease protein | 447325 | 448167 | 1 | 843 |
| P1.orf0401 | | amino acid ABC transporter permease protein | 448167 | 449150 | 3 | 984 |
| P1.orf0402 | lptB | ABC transporter ATP-binding protein | 449150 | 449893 | 2 | 744 |

-continued

| Locus | Gene | Product | Start | End | Strand | Length |
|---|---|---|---|---|---|---|
| P1.orf0403 | livF | ABC transporter ATP-binding protein | 449890 | 450609 | 1 | 720 |
| P1.orf0404 | | MmgE/PrpD family protein | 450622 | 452040 | 1 | 1419 |
| P1.orf0405 | prpB | isocitrate lyase family protein | 452042 | 452920 | 2 | 879 |
| P1.orf0406 | | tautomerase | 452966 | 453457 | 2 | 492 |
| P1.orf0407 | ifcA | putative fumarate reductase/succinate dehydrogenase flavoprotein | 453463 | 454821 | 1 | 1359 |
| P1.orf0408 | hyuE | hydantoin racemase | 454841 | 455599 | 2 | 759 |
| P1.orf0409 | hyuE | hydantoin racemase | 455614 | 456303 | 1 | 690 |
| P1.orf0410 | lrg1 | MmgE/PrpD family protein | 456300 | 457646 | 3 | 1347 |
| P1.orf0411 | | hypothetical protein | 457718 | 457864 | 2 | 147 |
| P1.orf0412 | | hypothetical protein | 457895 | 458059 | 2 | 165 |
| P1.orf0413 | | conserved hypothetical protein | 458269 | 459588 | 1 | 1320 |
| P1.orf0414 | | putative amidase | 461101 | 459668 | −2 | 1434 |
| P1.orf0415 | braG | branched chain amino acid ABC transporter ATP-binding protein | 461821 | 461129 | −2 | 693 |
| P1.orf0416 | braF | putative ABC transport system, ATP-bidning protein | 462606 | 461815 | −1 | 792 |
| P1.orf0417 | livM | putative ABC transport system, membrane protein | 463601 | 462603 | −3 | 999 |
| P1.orf0418 | braD | inner-membrane translocator | 464465 | 463605 | −3 | 861 |
| P1.orf0419 | | branched-chain amino acid ABC transporter, periplasmic amino acid-binding protein | 465776 | 464556 | −3 | 1221 |
| P1.orf0420 | nanR | regulatory protein GntR HTH | 466752 | 465961 | −1 | 792 |
| P1.orf0421 | | hypothetical protein | 467173 | 467316 | 1 | 144 |
| P1.orf0422 | | hypothetical protein | 467699 | 467899 | 2 | 201 |
| P1.orf0423 | | hypothetical protein | 467955 | 468107 | 3 | 153 |
| P1.orf0424 | | hypothetical protein | 468152 | 468298 | 2 | 147 |
| P1.orf0425 | | conserved hypothetical protein | 468358 | 469305 | 1 | 948 |
| P1.orf0426 | algI | membrane bound O-acyl transferase, MBOAT | 469322 | 470677 | 2 | 1356 |
| P1.orf0427 | | hypothetical protein | 471709 | 470678 | −2 | 1032 |
| P1.orf0428 | | hypothetical protein | 472081 | 471875 | −2 | 207 |
| P1.orf0429 | | hypothetical protein | 472147 | 472290 | 1 | 144 |
| P1.orf0430 | | hypothetical protein | 473393 | 472362 | −3 | 1032 |
| P1.orf0431 | | hypothetical protein | 473501 | 473692 | 2 | 192 |
| P1.orf0432 | | conserved hypothetical protein | 473712 | 473978 | 3 | 267 |
| P1.orf0433 | cinA | competence/damage-inducible protein CinA | 473929 | 474507 | 1 | 579 |
| P1.orf0434 | cat1 | putative acetyl-CoA hydrolase/transferase family protein; putative succinyl-CoA: coenzyme A transferase | 474600 | 476111 | 3 | 1512 |
| P1.orf0435 | alkJ | putative choline dehydrogenase lipoprotein oxidoreductase | 476491 | 478116 | 1 | 1626 |
| P1.orf0436 | siaP | TRAP dicarboxylate transporter- DctP subunit | 478397 | 479503 | 2 | 1107 |
| P1.orf0437 | | tripartite ATP-independent periplasmic transporter DctQ | 479565 | 480071 | 3 | 507 |
| P1.orf0438 | | TRAP dicarboxylate transporter, DctM subunit | 480068 | 481345 | 2 | 1278 |
| P1.orf0439 | yxeQ | MmgE/PrpD family protein | 481377 | 482729 | 3 | 1353 |
| P1.orf0440 | maoC | conserved hypothetical protein | 482756 | 483256 | 2 | 501 |
| P1.orf0441 | mmgC | Butyryl-CoA dehydrogenase | 483253 | 484428 | 1 | 1176 |
| P1.orf0442 | maoC | conserved hypothetical protein | 484439 | 484921 | 2 | 483 |
| P1.orf0443 | yfdE | L-carnitine dehydratase/bile acid-inducible protein F | 484918 | 486153 | 1 | 1236 |
| P1.orf0444 | | Citryl-CoA lyase | 486150 | 487073 | 3 | 924 |
| P1.orf0445 | kdgR | transcriptional regulator, IclR family | 487146 | 487898 | 3 | 753 |
| P1.orf0446 | | major facilitator transporter | 487911 | 489089 | 3 | 1179 |
| P1.orf0447 | Ech1 | enoyl-CoA hydratase | 489947 | 489102 | −3 | 846 |
| P1.orf0448 | | hypothetical protein | 490444 | 490049 | −2 | 396 |
| P1.orf0449 | | hypothetical protein | 490967 | 490515 | −3 | 453 |
| P1.orf0450 | | hypothetical protein | 491546 | 491067 | −3 | 480 |
| P1.orf0451 | gst3 | Glutathione S-transferase domain protein | 492356 | 491676 | −3 | 681 |
| P1.orf0452 | mmgC | acyl-CoA dehydrogenase | 493553 | 492408 | −3 | 1146 |
| P1.orf0453 | | Carbamoyl-phosphate synthase L chain ATP-binding | 495592 | 493598 | −2 | 1995 |
| P1.orf0454 | | propionyl-CoA carboxylase | 497235 | 495673 | −1 | 1563 |
| P1.orf0455 | | hypothetical protein | 497323 | 497616 | 1 | 294 |
| P1.orf0456 | mrcA | glycosyl transferase family protein | 498482 | 497871 | −3 | 612 |
| P1.orf0457 | | transcriptional regulator | 499199 | 498924 | −3 | 276 |
| P1.orf0458 | | hypothetical protein | 499669 | 499484 | −2 | 186 |
| P1.orf0459 | frpC | bacteriocin | 501632 | 499881 | −3 | 1752 |
| P1.orf0460 | | hypothetical protein | 501804 | 501619 | −1 | 186 |
| P1.orf0461 | | hypothetical protein | 502315 | 501893 | −2 | 423 |
| P1.orf0462 | | putative ENOYL-COA HYDRATASE | 502566 | 503336 | 3 | 771 |
| P1.orf0463 | araC | transcriptional regulator, AraC family | 503355 | 504209 | 3 | 855 |
| P1.orf0464 | lcfA | long-chain-fatty-acid--CoA ligase | 504260 | 506095 | 2 | 1836 |
| P1.orf0465 | rhlG | short-chain dehydrogenase/reductase SDR | 506873 | 506106 | −3 | 768 |
| P1.orf0466 | pleC | non-motile and phage-resistance protein | 508451 | 507000 | −3 | 1452 |
| P1.orf0467 | | membrane protein | 508592 | 508915 | 2 | 324 |
| P1.orf0468 | | conserved hypothetical protein | 510548 | 508890 | −3 | 1659 |

| Locus | Gene | Product | Start | End | Strand | Length |
|---|---|---|---|---|---|---|
| P1.orf0469 | | hypothetical protein | 510922 | 510668 | −2 | 255 |
| P1.orf0470 | luxQ | sensor histidine kinase | 511186 | 514770 | 1 | 3585 |
| P1.orf0471 | | two component transcriptional regulator | 514767 | 515732 | 3 | 966 |
| P1.orf0472 | | conserved hypothetical protein | 515942 | 516124 | 2 | 183 |
| P1.orf0473 | | hypothetical protein | 516354 | 516656 | 3 | 303 |
| P1.orf0474 | ynaD | GCN5-related N-acetyltransferase | 516833 | 517366 | 2 | 534 |
| P1.orf0475 | | conserved hypothetical protein | 521851 | 517388 | −2 | 4464 |
| P1.orf0476 | | conserved hypothetical protein | 529416 | 521851 | −1 | 7566 |
| P1.orf0477 | | hypothetical protein | 530907 | 529468 | −1 | 1440 |
| P1.orf0478 | | hemagglutinin protein | 534719 | 530907 | −3 | 3813 |
| P1.orf0479 | | conserved hypothetical protein | 537877 | 534716 | −2 | 3162 |
| P1.orf0480 | | conserved hypothetical protein | 539720 | 537975 | −3 | 1746 |
| P1.orf0481 | | major facilitator transporter | 541177 | 539945 | −2 | 1233 |
| P1.orf0482 | arsC | ArsR family transcriptional regulator/protein tyrosine phosphatase | 541322 | 542170 | 2 | 849 |
| P1.orf0483 | gap3 | glyceraldehyde-3-phosphate dehydrogenase, type I | 542175 | 543197 | 3 | 1023 |
| P1.orf0484 | | major facilitator transporter | 543191 | 544441 | 2 | 1251 |
| P1.orf0485 | | beta-lactamase | 544538 | 545719 | 2 | 1182 |
| P1.orf0486 | | Cephalosporin hydroxylase | 546109 | 546777 | 1 | 669 |
| P1.orf0487 | | macrocin-O-methyltransferase | 546777 | 547604 | 3 | 828 |
| P1.orf0488 | | conserved hypothetical protein | 547960 | 548265 | 1 | 306 |
| P1.orf0489 | | hypothetical protein | 548277 | 549212 | 3 | 936 |
| P1.orf0490 | | O-linked N-acetylglucosamine transferase | 549206 | 550879 | 2 | 1674 |
| P1.orf0491 | | hypothetical protein | 550831 | 551082 | 1 | 252 |
| P1.orf0492 | | dehydratase, MaoC family protein | 551432 | 551587 | 2 | 156 |
| P1.orf0493 | citE | HpcH/HpaI aldolase/citrate lyase family | 551584 | 552501 | 1 | 918 |
| P1.orf0494 | | conserved hypothetical protein | 552513 | 553436 | 3 | 924 |
| P1.orf0495 | livM | ABC transporter permease protein | 555566 | 554586 | −3 | 981 |
| P1.orf0496 | livH | inner-membrane translocator | 556600 | 555731 | −2 | 870 |
| P1.orf0497 | livF | ABC transporter related protein | 557327 | 556614 | −3 | 714 |
| P1.orf0498 | braF | ABC transporter related protein | 558115 | 557324 | −2 | 792 |
| P1.orf0499 | livK | putative leucine/isoleucine/valine-binding protein precursor | 559395 | 558163 | −1 | 1233 |
| P1.orf0500 | baiB | AMP-dependent synthetase and ligase | 559600 | 561189 | 1 | 1590 |
| P1.orf0501 | mfeB | MaoC-like dehydratase | 561274 | 562128 | 1 | 855 |
| P1.orf0502 | | short-chain dehydrogenase | 562184 | 563104 | 2 | 921 |
| P1.orf0503 | paaG | crotonase | 563120 | 563935 | 2 | 816 |
| P1.orf0504 | badR | putative MarR family transcriptional regulator | 564533 | 563985 | −3 | 549 |
| P1.orf0505 | fadH | short-chain dehydrogenase/reductase SDR | 565439 | 564561 | −3 | 879 |
| P1.orf0506 | ymfI | short-chain dehydrogenase/reductase SDR | 566278 | 565538 | −2 | 741 |
| P1.orf0507 | | putative acyl-CoA hydratase | 567137 | 566289 | −3 | 849 |
| P1.orf0508 | yxbG | 2,5-dichloro-2,5-cyclohexadiene-1,4-diol dehydrogenase (2,5-ddol dehydrogenase) | 567916 | 567161 | −2 | 756 |
| P1.orf0509 | menE | long-chain-fatty-acid--CoA ligase | 568030 | 569610 | 1 | 1581 |
| P1.orf0510 | | Acyl-CoA dehydrogenase, middle domain protein | 570905 | 569721 | −3 | 1185 |
| P1.orf0511 | | pimeloyl-CoA dehydrogenase | 572014 | 570902 | −2 | 1113 |
| P1.orf0512 | lcfB | AMP-dependent synthetase and ligase | 573590 | 572049 | −3 | 1542 |
| P1.orf0513 | dctP | putative dicarboxylate-binding periplasmic protein | 573957 | 575021 | 3 | 1065 |
| P1.orf0514 | | TRAP transporter, DctQ-like membrane protein | 575066 | 575599 | 2 | 534 |
| P1.orf0515 | | trap dicarboxylate transporter, dctm subunit | 575642 | 576946 | 2 | 1305 |
| P1.orf0516 | | Long-chain specific acyl-CoA dehydrogenase | 578341 | 577181 | −2 | 1161 |
| P1.orf0517 | | acetyl-CoA acetyltransferase | 579540 | 578338 | −1 | 1203 |
| P1.orf0518 | | conserved hypothetical protein | 581018 | 579570 | −3 | 1449 |
| P1.orf0519 | | L-carnitine dehydratase/bile acid-inducible protein F | 581258 | 582325 | 2 | 1068 |
| P1.orf0520 | bcd | Acyl-CoA dehydrogenase, C-terminal domain protein | 582357 | 583523 | 3 | 1167 |
| P1.orf0521 | | Enoyl-CoA hydratase/isomerase | 583556 | 584341 | 2 | 786 |
| P1.orf0522 | alkR | transcriptional regulator, AraC family protein | 585281 | 584475 | −3 | 807 |
| P1.orf0523 | | alkyl hydroperoxide reductase/thiol specific antioxidant/Mal allergen | 585348 | 585887 | 3 | 540 |
| P1.orf0524 | acsA | acetyl-CoA synthetase/AMP-(fatty) acid ligase FadDx | 587610 | 585964 | −1 | 1647 |
| P1.orf0525 | crt | enoyl-CoA hydratase | 587849 | 588775 | 2 | 927 |
| P1.orf0526 | OPR3 | NADH: flavin oxidoreductase/NADH oxidase | 588859 | 589962 | 1 | 1104 |
| P1.orf0527 | | hypothetical protein | 590078 | 590392 | 2 | 315 |
| P1.orf0528 | mliC | Membrane-bound lysozyme inhibitor of C-type lysozyme | 590488 | 590883 | 1 | 396 |
| P1.orf0529 | csgA | putative short-chain dehydrogenase, oxidoreductase | 591228 | 590935 | −1 | 294 |
| P1.orf0530 | sdh | short-chain dehydrogenase/reductase SDR | 591650 | 591237 | −3 | 414 |
| P1.orf0531 | | LysR family transcriptional regulator | 591776 | 592696 | 2 | 921 |
| P1.orf0532 | | hexapeptide repeat-containing transferase | 592801 | 593412 | 1 | 612 |

-continued

| Locus | Gene | Product | Start | End | Strand | Length |
|---|---|---|---|---|---|---|
| P1.orf0533 | xerD | possible integrase-like protein | 594709 | 593429 | −2 | 1281 |
| P1.orf0534 | yxjM | putative sensor histidine kinase | 595024 | 597258 | 1 | 2235 |
| P1.orf0535 | devR | response regulator | 597287 | 598000 | 2 | 714 |
| P1.orf0536 | | conserved hypothetical protein | 598984 | 598019 | −2 | 966 |
| P1.orf0537 | | Putative TRAP transporter large permease protein | 600291 | 598999 | −1 | 1293 |
| P1.orf0538 | | putative DctQ (C4-dicarboxylate permease, small subunit) | 600818 | 600288 | −3 | 531 |
| P1.orf0539 | dctP | C4-dicarboxylate-binding periplasmic protein | 601989 | 600982 | −1 | 1008 |
| P1.orf0540 | crt | enoyl-CoA hydratase | 602255 | 603037 | 2 | 783 |
| P1.orf0541 | tagA | ToxR-activated gene A lipoprotein | 603169 | 605823 | 1 | 2655 |
| P1.orf0542 | yngI | AMP-dependent synthetase and ligase | 607530 | 605857 | −1 | 1674 |
| P1.orf0543 | | conserved hypothetical protein | 608158 | 607595 | −2 | 564 |
| P1.orf0544 | | conserved hypothetical protein | 608700 | 608179 | −1 | 522 |
| P1.orf0545 | | conserved hypothetical protein | 609437 | 608847 | −3 | 591 |
| P1.orf0546 | | sulfotransferase | 610594 | 609725 | −2 | 870 |
| P1.orf0547 | | Hpr(Ser) kinase/phosphatase | 611454 | 610591 | −1 | 864 |
| P1.orf0548 | | sulfotransferase | 611695 | 612348 | 1 | 654 |
| P1.orf0549 | | putative N-acetylglucosaminyltransferase | 614343 | 613219 | −1 | 1125 |
| P1.orf0550 | pcaK | 3-hydroxyphenylpropionic acid | 615773 | 614421 | −3 | 1353 |
| P1.orf0551 | | gentisate 1,2-dioxygenase | 616945 | 615887 | −2 | 1059 |
| P1.orf0552 | doxA | rieske (2Fe—2S) domain protein | 617264 | 616950 | −3 | 315 |
| P1.orf0553 | | aromatic-ring-hydroxylating dioxygenase, beta subunit | 617775 | 617281 | −1 | 495 |
| P1.orf0554 | bphA | aromatic-ring-hydroxylating dioxygenase, alpha subunit | 618980 | 617772 | −3 | 1209 |
| P1.orf0555 | thcD | FAD-dependent pyridine nucleotide-disulphide oxidoreductase | 619193 | 620440 | 2 | 1248 |
| P1.orf0556 | iclR | transcriptional regulator | 621218 | 620400 | −3 | 819 |
| P1.orf0557 | maiA | maleylacetoacetate isomerase | 621321 | 621962 | 3 | 642 |
| P1.orf0558 | | fumarylacetoacetate hydrolase | 622007 | 622696 | 2 | 690 |
| P1.orf0559 | mauR | LysR family transcriptional regulator | 623860 | 622940 | −2 | 921 |
| P1.orf0560 | | methylmalonate-semialdehyde dehydrogenase | 624014 | 625513 | 2 | 1500 |
| P1.orf0561 | | hypothetical protein | 625931 | 628021 | 2 | 2091 |
| P1.orf0562 | | hypothetical protein | 628036 | 628410 | 1 | 375 |
| P1.orf0563 | | peptidase M48, Ste24p | 628432 | 630216 | 1 | 1785 |
| P1.orf0564 | | TRAP transporter solute receptor, TAXI family | 630217 | 631218 | 1 | 1002 |
| P1.orf0565 | | hypothetical protein | 631582 | 631779 | 1 | 198 |
| P1.orf0566 | badR | MarR family transcriptional regulator | 633132 | 633674 | 3 | 543 |
| P1.orf0567 | hipO | peptidase M20D, amidohydrolase | 633059 | 631887 | −3 | 1173 |
| P1.orf0568 | | conserved hypothetical protein | 633807 | 634955 | 3 | 1149 |
| P1.orf0569 | yogA | putative zinc-binding dehydrogenase | 635212 | 636231 | 1 | 1020 |
| P1.orf0570 | lcfB | AMP-binding domain protein | 636228 | 638114 | 3 | 1887 |
| P1.orf0571 | | conserved hypothetical protein | 638111 | 638965 | 2 | 855 |
| P1.orf0572 | | TRAP-T family transporter, DctQ (4 TMs) subunit | 638962 | 639525 | 1 | 564 |
| P1.orf0573 | | TRAP-T family protein transporter, DctM (12 TMs) subunit | 639522 | 640826 | 3 | 1305 |
| P1.orf0574 | | phenylacetic acid degradation-related protein | 640842 | 641276 | 3 | 435 |
| P1.orf0575 | | hypothetical protein | 641795 | 641316 | −3 | 480 |
| P1.orf0576 | | heme receptor | 644452 | 641879 | −2 | 2574 |
| P1.orf0577 | fecR | anti-FecI sigma factor, FecR | 645589 | 644660 | −2 | 930 |
| P1.orf0578 | | ECF subfamily RNA polymerase sigma-24 factor | 646092 | 645589 | −1 | 504 |
| P1.orf0579 | | hypothetical protein | 646794 | 646489 | −1 | 306 |
| P1.orf0580 | | HPr kinase | 647747 | 646791 | −3 | 957 |
| P1.orf0581 | asnH | asparagine synthase | 649648 | 647747 | −2 | 1902 |
| P1.orf0582 | | peptidase S45 penicillin amidase | 649895 | 652276 | 2 | 2382 |
| P1.orf0583 | | enoyl-CoA hydratase | 652483 | 653304 | 1 | 822 |
| P1.orf0584 | yhgD | transcriptional regulator, TetR family | 654155 | 653328 | −3 | 828 |
| P1.orf0585 | | conserved hypothetical protein | 654646 | 654152 | −2 | 495 |
| P1.orf0586 | | hypothetical protein | 655893 | 654871 | −1 | 1023 |
| P1.orf0587 | algI | membrane bound O-acyl transferase MBOAT family protein | 657349 | 655880 | −2 | 1470 |
| P1.orf0588 | acpM | putative acyl carrier protein | 657482 | 657718 | 2 | 237 |
| P1.orf0589 | | conserved hypothetical protein | 658665 | 657730 | −1 | 936 |
| P1.orf0590 | | FkbH like protein | 658770 | 660806 | 3 | 2037 |
| P1.orf0591 | yafC | transcriptional regulator | 661741 | 660836 | −2 | 906 |
| P1.orf0592 | | addiction module antitoxin | 662033 | 661743 | −3 | 291 |
| P1.orf0593 | dinJ | addiction module antitoxin | 662319 | 662020 | −1 | 300 |
| P1.orf0594 | | hypothetical protein | 662702 | 662454 | −3 | 249 |
| P1.orf0595 | | conserved hypothetical protein | 662739 | 666431 | 3 | 3693 |
| P1.orf0596 | | hypothetical protein | 666428 | 667438 | 2 | 1011 |
| P1.orf0597 | | conserved hypothetical protein | 667452 | 671111 | 3 | 3660 |
| P1.orf0598 | | HipA-like | 672445 | 671177 | −2 | 1269 |
| P1.orf0599 | | XRE family transcriptional regulator | 672684 | 672442 | −1 | 243 |
| P1.orf0600 | katE | catalase | 675002 | 672882 | −3 | 2121 |

-continued

| Locus | Gene | Product | Start | End | Strand | Length |
|---|---|---|---|---|---|---|
| P1.orf0601 | yhcV | Inosine-5'-monophosphate dehydrogenase related protein | 675652 | 675164 | −2 | 489 |
| P1.orf0602 | | phage SPO1 DNA polymerase-related protein | 675846 | 676556 | 3 | 711 |
| P1.orf0603 | tycC | non-ribosomal peptide synthetase | 676765 | 682599 | 1 | 5835 |
| P1.orf0604 | tycC | Amino acid adenylation | 682572 | 691364 | 3 | 8793 |
| P1.orf0605 | lgrC | Amino acid adenylation | 691352 | 692830 | 2 | 1479 |
| P2.orf0001 | fdh | alcohol dehydrogenase | 1 | 1170 | 1 | 1170 |
| P2.orf0002 | D | tail protein D | 2205 | 1204 | −1 | 1002 |
| P2.orf0003 | | phage Tail Protein X | 2432 | 2205 | −3 | 228 |
| P2.orf0004 | | conserved hypothetical protein | 3679 | 2429 | −2 | 1251 |
| P2.orf0005 | | hypothetical protein | 5381 | 3663 | −3 | 1719 |
| P2.orf0006 | | bacteriophage gpE | 5834 | 5529 | −3 | 306 |
| P2.orf0007 | FII | similar to probable bacteriophage protein | 6419 | 5916 | −3 | 504 |
| P2.orf0008 | FI | phage tail sheath protein | 7686 | 6511 | −1 | 1176 |
| P2.orf0009 | | hypothetical protein | 8166 | 7690 | −1 | 477 |
| P2.orf0010 | | conserved hypothetical protein | 8989 | 8177 | −2 | 813 |
| P2.orf0011 | | conserved hypothetical protein | 11125 | 8993 | −2 | 2133 |
| P2.orf0012 | | gp15 protein | 11987 | 11139 | −3 | 849 |
| P2.orf0013 | | phage baseplate J-like protein | 12876 | 11980 | −1 | 897 |
| P2.orf0014 | | Baseplate assembly protein W | 13256 | 12873 | −3 | 384 |
| P2.orf0015 | | PAAR | 13555 | 13262 | −2 | 294 |
| P2.orf0016 | | phage baseplate assembly protein V | 14012 | 13560 | −3 | 453 |
| P2.orf0017 | | hypothetical protein | 14632 | 14009 | −2 | 624 |
| P2.orf0018 | | hypothetical protein | 15097 | 14816 | −2 | 282 |
| P2.orf0019 | amtB | ammonium transporter | 16723 | 15371 | −2 | 1353 |
| P2.orf0020 | tauD | Taurine dioxygenase | 17879 | 17037 | −3 | 843 |
| P2.orf0021 | | class II aldolase/adducin family protein | 18717 | 17953 | −1 | 765 |
| P2.orf0022 | | binding-protein-dependent transport systems inner membrane component | 19509 | 18739 | −1 | 771 |
| P2.orf0023 | | binding-protein-dependent transport systems inner membrane component | 20273 | 19491 | −3 | 783 |
| P2.orf0024 | | ABC transporter related protein | 21163 | 20270 | −2 | 894 |
| P2.orf0025 | | NMT1/THI5 like domain protein | 22221 | 21181 | −1 | 1041 |
| P2.orf0026 | | metal-dependent phosphohydrolase | 22657 | 23268 | 1 | 612 |
| P2.orf0027 | lutR | transcriptional regulatory protein | 23401 | 24090 | 1 | 690 |
| P2.orf0028 | dhkJ | Signal transduction histidine kinase | 24694 | 29427 | 1 | 4734 |
| P2.orf0029 | rpfG | two component system, transcriptional regulatory protein | 29424 | 30527 | 3 | 1104 |
| P2.orf0030 | ydeR | major facilitator superfamily protein | 31739 | 30543 | −3 | 1197 |
| P2.orf0031 | yeaT | transcriptional regulator | 31835 | 32716 | 2 | 882 |
| P2.orf0032 | yvdB | sulphate transporter | 34447 | 32732 | −2 | 1716 |
| P2.orf0033 | | XRE family transcriptional regulator | 34788 | 34528 | −1 | 261 |
| P2.orf0034 | | conserved hypothetical protein | 35012 | 35473 | 2 | 462 |
| P2.orf0035 | lmrA | transcriptional regulator, TetR family | 35497 | 36090 | 1 | 594 |
| P2.orf0036 | | ABC transporter related protein | 36176 | 38086 | 2 | 1911 |
| P2.orf0037 | | hypothetical protein | 38126 | 38839 | 2 | 714 |
| P2.orf0038 | | ABC superfamily ATP binding cassette transporter substrate-binding protein | 40501 | 38924 | −2 | 1578 |
| P2.orf0039 | | poly(aspartic acid) hydrolase | 41621 | 40668 | −3 | 954 |
| P2.orf0040 | gsiA | ABC superfamily ATP binding cassette transporter, ABC protein | 43229 | 41646 | −3 | 1584 |
| P2.orf0041 | | Dipeptide transport system permease protein dppC | 44158 | 43292 | −2 | 867 |
| P2.orf0042 | | Putative peptide transport system permease protein | 45096 | 44155 | −1 | 942 |
| P2.orf0043 | | acyl-coenzyme A: 6-aminopenicillanic-acid-acyltransferase | 46564 | 45401 | −2 | 1164 |
| P2.orf0044 | bphR | GntR-family transcriptional regulator | 46705 | 47880 | 1 | 1176 |
| P2.orf0045 | | hypothetical protein | 48044 | 47868 | −3 | 177 |
| P2.orf0046 | paiB | Protease synthase and sporulation protein PAI | 48505 | 48155 | −2 | 351 |
| P2.orf0047 | | amidase family protein | 49974 | 48520 | −1 | 1455 |
| P2.orf0048 | | secretion protein HlyD family protein | 50955 | 50059 | −1 | 897 |
| P2.orf0049 | | conserved hypothetical protein | 51167 | 50952 | −3 | 216 |
| P2.orf0050 | ydhK | fusaric acid resistance protein region | 53257 | 51164 | −2 | 2094 |
| P2.orf0051 | yeaM | AraC family transcriptional regulator | 53335 | 54138 | 1 | 804 |
| P2.orf0052 | | conserved hypothetical protein | 54665 | 55303 | 2 | 639 |
| P2.orf0053 | | conserved hypothetical protein | 56402 | 55323 | −3 | 1080 |
| P2.orf0054 | | conserved hypothetical protein | 56446 | 57084 | 1 | 639 |
| P2.orf0055 | | conserved hypothetical protein | 57088 | 57966 | 1 | 879 |
| P2.orf0056 | pheC | extracellular solute-binding protein | 58113 | 58955 | 3 | 843 |
| P2.orf0057 | glnP | polar amino acid ABC transporter, inner membrane subunit | 59028 | 59690 | 3 | 663 |
| P2.orf0058 | tcyC | ABC transporter ATP-binding protein | 59687 | 60472 | 2 | 786 |
| P2.orf0059 | | Chain A, Crystal Structure Of A Muconate Cycloisomerase From *Azorhizobium Caulinodans* | 60482 | 61603 | 2 | 1122 |
| P2.orf0060 | dadA | FAD dependent oxidoreductase | 61661 | 62932 | 2 | 1272 |

-continued

| Locus | Gene | Product | Start | End | Strand | Length |
|---|---|---|---|---|---|---|
| P2.orf0061 | ilvB | thiamine pyrophosphate protein central region | 62971 | 64722 | 1 | 1752 |
| P2.orf0062 | gcvA | LysR family transcriptional regulator | 65673 | 64735 | −1 | 939 |
| P2.orf0063 | | conserved hypothetical protein | 66090 | 65689 | −1 | 402 |
| P2.orf0064 | | Beta-lactamase | 67350 | 66328 | −1 | 1023 |
| P2.orf0065 | | Chloramphenicol acetyltransferase | 68054 | 67404 | −3 | 651 |
| P2.orf0066 | yoeA | MATE efflux family protein | 69602 | 68235 | −3 | 1368 |
| P2.orf0067 | nccB | RND family efflux transporter MFP subunit | 69931 | 71175 | 1 | 1245 |
| P2.orf0068 | nolG | acriflavin resistance protein | 71172 | 74234 | 3 | 3063 |
| P2.orf0069 | | GCN5-related N-acetyltransferase | 74551 | 74243 | −2 | 309 |
| P2.orf0070 | yagA | ISHne2, transposase | 74674 | 75075 | 1 | 402 |
| P2.orf0071 | | putative periplasmic protein | 75622 | 76551 | 1 | 930 |
| P2.orf0072 | | GCN5-related N-acetyltransferase | 78513 | 78055 | −1 | 459 |
| P2.orf0073 | | mannitol transporter | 78868 | 79398 | 1 | 531 |
| P2.orf0074 | | DctMS | 79403 | 80728 | 2 | 1326 |
| P2.orf0075 | dctP | putative extracellular solute-binding protein, family 7 | 80801 | 81931 | 2 | 1131 |
| P2.orf0076 | menE | citrate synthase | 81954 | 83537 | 3 | 1584 |
| P2.orf0077 | | enoyl CoA hydratase | 83534 | 84376 | 2 | 843 |
| P2.orf0078 | marA | Multiple antibiotic resistance protein marA | 84846 | 84418 | −1 | 429 |
| P2.orf0079 | | conserved hypothetical protein | 85298 | 84885 | −3 | 414 |
| P2.orf0080 | fct | TonB-dependent siderophore receptor | 85472 | 87691 | 2 | 2220 |
| P2.orf0081 | fes | esterase | 87688 | 89295 | 1 | 1608 |
| P2.orf0082 | ytnP | metallo-beta-lactamase | 90248 | 89301 | −3 | 948 |
| P2.orf0083 | nahR | Transcriptional regulator, LysR family | 90263 | 91285 | 2 | 1023 |
| P2.orf0084 | guaA | putative GMP synthase [glutamine-hydrolyzing] | 91310 | 91993 | 2 | 684 |
| P2.orf0085 | | conserved hypothetical protein | 92830 | 92006 | −2 | 825 |
| P2.orf0086 | | transcriptional regulator, GntR family | 93052 | 93756 | 1 | 705 |
| P2.orf0087 | dapA | Dihydrodipicolinate synthase | 93875 | 94837 | 2 | 963 |
| P2.orf0088 | | hypothetical protein | 94888 | 95079 | 1 | 192 |
| P2.orf0089 | artI | extracellular solute-binding protein | 95092 | 95901 | 1 | 810 |
| P2.orf0090 | yecS | ABC transporter, membrane spanning protein (amino acid) | 95990 | 96655 | 2 | 666 |
| P2.orf0091 | gltK | putative amino acid ABC transporter permease protein | 96667 | 97320 | 1 | 654 |
| P2.orf0092 | glnQ | putative amino acid ABC transporter ATP-binding protein | 97313 | 98035 | 2 | 723 |
| P2.orf0093 | dadA | D-amino-acid dehydrogenase | 98035 | 99276 | 1 | 1242 |
| P2.orf0094 | | proline racemase | 99290 | 100291 | 2 | 1002 |
| P2.orf0095 | | Tripartite ATP-independent periplasmic | 100453 | 100992 | 1 | 540 |
| P2.orf0096 | siaT | TRAP dicarboxylate transporter, DctM subunit | 100994 | 102262 | 2 | 1269 |
| P2.orf0097 | | TRAP-type large permease component | 102297 | 103304 | 3 | 1008 |
| P2.orf0098 | | sugar ABC transporter | 105174 | 103435 | −1 | 1740 |
| P2.orf0099 | | conserved hypothetical protein | 105572 | 105285 | −3 | 288 |
| P2.orf0100 | yurM | binding-protein-dependent transport systems inner membrane component | 106468 | 105587 | −2 | 882 |
| P2.orf0101 | | sugar ABC transporter | 107336 | 106470 | −3 | 867 |
| P2.orf0102 | | ABC transporter related protein | 108411 | 107341 | −1 | 1071 |
| P2.orf0103 | smoK | ABC transporter related protein | 109522 | 108431 | −2 | 1092 |
| P2.orf0104 | glpD | FAD dependent oxidoreductase | 111127 | 109586 | −2 | 1542 |
| P2.orf0105 | | conserved hypothetical protein | 112676 | 111435 | −3 | 1242 |
| P2.orf0106 | | hypothetical protein | 113264 | 113103 | −3 | 162 |
| P2.orf0107 | cydB | cytochrome d ubiquinol oxidase, subunit II | 114258 | 113248 | −1 | 1011 |
| P2.orf0108 | cydA | cytochrome bd ubiquinol oxidase, subunit I | 115738 | 114263 | −2 | 1476 |
| P2.orf0109 | lcfB | AMP-dependent synthetase and ligase | 116321 | 117895 | 2 | 1575 |
| P2.orf0110 | | putative extracellular solute-binding protein | 117996 | 119045 | 3 | 1050 |
| P2.orf0111 | | conserved hypothetical protein | 119050 | 119565 | 1 | 516 |
| P2.orf0112 | siaT | TRAP-type C4-dicarboxylate transport system, large permease component | 119562 | 120851 | 3 | 1290 |
| P2.orf0113 | todF | alpha/beta hydrolase fold protein | 120931 | 121773 | 1 | 843 |
| P2.orf0114 | | conserved hypothetical protein | 121793 | 122113 | 2 | 321 |
| P2.orf0115 | mhpB | protocatechuate 4,5-dioxygenase subunit beta | 122110 | 122937 | 1 | 828 |
| P2.orf0116 | bedB | CinA3 | 122951 | 123274 | 2 | 324 |
| P2.orf0117 | hcaE | Aromatic-ring-hydroxylating dioxygenase, alpha subunit-like protein | 123351 | 124739 | 3 | 1389 |
| P2.orf0118 | | 3-phenylpropionate dioxygenase subunit beta | 124751 | 125293 | 2 | 543 |
| P2.orf0119 | bphB | 2,3-dihydroxy-2,3-dihydrophenylpropionate dehydrogenase | 125327 | 126139 | 2 | 813 |
| P2.orf0120 | | 2-nitropropane dioxygenase, NPD | 126169 | 127191 | 1 | 1023 |
| P2.orf0121 | todJ | 2-oxopent-4-enoate hydratase | 127188 | 127979 | 3 | 792 |
| P2.orf0122 | | acetaldehyde dehydrogenase | 127985 | 128923 | 2 | 939 |
| P2.orf0123 | | 4-hydroxy-2-oxovalerate aldolase | 128927 | 129985 | 2 | 1059 |
| P2.orf0124 | tetR | regulatory protein TetR | 130566 | 129976 | −1 | 591 |
| P2.orf0125 | thcD | ferredoxin--NAD+ reductase | 130857 | 132035 | 3 | 1179 |
| P2.orf0126 | | conserved hypothetical protein | 132167 | 132940 | 2 | 774 |
| P2.orf0127 | ycdT | diguanylate cyclase | 133040 | 134215 | 2 | 1176 |
| P2.orf0128 | yhiN | conserved hypothetical protein | 135416 | 134226 | −3 | 1191 |

-continued

| Locus | Gene | Product | Start | End | Strand | Length |
|---|---|---|---|---|---|---|
| P2.orf0129 | gacS | multi-sensor hybrid histidine kinase | 135604 | 139797 | 1 | 4194 |
| P2.orf0130 | | isopenicillin N synthase | 140642 | 139803 | −3 | 840 |
| P2.orf0131 | | hypothetical protein | 141315 | 142607 | 3 | 1293 |
| P2.orf0132 | | hypothetical protein | 142771 | 142646 | −2 | 126 |
| P2.orf0133 | | transposase, IS4 | 143023 | 142853 | −2 | 171 |
| P2.orf0134 | | transposase | 143487 | 143020 | −1 | 468 |
| P2.orf0135 | | peptidase M48 Ste24p | 145079 | 144252 | −3 | 828 |
| P2.orf0136 | rhtB | RhtB family transporter | 145828 | 145223 | −2 | 606 |
| P2.orf0137 | ASN1 | putative asparagine synthase (glutamine-hydrolyzing) | 147157 | 145841 | −2 | 1317 |
| P2.orf0138 | ubiE | Generic methyltransferase | 148478 | 147132 | −3 | 1347 |
| P2.orf0139 | | transcriptional regulator, LysR family | 149523 | 148594 | −1 | 930 |
| P2.orf0140 | | ATP-binding protein | 150384 | 149590 | −1 | 795 |
| P2.orf0141 | dapA | Dihydrodipicolinate synthase | 151442 | 150381 | −3 | 1062 |
| P2.orf0142 | | conserved hypothetical protein | 152393 | 151569 | −3 | 825 |
| P2.orf0143 | | conserved hypothetical protein | 153423 | 152380 | −1 | 1044 |
| P2.orf0144 | | putative ABC transporter permease protein | 154241 | 153420 | −3 | 822 |
| P2.orf0145 | mtrR | transcriptional regulatory protein | 155062 | 154388 | −2 | 675 |
| P2.orf0146 | | Pyrimidine precursor biosynthesis enzyme | 155238 | 156239 | 3 | 1002 |
| P2.orf0147 | | putative transmembrane protein | 156889 | 156278 | −2 | 612 |
| P2.orf0148 | | transcriptional regulator, TetR family | 157618 | 157037 | −2 | 582 |
| P2.orf0149 | | Pirin-related protein | 157819 | 158520 | 1 | 702 |
| P2.orf0150 | | dihydroxy-acid dehydratase | 158781 | 160622 | 3 | 1842 |
| P2.orf0151 | | NMT1/THI5-like domain-containing protein | 160851 | 161813 | 3 | 963 |
| P2.orf0152 | | ABC transporter, membrane spanning protein | 161910 | 162695 | 3 | 786 |
| P2.orf0153 | | ABC transporter, nucleotide binding/ATPase protein | 162692 | 163480 | 2 | 789 |
| P2.orf0154 | dinJ | addiction module antitoxin | 163579 | 163881 | 1 | 303 |
| P2.orf0155 | | addiction module toxin, RelE/StbE family | 163878 | 164165 | 3 | 288 |
| P2.orf0156 | ydaP | thiamine pyrophosphate protein domain protein TPP-binding | 165971 | 164190 | −3 | 1782 |
| P2.orf0157 | | putative fatty acid beta hydroxylase | 166136 | 167419 | 2 | 1284 |
| P2.orf0158 | | superoxide dismutase protein | 167454 | 167984 | 3 | 531 |
| P2.orf0159 | yidJ | arylsulfatase A and related enzyme | 168829 | 170619 | 1 | 1791 |
| P2.orf0160 | pcaC | carboxymuconolactone decarboxylase | 171893 | 170712 | −3 | 1182 |
| P2.orf0161 | | transcriptional regulator, LysR family | 172948 | 172043 | −2 | 906 |
| P2.orf0162 | fdh | zinc-containing alcohol dehydrogenase superfamily protein | 173105 | 174121 | 2 | 1017 |
| P2.orf0163 | fabG | short chain dehydrogenase | 174920 | 174168 | −3 | 753 |
| P2.orf0164 | ampR | MPR_RHOCA RecName: Full = HTH-type transcriptional activator AmpR emb | 176285 | 175293 | −3 | 993 |
| P2.orf0165 | | LAC_RHOCA RecName: Full = Beta-lactamase; AltName: Full = Penicillinase; Flags: Precursor emb | 176386 | 177288 | 1 | 903 |
| P2.orf0166 | | TetR family transcriptional regulator | 177876 | 177292 | −1 | 585 |
| P2.orf0167 | ykvO | 3-oxoacyl-(acyl-carrier-protein) reductase | 177978 | 178733 | 3 | 756 |
| P2.orf0168 | | putative transcriptional regulator, AbrB family | 179015 | 178761 | −3 | 255 |
| P2.orf0169 | | DNA-binding protein | 179385 | 179083 | −1 | 303 |
| P2.orf0170 | | conserved hypothetical protein | 180464 | 179562 | −3 | 903 |
| P2.orf0171 | mngR | Mannosyl-D-glycerate transport/metabolism system repressor mngR | 181469 | 180681 | −3 | 789 |
| P2.orf0172 | cat2 | putative 4-hydroxybutyrate coenzyme A transferase | 182704 | 181442 | −2 | 1263 |
| P2.orf0173 | | MmgE/PrpD family protein | 182794 | 184152 | 1 | 1359 |
| P2.orf0174 | paaK | putative aerobic phenylacetate-CoA ligase | 184208 | 185620 | 2 | 1413 |
| P2.orf0175 | gatA | glutamyl-tRNA (Gln) amidotransferase, A subunit | 185687 | 187156 | 2 | 1470 |
| P2.orf0176 | amiD | Putative amidase | 188946 | 187531 | −1 | 1416 |
| P2.orf0177 | | NMT1/THI5 like domain protein | 189203 | 190225 | 2 | 1023 |
| P2.orf0178 | | short chain dehydrogenase | 190353 | 191204 | 3 | 852 |
| P2.orf0179 | hisC | aspartate aminotransferase | 191201 | 192334 | 2 | 1134 |
| P2.orf0180 | ytxM | abhydrolase 1 | 192352 | 193233 | 1 | 882 |
| P2.orf0181 | allC | allantoate amidohydrolase | 193332 | 194600 | 3 | 1269 |
| P2.orf0182 | ytbD | major facilitator superfamily MFS_1 | 195827 | 194634 | −3 | 1194 |
| P2.orf0183 | | hypothetical protein | 196724 | 197392 | 2 | 669 |
| P2.orf0184 | | hypothetical protein | 197900 | 197595 | −3 | 306 |
| P2.orf0185 | slmA | Transcriptional regulator | 198971 | 198189 | −3 | 783 |
| P2.orf0186 | | branched-chain amino acid ABC superfamily ATP binding cassette transporter, binding protein | 200283 | 199069 | −1 | 1215 |
| P2.orf0187 | | pyruvate carboxylase | 203732 | 200391 | −3 | 3342 |
| P2.orf0188 | caiC | AMP-dependent synthetase and ligase | 205403 | 203736 | −3 | 1668 |
| P2.orf0189 | ycdT | diguanylate cyclase | 205708 | 207324 | 1 | 1617 |
| P2.orf0190 | | 2-oxoisovalerate dehydrogenase (alpha subunit) | 207731 | 208963 | 2 | 1233 |
| P2.orf0191 | | 2-oxoisovalerate dehydrogenase (beta subunit) | 208968 | 209981 | 3 | 1014 |

-continued

| Locus | Gene | Product | Start | End | Strand | Length |
|---|---|---|---|---|---|---|
| P2.orf0192 | | branched-chain alpha-keto acid dehydrogenase subunit E2 | 209985 | 211337 | 3 | 1353 |
| P2.orf0193 | lpdV | dihydrolipoamide dehydrogenase | 211342 | 212739 | 1 | 1398 |
| P2.orf0194 | iorA | isoquinoline 1-oxidoreductase subunit alpha | 213057 | 213515 | 3 | 459 |
| P2.orf0195 | iorB | isoquinoline 1-oxidoreductase, beta subunit | 213533 | 215710 | 2 | 2178 |
| P2.orf0196 | yycB | QbsM like protein | 215917 | 217068 | 1 | 1152 |
| P2.orf0197 | nemR | TetR family transcriptional regulator | 217122 | 217727 | 3 | 606 |
| P2.orf0198 | rutB | putative hydrolase | 218483 | 217788 | −3 | 696 |
| P2.orf0199 | ytlA | nitrate/sulfonate/taurine/bicarbonate ABC superfamily ATP binding cassette transporter, binding protein | 218671 | 219723 | 1 | 1053 |
| P2.orf0200 | ytlC | taurine ABC superfamily ATP binding cassette transporter, ABC protein | 219761 | 220600 | 2 | 840 |
| P2.orf0201 | ytlD | putative ABC transport proteins, inner membrane component | 220590 | 221444 | 3 | 855 |
| P2.orf0202 | | putative membrane protein, DUF81 | 221536 | 222270 | 1 | 735 |
| P2.orf0203 | gloA | glyoxalase/bleomycin resistance protein/dioxygenase | 222718 | 222281 | −2 | 438 |
| P2.orf0204 | | DoxX family protein | 223198 | 222809 | −2 | 390 |
| P2.orf0205 | | TetR family transcriptional regulator | 223870 | 223322 | −2 | 549 |
| P2.orf0206 | | alcohol dehydrogenase | 223948 | 224979 | 1 | 1032 |
| P2.orf0207 | | FAD-binding 9 siderophore-interacting domain protein | 225757 | 224999 | −2 | 759 |
| P2.orf0208 | yeaM | transcriptional regulatory protein | 226721 | 225882 | −3 | 840 |
| P2.orf0209 | cyaA | ferredoxin | 228506 | 226734 | −3 | 1773 |
| P2.orf0210 | nte1 | transcriptional regulator, Crp/Fnr family | 228613 | 229329 | 1 | 717 |
| P2.orf0211 | | patatin | 230390 | 229314 | −3 | 1077 |
| P2.orf0212 | | hypothetical protein | 230826 | 230365 | −1 | 462 |
| P2.orf0213 | | hypothetical protein | 231299 | 230823 | −3 | 477 |
| P2.orf0214 | oruR | PA2556 | 232461 | 231394 | −1 | 1068 |
| P2.orf0215 | ycfQ | TetR family transcriptional regulator | 233166 | 232561 | −1 | 606 |
| P2.orf0216 | yjgI | putative short-chain dehydrogenase/oxidoreductase | 233301 | 234071 | 3 | 771 |
| P2.orf0217 | | conserved hypothetical protein | 235012 | 234062 | −2 | 951 |
| P2.orf0218 | fhuF | ferric iron reductase | 235830 | 235087 | −1 | 744 |
| P2.orf0219 | fhuB | transporter | 237833 | 235833 | −3 | 2001 |
| P2.orf0220 | fhuC | ABC-type hydroxamate-dependent iron transport system, ATPase component | 238609 | 237830 | −2 | 780 |
| P2.orf0221 | fhuD | periplasmic component, ABC-type hydroxamate-dependent iron transport system | 239544 | 238606 | −1 | 939 |
| P2.orf0222 | fct | TonB-dependent siderophore receptor | 241934 | 239553 | −3 | 2382 |
| P2.orf0223 | ompR | two component transcriptional regulator, winged helix family | 242808 | 242068 | −1 | 741 |
| P2.orf0224 | | MltA-interacting MipA family protein | 243592 | 242822 | −2 | 771 |
| P2.orf0225 | envZ | two component sensor kinase | 243801 | 245078 | 3 | 1278 |
| P2.orf0226 | | putative AraC family transcriptional regulator | 246018 | 245083 | −1 | 936 |
| P2.orf0227 | | NAD-dependent epimerase/dehydratase | 246162 | 247058 | 3 | 897 |
| P2.orf0228 | ydbC | putative oxidoreductase | 247979 | 247098 | −3 | 882 |
| P2.orf0229 | | sensor histidine kinase | 251372 | 248049 | −3 | 3324 |
| P2.orf0230 | | response regulator receiver protein | 252450 | 251737 | −1 | 714 |
| P2.orf0231 | | transcriptional regulator/antitoxin, MazE | 252681 | 252908 | 3 | 228 |
| P2.orf0232 | | conserved hypothetical protein | 254762 | 252999 | −3 | 1764 |
| P2.orf0233 | | transcriptional regulatory protein | 255618 | 254920 | −1 | 699 |
| P2.orf0234 | fadK | putative acid-CoA ligase | 257373 | 255661 | −1 | 1713 |
| P2.orf0235 | livF | ABC branched chain amino acid transporter, ATPase subunit | 258272 | 257553 | −3 | 720 |
| P2.orf0236 | livG | ABC branched chain amino acid transporter, ATPase subunit | 259047 | 258265 | −1 | 783 |
| P2.orf0237 | | ABC branched chain amino acid transporter, inner membrane subunit | 260072 | 259044 | −3 | 1029 |
| P2.orf0238 | braD | ABC branched chain amino acid transporter, inner membrane subunit | 260962 | 260069 | −2 | 894 |
| P2.orf0239 | | ABC branched chain amino acid transporter, periplasmic ligandbinding protein | 262424 | 261135 | −3 | 1290 |
| P2.orf0240 | lcfB | AMP-dependent synthetase and ligase | 264169 | 262496 | −2 | 1674 |
| P2.orf0241 | crt | enoyl-CoA hydratase/isomerase | 265037 | 264222 | −3 | 816 |
| P2.orf0242 | yngJ | acyl-CoA dehydrogenase domain-containing protein | 266230 | 265109 | −2 | 1122 |
| P2.orf0243 | IVD | acyl-CoA dehydrogenase domain-containing protein | 267644 | 266403 | −3 | 1242 |
| P2.orf0244 | | conserved hypothetical protein | 268137 | 267889 | −1 | 249 |
| P2.orf0245 | old | putative ATP-dependent endonuclease of the OLD family protein | 268626 | 270371 | 3 | 1746 |
| P2.orf0246 | | conserved hypothetical protein | 271176 | 270910 | −1 | 267 |
| P2.orf0247 | | addiction module antitoxin | 270868 | 270617 | −2 | 252 |
| P2.orf0248 | | hypothetical protein | 271312 | 271533 | 1 | 222 |
| P2.orf0249 | | short-chain dehydrogenase/reductase SDR | 272518 | 271616 | −2 | 903 |

-continued

| Locus | Gene | Product | Start | End | Strand | Length |
|---|---|---|---|---|---|---|
| P2.orf0250 | gylR | IclR family transcriptional regulator | 273492 | 272716 | −1 | 777 |
| P2.orf0251 | | TRAP-T family transporter, DctM (12 TMs) subunit | 274823 | 273498 | −3 | 1326 |
| P2.orf0252 | | hypothetical protein | 275340 | 274813 | −1 | 528 |
| P2.orf0253 | | conserved hypothetical protein | 276464 | 275328 | −3 | 1137 |
| P2.orf0254 | | conserved hypothetical protein | 276581 | 277462 | 2 | 882 |
| P2.orf0255 | | aspartate racemase | 277466 | 278194 | 2 | 729 |
| P2.orf0256 | | OsmC family protein | 278769 | 279194 | 3 | 426 |
| P2.orf0257 | | methyl-accepting chemotaxis protein | 280931 | 279228 | −3 | 1704 |
| P2.orf0258 | | conserved hypothetical protein | 281540 | 281079 | −3 | 462 |
| P2.orf0259 | citE | citrate lyase beta chain | 282469 | 281537 | −2 | 933 |
| P2.orf0260 | pcaR | transcriptional regulator | 283242 | 282466 | −1 | 777 |
| P2.orf0261 | | acyltransferase 3 | 283484 | 284680 | 2 | 1197 |
| P2.orf0262 | bam | Indoleacetamide hydrolase | 286128 | 284692 | −1 | 1437 |
| P2.orf0263 | paiB | putative regulatory protein | 286853 | 286185 | −3 | 669 |
| P2.orf0264 | aes | putative acetyl esterase | 287833 | 286868 | −2 | 966 |
| P2.orf0265 | gsiA | putative ABC transporter ATP-binding protein | 289497 | 287845 | −1 | 1653 |
| P2.orf0266 | gsiC | binding-protein-dependent transport systems inner membrane component | 291379 | 290399 | −2 | 981 |
| P2.orf0267 | appC | binding-protein-dependent transport systems inner membrane component | 290351 | 289500 | −3 | 852 |
| P2.orf0268 | appA | twin-arginine translocation pathway signal | 292974 | 291382 | −1 | 1593 |
| P2.orf0269 | ghrA | putative 2-hydroxyacid dehydrogenase family protein. | 294110 | 293178 | −3 | 933 |
| P2.orf0270 | yeaM | AraC family transcriptional regulator | 294233 | 295117 | 2 | 885 |
| P2.orf0271 | | putative transcriptional regulators containing the CopG/Arc/MetJ DNA-binding domain | 295330 | 295127 | −2 | 204 |
| P2.orf0272 | | PRC-barrel domain-containing protein | 295879 | 295508 | −2 | 372 |
| P2.orf0273 | etrA | transcriptional regulator, Crp/Fnr family protein | 296121 | 296909 | 3 | 789 |
| P2.orf0274 | | conserved hypothetical protein | 297016 | 298263 | 1 | 1248 |
| P2.orf0275 | | conserved hypothetical protein | 298260 | 298787 | 3 | 528 |
| P2.orf0276 | | DNA ligase III-like protein | 298784 | 299476 | 2 | 693 |
| P2.orf0277 | | HvnC halovibrin | 299695 | 300918 | 1 | 1224 |
| P2.orf0278 | | conserved hypothetical protein | 301464 | 301009 | −1 | 456 |
| P2.orf0279 | ybfL | transposase, is4 family | 301727 | 302773 | 2 | 1047 |
| P2.orf0280 | | thioesterase-like protein | 303254 | 302817 | −3 | 438 |
| P2.orf0281 | | major facilitator superfamily MFS_1 | 304485 | 303271 | −1 | 1215 |
| P2.orf0282 | | conserved hypothetical protein | 305396 | 306409 | 2 | 1014 |
| P2.orf0283 | | conserved hypothetical protein | 306406 | 306660 | 1 | 255 |
| P2.orf0284 | serS | tRNA synthetase class II (G H P and S) | 306703 | 307707 | 1 | 1005 |
| P2.orf0285 | yrpB | 2-nitropropane dioxygenase NPD | 307806 | 308786 | 3 | 981 |
| P2.orf0286 | ASMT | O-methyltransferase family 2 | 308810 | 309811 | 2 | 1002 |
| P2.orf0287 | | aldo/keto reductase family oxidoreductase | 310797 | 309829 | −1 | 969 |
| P2.orf0288 | | short-chain dehydrogenase/reductase SDR | 311726 | 310845 | −3 | 882 |
| P2.orf0289 | siaT | TRAP transporter, DctM subunit | 313045 | 311756 | −2 | 1290 |
| P2.orf0290 | | hypothetical protein | 313660 | 313058 | −2 | 603 |
| P2.orf0291 | dctP | C4-dicarboxylate-binding periplasmic protein | 314806 | 313769 | −2 | 1038 |
| P2.orf0292 | | conserved hypothetical protein | 317076 | 314899 | −1 | 2178 |
| P2.orf0293 | | acyl-CoA dehydrogenase domain-containing protein | 318311 | 317280 | −3 | 1032 |
| P2.orf0294 | IVD1 | acyl-CoA dehydrogenase domain protein | 319462 | 318308 | −2 | 1155 |
| P2.orf0295 | iclR | Transcriptional regulator kdgR | 319747 | 320523 | 1 | 777 |
| P2.orf0296 | paaF | putative enoyl-CoA hydratase | 320572 | 321369 | 1 | 798 |
| P2.orf0297 | | transcriptional regulator | 321550 | 321849 | 1 | 300 |
| P2.orf0298 | | plasmid stabilization system protein | 321846 | 322172 | 3 | 327 |
| P2.orf0299 | lmrB | Lincomycin resistance protein | 323465 | 322224 | −3 | 1242 |
| P2.orf0300 | | hypothetical protein | 326989 | 323492 | −2 | 3498 |
| P2.orf0301 | alsS | acetolactate synthase | 327307 | 328953 | 1 | 1647 |
| P2.orf0302 | rfbU | glycosyl transferase group 1 | 330096 | 329038 | −1 | 1059 |
| P2.orf0303 | divJ | histidine kinase response regulator hybrid protein | 331511 | 330273 | −3 | 1239 |
| P2.orf0304 | | hypothetical protein | 332022 | 331756 | −1 | 267 |
| P2.orf0305 | | hypothetical protein | 331765 | 331646 | −2 | 120 |
| P2.orf0306 | polC | polymerase epsilon subunit | 333137 | 332193 | −3 | 945 |
| P2.orf0307 | | conserved hypothetical protein | 334008 | 333151 | −1 | 858 |
| P2.orf0308 | | putative iron reductase | 334199 | 334945 | 2 | 747 |
| P2.orf0309 | | RNA polymerase ECF-subfamily sigma-70 factor | 334903 | 335475 | 1 | 573 |
| P2.orf0310 | fecR | transmembrane sensor | 335636 | 336613 | 2 | 978 |
| P2.orf0311 | | acetyl transferase | 336764 | 337423 | 2 | 660 |
| P2.orf0312 | aatB | aspartate aminotransferase | 338676 | 337426 | −1 | 1251 |
| P2.orf0313 | | NAD-dependent aldehyde dehydrogenase | 340317 | 338788 | −1 | 1530 |
| P2.orf0314 | gcvA | transcriptional regulator | 341860 | 342789 | 1 | 930 |
| P2.orf0315 | | conserved hypothetical protein | 341730 | 340687 | −1 | 1044 |
| P2.orf0316 | | SpoOM family protein | 343262 | 343699 | 2 | 438 |
| P2.orf0317 | pcaI | 3-oxoacid CoA-transferase, A subunit | 343828 | 344538 | 1 | 711 |
| P2.orf0318 | | hypothetical protein | 343269 | 343153 | −1 | 117 |

| Locus | Gene | Product | Start | End | Strand | Length |
|---|---|---|---|---|---|---|
| P2.orf0319 | pcaJ | 3-oxoadipate CoA-transferase | 344535 | 345218 | 3 | 684 |
| P2.orf0320 | mbtH | MbtH-like protein | 345567 | 345812 | 3 | 246 |
| P2.orf0321 | | putative SyrP-like regulatory protein | 346227 | 346856 | 3 | 630 |
| P2.orf0322 | | putative non-ribosomal peptide synthetase | 346919 | 348349 | 2 | 1431 |
| P2.orf0323 | lgrC | amino acid adenylation domain protein | 348429 | 367838 | 3 | 19410 |
| P2.orf0324 | lgrC | PvdI | 367789 | 369903 | 1 | 2115 |
| P2.orf0325 | lgrD | GRC_BREPA RecName: Full = Linear gramicidin synthase subunit C; Includes: RecName: Full = ATP-dependent valine adenylase; Short = ValA; AltName: Full = Valine activase; Includes: RecName: Full = ATP-dependent D-valine adenylase; Short = D-ValA; AltName: Full = D-valine | 369900 | 381584 | 3 | 11685 |
| P2.orf0326 | iucB | putative acetylase | 381581 | 382612 | 2 | 1032 |
| P2.orf0327 | pvdA | L-ornithine 5-monooxygenase | 382609 | 383940 | 1 | 1332 |
| P2.orf0328 | fhuF | ferric iron reductase protein | 383944 | 384714 | 1 | 771 |
| P2.orf0329 | | hypothetical protein | 384753 | 385127 | 3 | 375 |
| P2.orf0330 | pvdQ | acyl-homoserine lactone acylase | 385517 | 387064 | 2 | 1548 |
| P2.orf0331 | fct | ferrichrome-iron transporter | 387288 | 389717 | 3 | 2430 |
| P2.orf0332 | fhuC | ABC transporter related protein | 389797 | 390591 | 1 | 795 |
| P2.orf0333 | fhuD | periplasmic binding protein | 390613 | 391512 | 1 | 900 |
| P2.orf0334 | fhuB | iron-hydroxamate transporter permease subunit | 391509 | 393557 | 3 | 2049 |
| P2.orf0335 | | pyoverdine ABC export system, permease/ATP-binding protein | 393612 | 395282 | 3 | 1671 |
| P2.orf0336 | | nitrile hydratase-like protein | 395682 | 395365 | −1 | 318 |
| P2.orf0337 | | conserved hypothetical protein | 396044 | 395733 | −3 | 312 |
| P2.orf0338 | | nitrile hydratase | 396434 | 396105 | −3 | 330 |
| P2.orf0339 | | conserved hypothetical protein | 396919 | 396644 | −2 | 276 |
| P2.orf0340 | | glutathione-dependent formaldehyde-activating GFA | 397372 | 397764 | 1 | 393 |
| P2.orf0341 | aceE | Pyruvate dehydrogenase (acetyl-transferring) | 400219 | 397808 | −2 | 2412 |
| P2.orf0342 | | transcriptional regulator | 400360 | 400839 | 1 | 480 |
| P2.orf0343 | | conserved hypothetical protein | 402074 | 401058 | −3 | 1017 |
| P2.orf0344 | pstB | high-affinity phosphate ABC transporter ATP-binding protein | 403461 | 402658 | −1 | 804 |
| P2.orf0345 | pstA | phosphate ABC transporter permease protein | 404321 | 403458 | −3 | 864 |
| P2.orf0346 | pstC | phosphate ABC transporter, inner membrane subunit PstC | 405346 | 404336 | −2 | 1011 |
| P2.orf0347 | pstS | phosphate ABC transporter, periplasmic phosphate-binding protein | 406436 | 405432 | −3 | 1005 |
| P2.orf0348 | PEPM | phosphoenolpyruvate phosphomutase | 407744 | 406830 | −3 | 915 |
| P2.orf0349 | aspC | aminotransferase class I and II | 408984 | 407782 | −1 | 1203 |
| P2.orf0350 | | ABC superfamily ATP binding cassette transporter, binding protein | 410075 | 409077 | −3 | 999 |
| P2.orf0351 | fbpB | inner membrane component of ABC transporter | 411775 | 410132 | −2 | 1644 |
| P2.orf0352 | potA | ABC transporter related protein | 412855 | 411779 | −2 | 1077 |
| P2.orf0353 | trpI | transcriptional regulator, LysR family | 413003 | 413887 | 2 | 885 |
| P2.orf0354 | | class II aldolase/adducin family protein | 414043 | 414819 | 1 | 777 |
| P2.orf0355 | yusQ | 4-oxalocrotonate tautomerase | 415302 | 414910 | −1 | 393 |
| P2.orf0356 | pecT | LysR family transcriptional regulator | 415370 | 416272 | 2 | 903 |
| P2.orf0357 | fecR | putative FecR | 417310 | 416303 | −2 | 1008 |
| P2.orf0358 | fecI | RNA polymerase sigma-70 family protein | 417962 | 417426 | −3 | 537 |
| P2.orf0359 | | Sphingosine kinase and enzymes related to eukaryotic diacylglycerol kinase | 419046 | 418102 | −1 | 945 |
| P2.orf0360 | | conserved hypothetical protein | 421188 | 419365 | −1 | 1824 |
| P2.orf0361 | | acyl-CoA dehydrogenase domain protein | 421331 | 422548 | 2 | 1218 |
| P2.orf0362 | | Putative HPr kinase/phosphorylase | 422644 | 423597 | 1 | 954 |
| P2.orf0363 | siaT | TRAP-T family protein transporter, DctM (12 TMs) subunit | 424975 | 423671 | −2 | 1305 |
| P2.orf0364 | | conserved hypothetical protein | 425520 | 424972 | −1 | 549 |
| P2.orf0365 | | Bacterial extracellular solute-binding protein, family 7 | 426771 | 425599 | −1 | 1173 |
| P2.orf0366 | lcfB | AMP-dependent synthetase and ligase | 428473 | 426866 | −2 | 1608 |
| P2.orf0367 | paaG | enoyl-CoA hydratase/isomerase family protein | 429389 | 428544 | −3 | 846 |
| P2.orf0368 | | acyl-CoA dehydrogenase-like | 430563 | 429403 | −1 | 1161 |
| P2.orf0369 | yurK | GntR family transcriptional regulator | 430895 | 431545 | 2 | 651 |
| P2.orf0370 | pleC | two-component hybrid sensor and regulator | 431729 | 433306 | 2 | 1578 |
| P2.orf0371 | degU | transcriptional regulator | 433932 | 433294 | −1 | 639 |
| P2.orf0372 | ugpC | lactose transport ATP-binding protein LacK | 434169 | 435335 | 3 | 1167 |
| P2.orf0373 | yurN | binding-protein-dependent transport systems inner membrane component | 435328 | 436269 | 1 | 942 |
| P2.orf0374 | yesQ | binding-protein-dependent transport systems inner membrane component | 436266 | 437108 | 3 | 843 |
| P2.orf0375 | | sugar binding protein of ABC transporter | 437160 | 438434 | 3 | 1275 |
| P2.orf0376 | icc | conserved hypothetical protein | 438434 | 439282 | 2 | 849 |

-continued

| Locus | Gene | Product | Start | End | Strand | Length |
|---|---|---|---|---|---|---|
| P2.orf0377 | | conserved hypothetical protein | 439858 | 439541 | −2 | 318 |
| P2.orf0378 | | conserved hypothetical protein | 441210 | 439870 | −1 | 1341 |
| P2.orf0379 | dppD | ABC transporter ATP-binding protein | 442939 | 441290 | −2 | 1650 |
| P2.orf0380 | | inner membrane component of binding-protein-dependent transport system | 443801 | 442944 | −3 | 858 |
| P2.orf0381 | | inner membrane component of binding-protein-dependent transport system | 444744 | 443806 | −1 | 939 |
| P2.orf0382 | | extracellular solute-binding protein | 446347 | 444758 | −2 | 1590 |
| P2.orf0383 | ybhD | HTH-type transcriptional regulator | 446504 | 447463 | 2 | 960 |
| P2.orf0384 | acyI | gamma-glutamyltranspeptidase | 447601 | 449319 | 1 | 1719 |
| P2.orf0385 | | putative amidotransferase | 449371 | 450792 | 1 | 1422 |
| P2.orf0386 | | arylmalonate decarboxylase | 451589 | 450840 | −3 | 750 |
| P2.orf0387 | citE | HpcH/HpaI aldolase | 451750 | 452613 | 1 | 864 |
| P2.orf0388 | maoC | MaoC-like dehydratase | 452668 | 453186 | 1 | 519 |
| P2.orf0389 | | conserved hypothetical protein | 453403 | 453849 | 1 | 447 |
| P2.orf0390 | | hypothetical protein | 453982 | 454575 | 1 | 594 |
| P2.orf0391 | | acyl-CoA dehydrogenase domain protein | 455977 | 454583 | −2 | 1395 |
| P2.orf0392 | yajO | aldo/keto reductase | 456051 | 457085 | 3 | 1035 |
| P2.orf0393 | | GNAT family acetyltransferase | 457600 | 457082 | −2 | 519 |
| P2.orf0394 | | nitrile hydratase beta-like protein | 458132 | 457743 | −3 | 390 |
| P2.orf0395 | nthA | alpha subunit of nitrile hydratase | 458767 | 458156 | −2 | 612 |
| P2.orf0396 | | nitrile hydratase beta subunit | 459468 | 458782 | −1 | 687 |
| P2.orf0397 | | conserved hypothetical protein | 460174 | 459506 | −2 | 669 |
| P2.orf0398 | amiC | amino acid ABC transporter | 460454 | 461557 | 2 | 1104 |
| P2.orf0399 | | MarR family transcriptional regulator | 461618 | 462076 | 2 | 459 |
| P2.orf0400 | | conserved hypothetical protein | 462391 | 462104 | −2 | 288 |
| P2.orf0401 | acrR | TetR family transcriptional regulator | 463014 | 462388 | −1 | 627 |
| P2.orf0402 | | Phytoene dehydrogenase and related protein | 464630 | 463011 | −3 | 1620 |
| P2.orf0403 | | aldehyde dehydrogenase | 464849 | 466288 | 2 | 1440 |
| P2.orf0404 | | Amidase | 467917 | 466403 | −2 | 1515 |
| P2.orf0405 | livF | ABC superfamily ATP binding cassette transporter, ABC protein | 468812 | 468099 | −3 | 714 |
| P2.orf0406 | braF | urea or short-chain amide ABC transporter | 469557 | 468814 | −1 | 744 |
| P2.orf0407 | | urea or short-chain amide ABC transporter | 470626 | 469559 | −2 | 1068 |
| P2.orf0408 | livH | urea or short-chain amide ABC transporter | 471496 | 470630 | −2 | 867 |
| P2.orf0409 | amiC | putative Leu/Ile/Val/Thr/Ala-binding protein | 472766 | 471513 | −3 | 1254 |
| P2.orf0410 | amiC | ABC transporter substrate-binding protein | 474013 | 472976 | −2 | 1038 |
| P2.orf0411 | yhbI | transcriptional regulatory protein | 474233 | 474652 | 2 | 420 |
| P2.orf0412 | | gamma-aminobutyraldehyde dehydrogenase | 476115 | 474658 | −1 | 1458 |
| P2.orf0413 | yybE | putative LysR-family regulatory protein | 477038 | 476112 | −3 | 927 |
| P2.orf0414 | puuC | aldehyde dehydrogenase protein | 478605 | 477100 | −1 | 1506 |
| P2.orf0415 | | conserved hypothetical protein | 478912 | 478616 | −2 | 297 |
| P2.orf0416 | adh | alcohol dehydrogenase protein | 479205 | 480242 | 3 | 1038 |
| P2.orf0417 | sdpR | ArsR family transcriptional regulator | 480297 | 480611 | 3 | 315 |
| P2.orf0418 | | conserved hypothetical protein | 480608 | 480940 | 2 | 333 |
| P2.orf0419 | | ATP-dependent Clp protease proteolytic subunit | 480987 | 481583 | 3 | 597 |
| P2.orf0420 | yddV | diguanylate cyclase | 481691 | 483121 | 2 | 1431 |
| P2.orf0421 | gabD | Aldehyde dehydrogenase (NAD(+)) | 483197 | 484633 | 2 | 1437 |
| P2.orf0422 | bphR | transcriptional regulator protein | 485453 | 484707 | −3 | 747 |
| P2.orf0423 | siaT | TRAP dicarboxylate transporter, DctQ subunit | 485577 | 486194 | 3 | 618 |
| P2.orf0424 | yiaN | TRAP transporter, DctM subunit subfamily | 486191 | 487462 | 2 | 1272 |
| P2.orf0425 | | putative hydroxlacyl-CoA dehydrogenase | 487462 | 488415 | 1 | 954 |
| P2.orf0426 | | trap dicarboxylate transporter- dctp subunit | 488412 | 488996 | 3 | 585 |
| P2.orf0427 | | trap dicarboxylate transporter- dctp subunit | 489025 | 489384 | 1 | 360 |
| P2.orf0428 | catA | oxidoreductase protein | 489463 | 490338 | 1 | 876 |
| P2.orf0429 | bphC | glyoxalase/bleomycin resistance protein/dioxygenase | 490335 | 491192 | 3 | 858 |
| P2.orf0430 | | decarboxylase protein | 491197 | 491901 | 1 | 705 |
| P2.orf0431 | dmpC | 2-hydroxymuconic semialdehyde dehydrogenase | 491907 | 493361 | 3 | 1455 |
| P2.orf0432 | hpcG | 2-oxo-hepta-3-ene-1,7-dioic acid hydratase | 493381 | 494163 | 1 | 783 |
| P2.orf0433 | hpcH | HpcH/HpaI aldolase | 494173 | 494940 | 1 | 768 |
| P2.orf0434 | | enoyl-CoA hydratase/isomerase family protein | 495939 | 496742 | 3 | 804 |
| P2.orf0435 | | phenylacetic acid degradation operon negative regulatory protein | 495806 | 495021 | −3 | 786 |
| P2.orf0436 | menE | feruloyl-CoA synthetase | 496838 | 498403 | 2 | 1566 |
| P2.orf0437 | bphR | GntR family transcriptional regulator | 499406 | 498528 | −3 | 879 |
| P2.orf0438 | | gentisate 1,2-dioxygenase | 499618 | 500733 | 1 | 1116 |
| P2.orf0439 | | 5-carboxymethyl-2-hydroxymuconate Delta-isomerase | 500863 | 501768 | 1 | 906 |
| P2.orf0440 | | extracellular ligand-binding receptor | 501956 | 503143 | 2 | 1188 |
| P2.orf0441 | braD | ABC superfamily ATP binding cassette transporter, membrane protein | 503251 | 504168 | 1 | 918 |
| P2.orf0442 | livM | ABC superfamily ATP binding cassette transporter, permease protein | 504180 | 505202 | 3 | 1023 |
| P2.orf0443 | braF | ABC transporter related protein | 505195 | 505962 | 1 | 768 |

-continued

| Locus | Gene | Product | Start | End | Strand | Length |
|---|---|---|---|---|---|---|
| P2.orf0444 | livF | branched-chain amino acid ABC superfamily ATP binding cassette transporter, ABC protein | 505962 | 506657 | 3 | 696 |
| P2.orf0445 | NIT4 | nitrilase | 506670 | 507617 | 3 | 948 |
| P2.orf0446 | | conserved hypothetical protein | 507630 | 508274 | 3 | 645 |
| P2.orf0447 | | putative esterase/lipase | 508271 | 509167 | 2 | 897 |
| P2.orf0448 | | hypothetical protein | 509275 | 509907 | 1 | 633 |
| P2.orf0449 | | transcriptional activator FtrB | 510630 | 509926 | −1 | 705 |
| P2.orf0450 | narK | nitrite transporter | 510877 | 513570 | 1 | 2694 |
| P2.orf0451 | narG | nitrate reductase, alpha subunit | 513598 | 517338 | 1 | 3741 |
| P2.orf0452 | narY | nitrate reductase, beta subunit | 517335 | 518873 | 3 | 1539 |
| P2.orf0453 | narJ | nitrate reductase molybdenum cofactor assembly chaperone | 518878 | 519603 | 1 | 726 |
| P2.orf0454 | narI | respiratory nitrate reductase, gamma subunit | 519603 | 520349 | 3 | 747 |
| P2.orf0455 | nifM | PpiC-type peptidyl-prolyl cis-trans isomerase | 520362 | 521252 | 3 | 891 |
| P2.orf0456 | | Hemerythrin HHE cation binding domain subfamily | 521300 | 521854 | 2 | 555 |
| P2.orf0457 | moeA | molybdopterin biosynthesis protein | 521851 | 523119 | 1 | 1269 |
| P2.orf0458 | | molybdenum ABC transporter ATP-binding protein | 523116 | 523604 | 3 | 489 |
| P2.orf0459 | moaA | molybdenum cofactor biosynthesis protein A | 523641 | 524687 | 3 | 1047 |
| P2.orf0460 | mog | molybdopterin binding domain protein | 524716 | 525222 | 1 | 507 |
| P2.orf0461 | | NnrS family protein | 525243 | 526451 | 3 | 1209 |
| P2.orf0462 | | Cellulose synthesis regulatory protein | 526976 | 526461 | −3 | 516 |
| P2.orf0463 | | diguanylate cyclase | 527952 | 526945 | −1 | 1008 |
| P2.orf0464 | aapP | General L-amino acid transport ATP-binding protein | 528809 | 528063 | −3 | 747 |
| P2.orf0465 | yhdY | amino acid ABC transporter permease | 531132 | 528817 | −1 | 2316 |
| P2.orf0466 | aapJ | general L-amino acid transport system substrate-binding protein | 532175 | 531132 | −3 | 1044 |
| P2.orf0467 | dapA | dihydrodipicolinate synthase | 533301 | 532393 | −1 | 909 |
| P2.orf0468 | yibF | glutathione S-transferase | 534025 | 533423 | −2 | 603 |
| P2.orf0469 | dadA | D-amino-acid dehydrogenase | 535329 | 534022 | −1 | 1308 |
| P2.orf0470 | ordL | Glycine/D-amino acid oxidase | 536660 | 535332 | −3 | 1329 |
| P2.orf0471 | nocR | transcriptional regulator, LysR family | 537755 | 536838 | −3 | 918 |
| P2.orf0472 | amiC | urea ABC transporter, urea binding protein | 537992 | 539263 | 2 | 1272 |
| P2.orf0473 | braD | urea ABC transporter, permease protein UrtB | 539469 | 540398 | 3 | 930 |
| P2.orf0474 | | urea ABC transporter, permease protein UrtC | 540403 | 541587 | 1 | 1185 |
| P2.orf0475 | braF | urea ABC transporter, ATP-binding protein UrtD | 541602 | 542384 | 3 | 783 |
| P2.orf0476 | livF | putative ABC transporter ATP-binding component | 542458 | 543147 | 1 | 690 |
| P2.orf0477 | fmdA | formamidase | 543426 | 544661 | 3 | 1236 |
| P2.orf0478 | fmdB | FmdB family regulatory protein | 544730 | 545059 | 2 | 330 |
| P2.orf0479 | | conserved hypothetical protein | 545144 | 545584 | 2 | 441 |
| P2.orf0480 | | conserved hypothetical protein | 545695 | 546876 | 1 | 1182 |
| P2.orf0481 | | conserved hypothetical protein | 546881 | 548323 | 2 | 1443 |
| P2.orf0482 | | conserved hypothetical protein | 548442 | 549665 | 3 | 1224 |
| P2.orf0483 | | ABC transporter related protein | 549662 | 551452 | 2 | 1791 |
| P2.orf0484 | | transcriptional regulator, MarR family | 551531 | 552130 | 2 | 600 |
| P2.orf0485 | dipZ | thiol-disulfide isomerase and thioredoxins | 552180 | 552671 | 3 | 492 |
| P2.orf0486 | suhR | Patatin | 554481 | 552685 | −1 | 1797 |
| P2.orf0487 | gcvA | transcriptional regulator | 555545 | 554538 | −3 | 1008 |
| P2.orf0488 | | glyoxalase/bleomycin resistance protein/dioxygenase superfamily protein | 555678 | 556124 | 3 | 447 |
| P2.orf0489 | cya | calcium binding hemolysin protein | 556302 | 558818 | 3 | 2517 |
| P2.orf0490 | yodM | phosphoesterase PA-phosphatase related protein | 559494 | 558808 | −1 | 687 |
| P2.orf0491 | dppC | binding-protein-dependent transport systems inner membrane component | 560476 | 559592 | −2 | 885 |
| P2.orf0492 | | putative oligopeptide ABC transporter (permease) | 561429 | 560476 | −1 | 954 |
| P2.orf0493 | gsiB | extracellular solute-binding protein family 5 | 563119 | 561512 | −2 | 1608 |
| P2.orf0494 | ykfD | oligopeptide/dipeptide ABC transporter, ATP-binding protein-like | 564228 | 563212 | −1 | 1017 |
| P2.orf0495 | | oligopeptide/dipeptide ABC transporter, ATP-binding protein-like | 565220 | 564225 | −3 | 996 |
| P2.orf0496 | caiC | AMP-dependent synthetase and ligase | 566971 | 565217 | −2 | 1755 |
| P2.orf0497 | | conserved hypothetical protein | 567938 | 567177 | −3 | 762 |
| P2.orf0498 | | B3/4 domain protein | 568082 | 568798 | 2 | 717 |
| P2.orf0499 | | hypothetical protein | 569114 | 569269 | 2 | 156 |
| P2.orf0500 | | conserved hypothetical protein | 569625 | 569290 | −1 | 336 |
| P2.orf0501 | | hypothetical protein | 569983 | 569669 | −2 | 315 |
| P2.orf0502 | | phytanoyl-CoA dioxygenase (PhyH) family protein | 570940 | 570065 | −2 | 876 |
| P2.orf0503 | oruR | AraC family transcriptional regulator | 571040 | 572080 | 2 | 1041 |
| P2.orf0504 | glpR | glycerol-3-phosphate regulon repressor | 572197 | 572976 | 1 | 780 |
| P2.orf0505 | mhpD | fumarylacetoacetate (FAA) hydrolase | 573801 | 572995 | −1 | 807 |

| Locus | Gene | Product | Start | End | Strand | Length |
|---|---|---|---|---|---|---|
| P2.orf0506 | opdE | major facilitator transporter | 575026 | 573917 | −2 | 1110 |
| P2.orf0507 | | major facilitator superfamily MFS_1 | 575433 | 575083 | −1 | 351 |
| P2.orf0508 | | regulatory protein | 575710 | 576603 | 1 | 894 |
| P2.orf0509 | | transcriptional regulator | 577116 | 576613 | −1 | 504 |
| P2.orf0510 | | short chain dehydrogenase/reductase family oxidoreductase | 577227 | 577991 | 3 | 765 |
| P2.orf0511 | | 2-hydroxychromene-2-carboxylate isomerase | 578006 | 578614 | 2 | 609 |
| P2.orf0512 | | conserved hypothetical protein | 578810 | 578622 | −3 | 189 |
| P2.orf0513 | | AraC family transcriptional regulator | 579873 | 578893 | −1 | 981 |
| P2.orf0514 | | conserved hypothetical protein | 580238 | 579909 | −3 | 330 |
| P2.orf0515 | dke1 | acetylacetone-cleaving enzyme | 580708 | 580235 | −2 | 474 |
| P2.orf0516 | Glo1 | Lactoylglutathione lyase | 580954 | 581478 | 1 | 525 |
| P2.orf0517 | | GntR family transcriptional regulator | 581586 | 582263 | 3 | 678 |
| P2.orf0518 | coaA | pantothenate kinase | 582287 | 583222 | 2 | 936 |
| P2.orf0519 | alkJ | GMC family oxidoreductase | 583334 | 584968 | 2 | 1635 |
| P2.orf0520 | | LysR family transcriptional regulator | 585483 | 584983 | −1 | 501 |
| P2.orf0521 | yhaJ | LysR family transcriptional regulator | 585890 | 585480 | −3 | 411 |
| P2.orf0522 | | TrpR binding protein WrbA | 585995 | 586621 | 2 | 627 |
| P2.orf0523 | | TPR domain-containing protein | 588934 | 587846 | −2 | 1089 |
| P2.orf0524 | caiC | AMP-dependent synthetase and ligase | 590679 | 589033 | −1 | 1647 |
| P2.orf0525 | | putative monooxygenase | 592736 | 590775 | −3 | 1962 |
| P2.orf0526 | | Beta-lactamase | 593031 | 594248 | 3 | 1218 |
| P2.orf0527 | | TRAP-T family transporter, DctP (periplasmic binding) subunit | 594350 | 595498 | 2 | 1149 |
| P2.orf0528 | | TRAP-T family transporter, DctQ (4 TMs) subunit | 595572 | 596105 | 3 | 534 |
| P2.orf0529 | siaT | TRAP-T family transporter, DctM (12 TMs) subunit | 596102 | 597409 | 2 | 1308 |
| P2.orf0530 | | regulatory protein, TetR | 597461 | 598171 | 2 | 711 |
| P2.orf0531 | | putative transcriptional regulators | 598216 | 598461 | 1 | 246 |
| P2.orf0532 | ybiO | mscS family protein ybiO | 600759 | 598477 | −1 | 2283 |
| P2.orf0533 | | Beta-lactamase | 600931 | 602205 | 1 | 1275 |
| P2.orf0534 | | putative Peroxiredoxin | 602334 | 602972 | 3 | 639 |
| P2.orf0535 | | conserved hypothetical protein | 603028 | 603453 | 1 | 426 |
| P2.orf0536 | | conserved hypothetical protein | 603785 | 603438 | −3 | 348 |
| P2.orf0537 | rob | putative transcriptional regulator protein, AraC family | 604467 | 605375 | 3 | 909 |
| P2.orf0538 | yebQ | major facilitator superfamily MFS_1 | 606706 | 605393 | −2 | 1314 |
| P2.orf0539 | glxA | AraC family transcriptional regulator | 608808 | 607756 | −1 | 1053 |
| P2.orf0540 | soxB | sarcosine oxidase beta subunit family protein | 608908 | 610161 | 1 | 1254 |
| P2.orf0541 | soxD | sarcosine oxidase delta subunit family protein | 610172 | 610471 | 2 | 300 |
| P2.orf0542 | soxA | sarcosine oxidase alpha subunit family protein | 610468 | 613470 | 1 | 3003 |
| P2.orf0543 | soxG | sarcosine oxidase, gamma subunit | 613489 | 614040 | 1 | 552 |
| P2.orf0544 | | hypothetical protein | 614270 | 614079 | −3 | 192 |
| P2.orf0545 | | conserved hypothetical protein | 614962 | 614510 | −2 | 453 |
| P2.orf0546 | leuD | 3-isopropylmalate dehydratase, small subunit | 615722 | 615069 | −3 | 654 |
| P2.orf0547 | leuC | adenosylcobinamide kinase/adenosylcobinamide-phosphate guanylyltransferase | 617121 | 615727 | −1 | 1395 |
| P2.orf0548 | | L-carnitine dehydratase/bile acid-inducible protein F | 618356 | 617118 | −3 | 1239 |
| P2.orf0549 | GCDH | glutaryl-CoA dehydrogenase | 619608 | 618421 | −1 | 1188 |
| P2.orf0550 | | isochorismatase hydrolase | 620279 | 619656 | −3 | 624 |
| P2.orf0551 | hyuA | hydantoin utilization protein A | 622363 | 620231 | −2 | 2133 |
| P2.orf0552 | | 5-oxoprolinase (ATP-hydrolyzing) | 624071 | 622392 | −3 | 1680 |
| P2.orf0553 | yvoA | GntR family transcriptional regulator | 625002 | 624157 | −1 | 846 |
| P2.orf0554 | | Conserved hypothetical protein | 626913 | 625399 | −1 | 1515 |
| P2.orf0555 | | conserved hypothetical protein | 628844 | 627255 | −3 | 1590 |
| P2.orf0556 | | glyoxalase/bleomycin resistance protein/dioxygenase | 629129 | 629605 | 2 | 477 |
| P2.orf0557 | sdpR | ArsR family transcriptional regulator | 629602 | 629943 | 1 | 342 |
| P2.orf0558 | | activator of HSP90 ATPase 1 family protein | 629940 | 630437 | 3 | 498 |
| P2.orf0559 | uhpA | LuxR family transcriptional regulator | 630987 | 630421 | −1 | 567 |
| P2.orf0560 | | acetyl-CoA acetyltransferase | 631151 | 632326 | 2 | 1176 |
| P2.orf0561 | menE | putative long-chain-fatty-acid CoA ligase | 632336 | 633874 | 2 | 1539 |
| P2.orf0562 | hutC | transcriptional regulator, GntR family | 634557 | 633829 | −1 | 729 |
| P2.orf0563 | | conserved hypothetical protein | 634942 | 634649 | −2 | 294 |
| P2.orf0564 | cda1 | polysaccharide deacetylase | 635146 | 636012 | 1 | 867 |
| P2.orf0565 | | TRAP transporter, transmembrane protein | 636092 | 636685 | 2 | 594 |
| P2.orf0566 | | Putative TRAP transporter large permease protein | 636682 | 637965 | 1 | 1284 |
| P2.orf0567 | yiaO | putative exported protein (TRAP-type transport system, periplasmic component) | 638073 | 639077 | 3 | 1005 |
| P2.orf0568 | IRG1 | MmgE/PrpD | 639094 | 640503 | 1 | 1410 |
| P2.orf0569 | mmgC | acyl-CoA dehydrogenase | 640689 | 641858 | 3 | 1170 |
| P2.orf0570 | | L-carnitine dehydratase/bile acid-inducible protein F | 641855 | 643117 | 2 | 1263 |

-continued

| Locus | Gene | Product | Start | End | Strand | Length |
|---|---|---|---|---|---|---|
| P2.orf0571 | yfdE | L-carnitine dehydratase/bile acid-inducible protein F | 643436 | 644209 | 2 | 774 |
| P2.orf0572 | pilJ | putative methyl accepting chemotaxis protein | 644419 | 646494 | 1 | 2076 |
| P2.orf0573 | | conserved hypothetical protein | 647362 | 646472 | −2 | 891 |
| P2.orf0574 | | peptide deformylase | 647567 | 648151 | 2 | 585 |
| P2.orf0575 | | short chain dehydrogenase | 649016 | 648183 | −3 | 834 |
| P2.orf0576 | ycaN | LysR family transcriptional regulator | 649114 | 650016 | 1 | 903 |
| P2.orf0577 | ycfQ | TetR family transcriptional regulator | 650709 | 650032 | −1 | 678 |
| P2.orf0578 | yjgI | short-chain dehydrogenase/reductase SDR | 650818 | 651558 | 1 | 741 |
| P2.orf0579 | | hypothetical protein | 652126 | 652260 | 1 | 135 |
| P2.orf0580 | | putative Ketopantoate reductase PanE/ApbA | 652662 | 652390 | −1 | 273 |
| P2.orf0581 | leuA | 2-isopropylmalate synthase | 654186 | 652687 | −1 | 1500 |
| P2.orf0582 | | hypothetical protein | 654661 | 654545 | −2 | 117 |
| P2.orf0583 | | conserved hypothetical protein | 655211 | 654687 | −3 | 525 |
| P2.orf0584 | pleC | Sensor protein | 655466 | 656701 | 2 | 1236 |
| P2.orf0585 | | conserved hypothetical protein | 657778 | 656801 | −2 | 978 |
| P2.orf0586 | | sporulation initiation inhibitor protein Soj | 658949 | 659989 | 2 | 1041 |
| P2.orf0587 | | chromosome partitioning protein ParB | 659989 | 660891 | 1 | 903 |
| P2.orf0588 | | GCN5-related N-acetyltransferase | 661556 | 661014 | −3 | 543 |
| P2.orf0589 | padR | transcriptional regulator | 662176 | 662706 | 1 | 531 |
| P2.orf0590 | | conserved hypothetical protein | 663239 | 662793 | −3 | 447 |
| P2.orf0591 | fadH | NADH: flavin oxidoreductase/NADH oxidase | 665393 | 663282 | −3 | 2112 |
| P2.orf0592 | | triacylglycerol lipase superfamily protein | 666816 | 665485 | −1 | 1332 |
| P2.orf0593 | glxA | AraC family transcription regulator | 667905 | 666955 | −1 | 951 |
| P2.orf0594 | | conserved hypothetical protein | 668034 | 668333 | 3 | 300 |
| P2.orf0595 | | conserved hypothetical protein | 668330 | 668737 | 2 | 408 |
| P2.orf0596 | yfiR | regulatory protein TetR | 669425 | 668724 | −3 | 702 |
| P2.orf0597 | | putative acyltransferase | 669523 | 670626 | 1 | 1104 |
| P2.orf0598 | | putative outer membrane autotransporter barrel | 672954 | 670636 | −1 | 2319 |
| P2.orf0599 | | hypothetical protein | 687767 | 686256 | −3 | 1512 |
| P2.orf0600 | | Invasion protein B homolog | 688435 | 687865 | −1 | 570 |
| P2.orf0601 | | universal stress protein UspA | 689603 | 688716 | −3 | 888 |
| P2.orf0602 | | conserved hypothetical protein | 689981 | 689637 | −3 | 345 |
| P3.orf0001 | istA | Integrase, catalytic region | 1 | 1509 | 1 | 1509 |
| P3.orf0002 | istB | IstB domain protein ATP-binding protein | 1496 | 2287 | 2 | 792 |
| P3.orf0003 | | CzcC family heavy metal RND efflux outer membrane protein | 3597 | 2500 | −1 | 1098 |
| P3.orf0004 | | transposase, IS4 family protein | 4330 | 4806 | 1 | 477 |
| P3.orf0005 | alsR | regulatory protein BphR | 7279 | 6389 | −2 | 891 |
| P3.orf0006 | copK | Copper resistance protein K | 7696 | 7511 | −2 | 186 |
| P3.orf0007 | copD | putative copper resistance D transmembrane protein | 8850 | 7924 | −1 | 927 |
| P3.orf0008 | copC | copper resistance protein CopC | 9241 | 8855 | −2 | 387 |
| P3.orf0009 | silP | heavy metal translocating P-type ATPase | 11634 | 9382 | −1 | 2253 |
| P3.orf0010 | | conserved hypothetical protein | 12523 | 12227 | −2 | 297 |
| P3.orf0011 | copB | copper resistance protein B | 13520 | 12750 | −3 | 771 |
| P3.orf0012 | pcoA | CopA family copper resistance protein | 15354 | 13756 | −1 | 1599 |
| P3.orf0013 | cusR | two component response regulator | 15899 | 16603 | 2 | 705 |
| P3.orf0014 | cusS | sensor histidine kinase | 16857 | 18011 | 3 | 1155 |
| P3.orf0015 | | ArsR family transcriptional regulator | 18941 | 19288 | 2 | 348 |
| P3.orf0016 | yqcK | lactoylglutathione lyase | 19302 | 19772 | 3 | 471 |
| P3.orf0017 | arsC | arsenate reductase | 19785 | 20282 | 3 | 498 |
| P3.orf0018 | | putative sodium bile acid symporter family protein | 20293 | 21378 | 1 | 1086 |
| P3.orf0019 | arsC | arsenate reductase | 21393 | 21815 | 3 | 423 |
| P3.orf0020 | ywzG | transcriptional regulator, PadR family | 21914 | 22216 | 2 | 303 |
| P3.orf0021 | | chromate transporter | 22213 | 23442 | 1 | 1230 |
| P3.orf0022 | yhbS | acetyltransferase, gnat family | 23448 | 23978 | 3 | 531 |
| P3.orf0023 | yubM | ParB domain protein nuclease | 25667 | 24186 | −3 | 1482 |
| P3.orf0024 | bepE | transporter, HAE1 family | 26377 | 25976 | −2 | 402 |
| P3.orf0025 | bepF | multidrug efflux RND transporter, membrane fusion protein MexE | 27438 | 26470 | −1 | 969 |
| P3.orf0026 | | relaxase | 29882 | 27960 | −3 | 1923 |
| P3.orf0027 | | conserved hypothetical protein | 30123 | 30749 | 3 | 627 |
| P3.orf0028 | | RES domain superfamily | 30762 | 31394 | 3 | 633 |
| P3.orf0029 | | conserved hypothetical protein | 31479 | 31844 | 3 | 366 |
| P3.orf0030 | | conserved hypothetical protein | 33376 | 31856 | −2 | 1521 |
| P3.orf0031 | | conserved hypothetical protein | 33749 | 33390 | −3 | 360 |
| P3.orf0032 | | conserved hypothetical protein | 35140 | 33746 | −2 | 1395 |
| P3.orf0033 | | conserved hypothetical protein | 36100 | 35150 | −2 | 951 |
| P3.orf0034 | | conserved hypothetical protein | 36489 | 36097 | −1 | 393 |
| P3.orf0035 | | DNA repair protein RadC | 37202 | 36708 | −3 | 495 |
| P3.orf0036 | | dsba oxidoreductase | 37806 | 37378 | −1 | 429 |
| P3.orf0037 | | conserved hypothetical protein | 41061 | 38170 | −1 | 2892 |
| P3.orf0038 | | conserved hypothetical protein | 41510 | 41061 | −3 | 450 |
| P3.orf0039 | | conserved hypothetical protein | 42909 | 41491 | −1 | 1419 |

-continued

| Locus | Gene | Product | Start | End | Strand | Length |
|---|---|---|---|---|---|---|
| P3.orf0040 | | putative secreted protein | 43810 | 42899 | −2 | 912 |
| P3.orf0041 | | putative secreted protein | 44499 | 43807 | −1 | 693 |
| P3.orf0042 | | conserved hypothetical protein | 44894 | 44496 | −3 | 399 |
| P3.orf0043 | | conserved hypothetical protein | 45265 | 44906 | −2 | 360 |
| P3.orf0044 | | conserved hypothetical protein | 45515 | 45282 | −3 | 234 |
| P3.orf0045 | | plasmid conserved hypothetical protein, RAQPRD family | 45895 | 45512 | −2 | 384 |
| P3.orf0046 | | excisionase/Xis, DNA-binding | 46099 | 46569 | 1 | 471 |
| P3.orf0047 | | conserved hypothetical protein | 46638 | 47141 | 3 | 504 |
| P3.orf0048 | | AAA ATPase, central region | 47159 | 48073 | 2 | 915 |
| P3.orf0049 | | conserved hypothetical protein | 48537 | 49037 | 3 | 501 |
| P3.orf0050 | | conserved hypothetical protein | 49037 | 49939 | 2 | 903 |
| P3.orf0051 | | F440523_63 hypothetical protein | 50110 | 50703 | 1 | 594 |
| P3.orf0052 | | conserved hypothetical protein | 50770 | 53337 | 1 | 2568 |
| P3.orf0053 | | conserved hypothetical protein | 54127 | 53378 | −2 | 750 |
| P3.orf0054 | | conserved hypothetical protein | 56190 | 54124 | −1 | 2067 |
| P3.orf0055 | | conserved hypothetical protein | 56638 | 56321 | −2 | 318 |
| P3.orf0056 | | lytic transglycosylase, catalytic | 57435 | 56866 | −1 | 570 |
| P3.orf0057 | | conserved hypothetical protein | 58175 | 57438 | −3 | 738 |
| P3.orf0058 | | conserved hypothetical protein | 58832 | 58188 | −3 | 645 |
| P3.orf0059 | | conserved hypothetical protein | 59428 | 58829 | −2 | 600 |
| P3.orf0060 | JBP2 | helicase-like protein | 61846 | 59567 | −2 | 2280 |
| P3.orf0061 | | conserved hypothetical protein | 62288 | 61983 | −3 | 306 |
| P3.orf0062 | | conserved hypothetical protein | 62698 | 62378 | −2 | 321 |
| P3.orf0063 | | conserved hypothetical protein | 63858 | 62749 | −1 | 1110 |
| P3.orf0064 | | conserved hypothetical protein | 64570 | 63923 | −2 | 648 |
| P3.orf0065 | | conserved hypothetical protein | 64907 | 64647 | −3 | 261 |
| P3.orf0066 | | conserved hypothetical protein | 65331 | 64924 | −1 | 408 |
| P3.orf0067 | | conserved hypothetical protein | 66560 | 65871 | −3 | 690 |
| P3.orf0068 | yubP | conserved hypothetical protein | 67482 | 66655 | −1 | 828 |
| P3.orf0069 | | conserved hypothetical protein | 68533 | 67628 | −2 | 906 |
| P3.orf0070 | | conserved hypothetical protein | 69128 | 68844 | −3 | 285 |
| P3.orf0071 | | conserved hypothetical protein | 69696 | 69436 | −1 | 261 |
| P3.orf0072 | tnpA | Transposase Tn3 | 70407 | 69766 | −1 | 642 |
| P3.orf0073 | merA | mercuric reductase | 72470 | 70782 | −3 | 1689 |
| P3.orf0074 | merP | mercuric transport protein periplasmic protein | 72786 | 72481 | −1 | 306 |
| P3.orf0075 | merT | putative mercuric transport protein | 73149 | 72799 | −1 | 351 |
| P3.orf0076 | merR | MerR family transcriptional regulator | 73221 | 73628 | 3 | 408 |
| P3.orf0077 | | conserved hypothetical protein | 74714 | 73890 | −3 | 825 |
| P3.orf0078 | | conserved hypothetical protein | 75281 | 75003 | −3 | 279 |
| P3.orf0079 | | conserved hypothetical protein | 76115 | 75378 | −3 | 738 |
| P3.orf0080 | | conserved hypothetical protein | 76721 | 76329 | −3 | 393 |
| P3.orf0081 | | conserved hypothetical protein | 77461 | 77294 | −2 | 168 |
| P3.orf0082 | lspA | signal peptidase II | 78322 | 77942 | −2 | 381 |
| P3.orf0083 | cadA | heavy metal translocating P-type ATPase | 81247 | 78446 | −2 | 2802 |
| P3.orf0084 | zntR | MerR family transcriptional regulator | 81450 | 81848 | 3 | 399 |
| P3.orf0085 | | sterol desaturase-like protein | 82512 | 82303 | −1 | 210 |
| P3.orf0086 | | cation efflux protein | 82924 | 83559 | 1 | 636 |
| P3.orf0087 | topB | DNA topoisomerase III | 86313 | 84283 | −1 | 2031 |
| P3.orf0088 | ssb | single-stranded DNA-binding protein | 87037 | 86597 | −2 | 441 |
| P3.orf0089 | | conserved hypothetical protein | 87638 | 87111 | −3 | 528 |
| P3.orf0090 | | conserved hypothetical protein | 88426 | 87635 | −2 | 792 |
| P3.orf0091 | | conserved hypothetical protein | 89902 | 88856 | −2 | 1047 |
| P3.orf0092 | | conserved hypothetical protein | 90658 | 90098 | −2 | 561 |
| P3.orf0093 | | conserved hypothetical protein | 92352 | 90673 | −1 | 1680 |
| P3.orf0094 | | conserved hypothetical protein | 92614 | 92345 | −2 | 270 |
| P3.orf0095 | | cobyrinic acid a,c-diamide synthase | 93473 | 92598 | −3 | 876 |
| P3.orf0096 | | phage-related protein | 93728 | 93516 | −3 | 213 |
| P3.orf0097 | | conserved hypothetical protein | 94593 | 93847 | −1 | 747 |
| P3.orf0098 | | conserved hypothetical protein | 95428 | 95544 | 1 | 117 |
| P3.orf0099 | | hypothetical protein | 95955 | 96197 | 3 | 243 |
| P3.orf0100 | iap | Alkaline phosphatase isozyme conversion protein | 98224 | 96218 | −2 | 2007 |
| P3.orf0101 | | Pyridoxamine 5′-phosphate oxidase-like, FMN-binding | 99403 | 98414 | −2 | 990 |
| P3.orf0102 | trpB | tryptophan synthase subunit beta | 100406 | 100089 | −3 | 318 |
| P3.orf0103 | trpB | tryptophan synthase, beta subunit | 101314 | 100406 | −2 | 909 |
| P3.orf0104 | | conserved hypothetical protein | 102640 | 101558 | −2 | 1083 |
| P3.orf0105 | | conserved hypothetical protein | 103201 | 102659 | −2 | 543 |
| P3.orf0106 | rpoD | RNA polymerase sigma factor | 105716 | 103623 | −3 | 2094 |
| P3.orf0107 | dnaG | DNA primase | 107778 | 105883 | −1 | 1896 |
| P3.orf0108 | | GatB/Yqey domain superfamily | 108256 | 107789 | −2 | 468 |
| P3.orf0109 | carA | carbamoyl-phosphate synthase small chain | 108790 | 109962 | 1 | 1173 |
| P3.orf0110 | carB | Carbamoylphosphate synthase large subunit | 109955 | 113200 | 2 | 3246 |
| P3.orf0111 | greA | transcription elongation factor GreA | 113454 | 113912 | 3 | 459 |
| P3.orf0112 | | conserved hypothetical protein | 115711 | 113996 | −2 | 1716 |
| P3.orf0113 | abrB | membrane protein AbrB duplication | 116368 | 115796 | −2 | 573 |

-continued

| Locus | Gene | Product | Start | End | Strand | Length |
|---|---|---|---|---|---|---|
| P3.orf0114 | lrp | transcriptional regulator | 117507 | 117001 | −1 | 507 |
| P3.orf0115 | | nucleoside-diphosphate-sugar epimerase | 117815 | 118876 | 2 | 1062 |
| P3.orf0116 | trxB | thioredoxin reductase (NADPH) | 118974 | 119945 | 3 | 972 |
| P3.orf0117 | yafC | redox-sensitive transcriptional activator | 120106 | 120996 | 1 | 891 |
| P3.orf0118 | | diguanylate cyclase | 121882 | 121061 | −2 | 822 |
| P3.orf0119 | | conserved hypothetical protein | 122308 | 121898 | −2 | 411 |
| P3.orf0120 | | conserved hypothetical protein | 122847 | 122305 | −1 | 543 |
| P3.orf0121 | | Serine phosphatase RsbU, regulator of sigma subunit | 124565 | 122895 | −3 | 1671 |
| P3.orf0122 | | amino acid ABC transporter periplasmic protein | 125412 | 124600 | −1 | 813 |
| P3.orf0123 | yedY | Sulfoxide reductase catalytic subunit yedY | 127668 | 126661 | −1 | 1008 |
| P3.orf0124 | aatA | aspartate aminotransferase | 129076 | 127874 | −2 | 1203 |
| P3.orf0125 | uvrB | excinuclease ABC subunit B | 129371 | 131581 | 2 | 2211 |
| P3.orf0126 | mdtA | RND family efflux transporter MFP subunit | 131809 | 132912 | 1 | 1104 |
| P3.orf0127 | | AcrB/AcrD/AcrF family protein | 132944 | 136144 | 2 | 3201 |
| P3.orf0128 | fabG | 3-oxoacyl-[acyl-carrier-protein] reductase | 136284 | 137027 | 3 | 744 |
| P3.orf0129 | folB | dihydroneopterin aldolase family protein | 137128 | 137535 | 1 | 408 |
| P3.orf0130 | uvrC | Nuclease subunit of the excinuclease complex | 137920 | 140361 | 1 | 2442 |
| P3.orf0131 | pgsA | Phosphatidylglycerophosphate synthase | 140437 | 140988 | 1 | 552 |
| P3.orf0132 | moaE | molybdenum cofactor biosynthesis protein E | 141003 | 141761 | 3 | 759 |
| P3.orf0133 | | Calcium-binding EF-hand protein | 141891 | 142391 | 3 | 501 |
| P3.orf0134 | sigW | RNA polymerase sigma factor | 142388 | 142996 | 2 | 609 |
| P3.orf0135 | | conserved hypothetical protein | 142996 | 143559 | 1 | 564 |
| P3.orf0136 | | conserved hypothetical protein | 143556 | 143957 | 3 | 402 |
| P3.orf0137 | azoB | NmrA family protein | 144927 | 144049 | −1 | 879 |
| P3.orf0138 | yybR | transcriptional regulator | 145036 | 145386 | 1 | 351 |
| P3.orf0139 | ilvE | branched-chain amino acid aminotransferase | 146392 | 145484 | −2 | 909 |
| P3.orf0140 | petP | transcriptional regulator, MarR family | 146478 | 146960 | 3 | 483 |
| P3.orf0141 | petR | Response regulator receiver: Transcriptional regulatory protein, C-terminal | 147017 | 147763 | 2 | 747 |
| P3.orf0142 | envZ | Signal transduction histidine kinase | 147784 | 149145 | 1 | 1362 |
| P3.orf0143 | | hypothetical protein | 149529 | 149149 | −1 | 381 |
| P3.orf0144 | yhcK | diguanylate cyclase | 150423 | 149653 | −1 | 771 |
| P3.orf0145 | csaA | chaperonin csaA | 150861 | 150505 | −1 | 357 |
| P3.orf0146 | | magnetic particle membrane specific GTPase P16 | 151425 | 151000 | −1 | 426 |
| P3.orf0147 | | conserved hypothetical protein | 152319 | 151645 | −1 | 675 |
| P3.orf0148 | rpoH | RNA polymerase factor sigma-32 | 152518 | 153435 | 1 | 918 |
| P3.orf0149 | yuxG | oxidoreductase yuxG | 155553 | 153502 | −1 | 2052 |
| P3.orf0150 | mtnA | Initiation factor 2B related | 156703 | 155603 | −2 | 1101 |
| P3.orf0151 | mtnP | Purine phosphorylase, family 2 | 157654 | 156734 | −2 | 921 |
| P3.orf0152 | | Cytochrome c1, heme protein precursor | 158759 | 157995 | −3 | 765 |
| P3.orf0153 | petB | Cytochrome b/b6-like protein | 159988 | 158759 | −2 | 1230 |
| P3.orf0154 | petA | ubiquinol-cytochrome c reductase, iron-sulfur subunit | 160561 | 160016 | −2 | 546 |
| P3.orf0155 | yibK | putative aminotransferase/methyltransferase | 161030 | 161545 | 2 | 516 |
| P3.orf0156 | hemF | coproporphyrinogen III oxidase | 161542 | 162483 | 1 | 942 |
| P3.orf0157 | | hypothetical protein | 162813 | 162550 | −1 | 264 |
| P3.orf0158 | | major facilitator transporter | 163774 | 162830 | −2 | 945 |
| P3.orf0159 | | hypothetical protein | 163909 | 164841 | 1 | 933 |
| P3.orf0160 | | polynucleotide adenylyltransferase region | 166208 | 164859 | −3 | 1350 |
| P3.orf0161 | | hypothetical protein | 166528 | 166259 | −2 | 270 |
| P3.orf0162 | nudL | NUDIX hydrolase | 167248 | 166538 | −2 | 711 |
| P3.orf0163 | | conserved hypothetical protein | 167916 | 167245 | −1 | 672 |
| P3.orf0164 | nudF | MutT/nudix family protein | 168572 | 167877 | −3 | 696 |
| P3.orf0165 | aidB | putative acyl-CoA dehydrogenase | 170347 | 168665 | −2 | 1683 |
| P3.orf0166 | | Transcriptional regulator | 171179 | 170394 | −3 | 786 |
| P3.orf0167 | | hypothetical protein | 171425 | 171742 | 2 | 318 |
| P3.orf0168 | | conserved hypothetical protein | 171819 | 172907 | 3 | 1089 |
| P3.orf0169 | | YcaO-like family | 173005 | 174360 | 1 | 1356 |
| P3.orf0170 | | Putative nitroreductase | 174395 | 175204 | 2 | 810 |
| P3.orf0171 | | hypothetical protein | 175281 | 177491 | 3 | 2211 |
| P3.orf0172 | | conserved hypothetical protein | 177491 | 177958 | 2 | 468 |
| P3.orf0173 | ywmD | von Willebrand factor type A | 179423 | 178047 | −3 | 1377 |
| P3.orf0174 | | transcriptional regulator, LuxR family/hydrolase, alpha/beta fold family | 181216 | 179585 | −2 | 1632 |
| P3.orf0175 | yeeA | Putative DNA methyltransferase yeeA | 183092 | 185971 | 2 | 2880 |
| P3.orf0176 | | LuxR family transcriptional regulator | 187094 | 186264 | −3 | 831 |
| P3.orf0177 | | SpoVT/AbrB domain-containing protein | 187255 | 187404 | 1 | 150 |
| P3.orf0178 | ispE | 4-diphosphocytidyl-2C-methyl-D-erythritol kinase | 188600 | 187665 | −3 | 936 |
| P3.orf0179 | | TPR repeat-containing protein | 190357 | 188618 | −2 | 1740 |
| P3.orf0180 | | conserved hypothetical protein | 190896 | 191087 | 3 | 192 |
| P3.orf0181 | | hypothetical protein | 193001 | 191250 | −3 | 1752 |
| P3.orf0182 | | hypothetical protein | 193258 | 193461 | 1 | 204 |
| P3.orf0183 | | peptidase M24 | 195602 | 193539 | −3 | 2064 |

| Locus | Gene | Product | Start | End | Strand | Length |
|---|---|---|---|---|---|---|
| P3.orf0184 | prmA | ribosomal protein L11 methylase | 196575 | 195634 | −1 | 942 |
| P3.orf0185 | uvrD | UvrD/REP helicase domain protein | 198952 | 196559 | −2 | 2394 |
| P3.orf0186 | | conserved hypothetical protein | 200143 | 199112 | −2 | 1032 |
| P3.orf0187 | asnO | Asparagine synthase (glutamine-hydrolyzing) | 202308 | 200392 | −1 | 1917 |
| P3.orf0188 | yeaM | pyridoxamine 5′-phosphate oxidase-related protein | 203165 | 202365 | −3 | 801 |
| P3.orf0189 | | pyridoxamine 5′-phosphate oxidase-related FMN-binding | 203259 | 203870 | 3 | 612 |
| P3.orf0190 | | conserved hypothetical protein | 203949 | 204098 | 3 | 150 |
| P3.orf0191 | yfkN | 5′-nucleotidase | 205696 | 204164 | −2 | 1533 |
| P3.orf0192 | | pentapeptide repeat-containing protein | 206223 | 205687 | −1 | 537 |
| P3.orf0193 | | D-lactate dehydrogenase | 206420 | 207871 | 2 | 1452 |
| P3.orf0194 | ssuA | Putative aliphatic sulfonates-binding protein | 208092 | 209174 | 3 | 1083 |
| P3.orf0195 | | ABC transporter ATP-binding protein | 209185 | 209952 | 1 | 768 |
| P3.orf0196 | tauC | binding-protein-dependent transport systems inner membrane component | 209945 | 210766 | 2 | 822 |
| P3.orf0197 | zntB | Mg2+ transporter protein, CorA-like | 210794 | 211834 | 2 | 1041 |
| P3.orf0198 | | transcriptional regulator, GntR family with aminotransferase domain | 214073 | 212691 | −3 | 1383 |
| P3.orf0199 | | conserved hypothetical protein | 214491 | 214973 | 3 | 483 |
| P3.orf0200 | nitA | putative amidohydrolase | 215030 | 216106 | 2 | 1077 |
| P3.orf0201 | | Radical SAM domain protein | 216189 | 217202 | 3 | 1014 |
| P3.orf0202 | | putative histone acetyltransferase | 217199 | 217756 | 2 | 558 |
| P3.orf0203 | | selenophosphate synthetase-related protein | 217753 | 218772 | 1 | 1020 |
| P3.orf0204 | | glycosyl transferase group 1 | 218769 | 219959 | 3 | 1191 |
| P3.orf0205 | | conserved hypothetical protein | 219956 | 220243 | 2 | 288 |
| P3.orf0206 | | putative flavoprotein involved in K+ transport | 220249 | 221529 | 1 | 1281 |
| P3.orf0207 | | conserved hypothetical protein | 221858 | 221541 | −3 | 318 |
| P3.orf0208 | | putative oxidoreductase protein | 222622 | 221873 | −2 | 750 |
| P3.orf0209 | ycaN | transcriptional regulator, LysR family | 223647 | 222733 | −1 | 915 |
| P3.orf0210 | | enoyl-CoA hydratase | 223743 | 224489 | 3 | 747 |
| P3.orf0211 | Hadh | 3-hydroxyacyl-CoA dehydrogenase | 224636 | 225592 | 2 | 957 |
| P3.orf0212 | ybfI | transcriptional activator | 226298 | 226915 | 2 | 618 |
| P3.orf0213 | pamO | steroid monooxygenase | 227173 | 228822 | 1 | 1650 |
| P3.orf0214 | metX | esterase | 228849 | 229904 | 3 | 1056 |
| P3.orf0215 | | conserved hypothetical protein | 230906 | 230031 | −3 | 876 |
| P3.orf0216 | | TetR family transcriptional regulator | 231603 | 230980 | −1 | 624 |
| P3.orf0217 | ybhR | multidrug ABC transporter permease component | 232801 | 231680 | −2 | 1122 |
| P3.orf0218 | ybhS | multidrug ABC transporter permease component | 233368 | 232805 | −2 | 564 |
| P3.orf0219 | ybhS | putative ABC transporter permease protein | 233931 | 233365 | −1 | 567 |
| P3.orf0220 | ybhF | ABC transporter related protein | 235682 | 233928 | −3 | 1755 |
| P3.orf0221 | | membrane protein | 236706 | 235687 | −1 | 1020 |
| P3.orf0222 | ybiH | TetR family transcriptional regulator | 237326 | 236703 | −3 | 624 |
| P3.orf0223 | | conserved hypothetical protein | 238615 | 237500 | −2 | 1116 |
| P3.orf0224 | paaA | phenylacetic acid degradation protein (similar to paaA) | 239551 | 238799 | −2 | 753 |
| P3.orf0225 | | hypothetical protein | 240236 | 239757 | −3 | 480 |
| P3.orf0226 | | Radical SAM domain protein | 241498 | 240233 | −2 | 1266 |
| P3.orf0227 | hcaE | Rieske (2Fe—2S) domain-containing protein | 242879 | 241698 | −3 | 1182 |
| P3.orf0228 | | thioesterase superfamily protein | 243659 | 243189 | −3 | 471 |
| P3.orf0229 | ydeM | MaoC-like dehydratase | 244141 | 243656 | −2 | 486 |
| P3.orf0230 | ligA | NAD-dependent DNA ligase | 246344 | 244233 | −3 | 2112 |
| P3.orf0231 | recN | DNA repair protein RecN | 248114 | 246438 | −3 | 1677 |
| P3.orf0232 | | DNA uptake lipoprotein | 249069 | 248191 | −1 | 879 |
| P3.orf0233 | | DNA-binding protein | 249926 | 250372 | 2 | 447 |
| P3.orf0234 | lpxC | UDP-3-O-[3-hydroxymyristoyl] N-acetylglucosamine deacetylase | 251433 | 250468 | −1 | 966 |
| P3.orf0235 | ftsZ | cell division protein FtsZ | 253351 | 251786 | −2 | 1566 |
| P3.orf0236 | ftsA | F492457_3 cell division protein FtsA | 254667 | 253432 | −1 | 1236 |
| P3.orf0237 | ftsQ | Cell division protein FtsQ | 255726 | 254782 | −1 | 945 |
| P3.orf0238 | ddl | D-alanine-D--alanine ligase | 256628 | 255714 | −3 | 915 |
| P3.orf0239 | murB | UDP-N-acetylenolpyruvoylglucosamine reductase | 257635 | 256625 | −2 | 1011 |
| P3.orf0240 | murC | UDP-N-acetylmuramate--L-alanine ligase | 259059 | 257635 | −1 | 1425 |
| P3.orf0241 | murG | UDP-N-acetylglucosamine-N-acetylmuramyl-(pentapeptide) pyrophosphoryl-undecaprenol N-acetylglucosamine transferase | 260279 | 259056 | −3 | 1224 |
| P3.orf0242 | ftsW | putative cell division protein ftsW | 261397 | 260276 | −2 | 1122 |
| P3.orf0243 | murD | UDP-N-acetylmuramoyl-L-alanyl-D-glutamate synthetase | 262860 | 261394 | −1 | 1467 |
| P3.orf0244 | mraY | Glycosyl transferase, family 4 | 263966 | 262878 | −3 | 1089 |
| P3.orf0245 | murF | UDP-N-acetylmuramoyl-tripeptide--D-alanyl-D-alanine ligase subfamily | 265477 | 264020 | −2 | 1458 |
| P3.orf0246 | murE | UDP-N-acetylmuramoylalanyl-D-glutamate--2,6-diaminopimelate ligase | 266946 | 265474 | −1 | 1473 |

-continued

| Locus | Gene | Product | Start | End | Strand | Length |
|---|---|---|---|---|---|---|
| P3.orf0247 | penA | peptidoglycan synthetase FtsI | 268828 | 266933 | −2 | 1896 |
| P3.orf0248 | | periplasmic protein | 269292 | 268825 | −1 | 468 |
| P3.orf0249 | mraW | S-adenosyl-methyltransferase mraW | 270293 | 269289 | −3 | 1005 |
| P3.orf0250 | mraZ | cell division protein MraZ | 270811 | 270290 | −2 | 522 |
| P3.orf0251 | ampD | negative regulator of AmpC, AmpD | 272679 | 271888 | −1 | 792 |
| P3.orf0252 | eamA | integral membrane protein | 273634 | 272702 | −2 | 933 |
| P3.orf0253 | hfaC | ABC transporter related protein | 275499 | 273631 | −1 | 1869 |
| P3.orf0254 | | curculin domain-containing protein | 276723 | 275686 | −1 | 1038 |
| P3.orf0255 | djlA | DnaJ-like protein DjlA | 277594 | 276848 | −2 | 747 |
| P3.orf0256 | | bacterial extracellular solute-binding protein, family 7 | 277977 | 278957 | 3 | 981 |
| P3.orf0257 | | tripartite ATP-independent periplasmic transporter, DctQ component | 279099 | 279656 | 3 | 558 |
| P3.orf0258 | | TRAP dicarboxylate transporter, DctM subunit | 279676 | 280986 | 1 | 1311 |
| P3.orf0259 | OXP1 | 5-oxoprolinase (ATP-hydrolyzing) | 281063 | 284704 | 2 | 3642 |
| P3.orf0260 | | conserved hypothetical protein | 284715 | 285302 | 3 | 588 |
| P3.orf0261 | | conserved hypothetical protein | 285447 | 285947 | 3 | 501 |
| P3.orf0262 | | conserved hypothetical protein | 285944 | 287074 | 2 | 1131 |
| P3.orf0263 | | conserved hypothetical protein | 287088 | 287303 | 3 | 216 |
| P3.orf0264 | yneJ | putative transcriptional regulator protein, LysR family | 287445 | 288308 | 3 | 864 |
| P3.orf0265 | | putative transmembrane protein | 288326 | 289105 | 2 | 780 |
| P3.orf0266 | | pyruvate, phosphate dikinase | 289409 | 291367 | 2 | 1959 |
| P3.orf0267 | ydcN | XRE family transcriptional regulator | 292040 | 291459 | −3 | 582 |
| P3.orf0268 | | Gluconate 2-dehydrogenase subunit 3 | 292191 | 292955 | 3 | 765 |
| P3.orf0269 | | Gluconate 2-dehydrogenase (acceptor) | 293016 | 294779 | 3 | 1764 |
| P3.orf0270 | | diheme cytochrome c SoxE | 294776 | 295147 | 2 | 372 |
| P3.orf0271 | ykpB | Ketopantoate reductase | 295209 | 296135 | 3 | 927 |
| P3.orf0272 | ydeK | transporter ydeK | 296132 | 296998 | 2 | 867 |
| P3.orf0273 | hxlR | transcriptional regulator | 297307 | 297005 | −2 | 303 |
| P3.orf0274 | gstB | glutathione S-transferase | 297503 | 298117 | 2 | 615 |
| P3.orf0275 | | conserved hypothetical protein | 298114 | 298491 | 1 | 378 |
| P3.orf0276 | | 4-oxalocrotonate tautomerase family protein | 298504 | 298710 | 1 | 207 |
| P3.orf0277 | thcD | FAD-dependent pyridine nucleotide-disulphide oxidoreductase | 300150 | 298870 | −1 | 1281 |
| P3.orf0278 | hrb | rubredoxin reductase | 300460 | 300251 | −2 | 210 |
| P3.orf0279 | | conserved hypothetical protein | 301498 | 300509 | −2 | 990 |
| P3.orf0280 | glyA | glycine hydroxymethyltransferase | 303294 | 302002 | −1 | 1293 |
| P3.orf0281 | yfeJ | glutamine amidotransferase class-I | 304426 | 303725 | −2 | 702 |
| P3.orf0282 | ptsJ | GntR family transcriptional regulator | 304715 | 306028 | 2 | 1314 |
| P3.orf0283 | | cupin 2 domain-containing protein | 306617 | 306231 | −3 | 387 |
| P3.orf0284 | yedZ | Ferric reductase domain protein protein transmembrane component domain protein | 306862 | 307848 | 1 | 987 |
| P3.orf0285 | ydeR | Major facilitator superfamily MFS_1 | 308978 | 307812 | −3 | 1167 |
| P3.orf0286 | ycaN | LysR family transcriptional regulator | 310241 | 311167 | 2 | 927 |
| P3.orf0287 | yajO | aldo/keto reductase | 310081 | 309035 | −2 | 1047 |
| P3.orf0288 | menE | citrate synthase | 311990 | 313657 | 2 | 1668 |
| P3.orf0289 | | putative glutathione S-transferase-related protein | 313654 | 314640 | 1 | 987 |
| P3.orf0290 | | short-chain dehydrogenase/reductase SDR | 314637 | 315410 | 3 | 774 |
| P3.orf0291 | creA | CreA family protein | 315498 | 315989 | 3 | 492 |
| P3.orf0292 | | LemA family protein | 316110 | 316691 | 3 | 582 |
| P3.orf0293 | htpX | HtpX-2 peptidase | 316696 | 317859 | 1 | 1164 |
| P3.orf0294 | virR | conserved hypothetical protein | 318375 | 317875 | −1 | 501 |
| P3.orf0295 | fixR | short-chain dehydrogenase | 318540 | 319295 | 3 | 756 |
| P3.orf0296 | | hypothetical protein | 320005 | 320121 | 1 | 117 |
| P3.orf0297 | yjfL | inner membrane protein YjfL | 320245 | 320667 | 1 | 423 |
| P3.orf0298 | | conserved hypothetical protein | 320745 | 321326 | 3 | 582 |
| P3.orf0299 | ygiC | glutathionylspermidine synthase | 321341 | 322552 | 2 | 1212 |
| P3.orf0300 | | conserved hypothetical protein | 323212 | 322577 | −2 | 636 |
| P3.orf0301 | cqsS | CAI-1 autoinducer sensor kinase/phosphatase cqsS | 324242 | 323349 | −3 | 894 |
| P3.orf0302 | pleC | response regulator receiver sensor signal transduction histidine kinase | 325762 | 324248 | −2 | 1515 |
| P3.orf0303 | iorA | indolepyruvate ferredoxin oxidoreductase, alpha subunit | 329497 | 325985 | −2 | 3513 |
| P3.orf0304 | | putative TetR family protein receptor protein | 330225 | 329839 | −1 | 387 |
| P3.orf0305 | | conserved hypothetical protein | 330266 | 330535 | 2 | 270 |
| P3.orf0306 | | conserved hypothetical protein | 330489 | 330956 | 3 | 468 |
| P3.orf0307 | zraR | two component, sigma54 specific, Fis family transcriptional regulator | 332800 | 331025 | −2 | 1776 |
| P3.orf0308 | yjbG | Oligoendopeptidase F homolog | 332996 | 334807 | 2 | 1812 |
| P3.orf0309 | | aarF domain-containing kinase | 334862 | 336265 | 2 | 1404 |
| P3.orf0310 | | hypothetical protein | 336546 | 337256 | 3 | 711 |
| P3.orf0311 | | diguanylate cyclase/phosphodiesterase | 339938 | 337284 | −3 | 2655 |
| P3.orf0312 | hipO | amidohydrolase | 341077 | 339941 | −2 | 1137 |
| P3.orf0313 | | hypothetical protein | 341375 | 341542 | 2 | 168 |

-continued

| Locus | Gene | Product | Start | End | Strand | Length |
|---|---|---|---|---|---|---|
| P3.orf0314 | ilvG | thiamine pyrophosphate protein central region | 341626 | 343383 | 1 | 1758 |
| P3.orf0315 | | conserved hypothetical protein | 343422 | 345497 | 3 | 2076 |
| P3.orf0316 | | conserved hypothetical protein | 345494 | 347092 | 2 | 1599 |
| P3.orf0317 | | conserved hypothetical protein | 347500 | 347114 | −2 | 387 |
| P3.orf0318 | | conserved hypothetical protein | 347766 | 347518 | −1 | 249 |
| P3.orf0319 | ttuD | hydroxypyruvate reductase | 349150 | 347876 | −2 | 1275 |
| P3.orf0320 | | Creatininase | 349350 | 350093 | 3 | 744 |
| P3.orf0321 | | N-formylglutamate amidohydrolase | 350106 | 350867 | 3 | 762 |
| P3.orf0322 | | conserved hypothetical protein | 350920 | 351222 | 1 | 303 |
| P3.orf0323 | ytcJ | amidohydrolase 3 | 353140 | 351260 | −2 | 1881 |
| P3.orf0324 | | conserved hypothetical protein | 353483 | 353193 | −3 | 291 |
| P3.orf0325 | ybfI | transcriptional regulator, AraC family | 353634 | 354530 | 3 | 897 |
| P3.orf0326 | | conserved hypothetical protein | 354659 | 354910 | 2 | 252 |
| P3.orf0327 | | conserved hypothetical protein | 355041 | 355385 | 3 | 345 |
| P3.orf0328 | | hypothetical protein | 355851 | 355375 | −1 | 477 |
| P3.orf0329 | | conserved hypothetical protein | 356637 | 355870 | −1 | 768 |
| P3.orf0330 | | conserved hypothetical protein | 357494 | 356634 | −3 | 861 |
| P3.orf0331 | | conserved hypothetical protein | 357888 | 357541 | −1 | 348 |
| P3.orf0332 | cqsA | CAI-1 autoinducer synthase | 358328 | 359608 | 2 | 1281 |
| P3.orf0333 | SRY1 | Threo-3-hydroxyaspartate ammonia-lyase | 360652 | 359672 | −2 | 981 |
| P3.orf0334 | ydfD | transcriptional regulator, GntR family with aminotransferase domain | 360821 | 362302 | 2 | 1482 |
| P3.orf0335 | | L-lactate permease | 362445 | 364148 | 3 | 1704 |
| P3.orf0336 | | transcriptional regulator | 364222 | 364560 | 1 | 339 |
| P3.orf0337 | arsB | arsenical-resistance protein | 364569 | 365630 | 3 | 1062 |
| P3.orf0338 | | NADPH-dependent FMN reductase | 365627 | 366391 | 2 | 765 |
| P3.orf0339 | ggt | gamma-glutamyltranspeptidase | 366507 | 368312 | 3 | 1806 |
| P3.orf0340 | | epoxide hydrolase protein | 368348 | 369241 | 2 | 894 |
| P3.orf0341 | | AraC family transcriptional regulator | 369241 | 370308 | 1 | 1068 |
| P3.orf0342 | | putative regulator PrlF | 370305 | 370499 | 3 | 195 |
| P3.orf0343 | | conserved hypothetical protein | 371729 | 370581 | −3 | 1149 |
| P3.orf0344 | | conserved hypothetical protein | 372148 | 371726 | −2 | 423 |
| P3.orf0345 | | conserved hypothetical protein | 372478 | 373455 | 1 | 978 |
| P3.orf0346 | ddpA | ABC transporter substrate-binding protein | 373624 | 375249 | 1 | 1626 |
| P3.orf0347 | dppB | ABC transporter permease protein 2 | 375326 | 376348 | 2 | 1023 |
| P3.orf0348 | ddpC | ABC transporter permease protein 1 | 376345 | 377193 | 1 | 849 |
| P3.orf0349 | gsiA | ABC transporter ATP-binding protein | 377190 | 378911 | 3 | 1722 |
| P3.orf0350 | mcbR | Transcriptional Regulator, GntR family protein | 378980 | 379708 | 2 | 729 |
| P3.orf0351 | | aminotransferase class-III | 379990 | 381345 | 1 | 1356 |
| P3.orf0352 | | hydantoin utilization protein | 381360 | 383396 | 3 | 2037 |
| P3.orf0353 | | putative N-methylhydantoinase B | 383401 | 385014 | 1 | 1614 |
| P3.orf0354 | ygaY | major facilitator transporter | 386318 | 385119 | −3 | 1200 |
| P3.orf0355 | | HxlR family transcriptional regulator | 386421 | 386861 | 3 | 441 |
| P3.orf0356 | | GntR family transcriptional regulator | 387573 | 386902 | −1 | 672 |
| P3.orf0357 | bcpA | isocitrate lyase and phosphorylmutase | 387704 | 388567 | 2 | 864 |
| P3.orf0358 | | isopropylmalate isomerase large subunit | 388564 | 389985 | 1 | 1422 |
| P3.orf0359 | leuD | isopropylmalate isomerase small subunit | 389985 | 390620 | 3 | 636 |
| P3.orf0360 | yraM | conserved hypothetical protein | 390701 | 391888 | 2 | 1188 |
| P3.orf0361 | dctP | c4-dicarboxylate-binding periplasmic protein | 391939 | 392961 | 1 | 1023 |
| P3.orf0362 | | TRAP-type C4-dicarboxylate transport system small permease | 392966 | 393532 | 2 | 567 |
| P3.orf0363 | | C4-dicarboxylate TRAP-T family tripartite ATP-independent periplasmic transporter, membrane protein, large subunit | 393529 | 394812 | 1 | 1284 |
| P3.orf0364 | citH | proline/glycine betaine transporter, Major facilitator superfamily | 394995 | 396287 | 3 | 1293 |
| P3.orf0365 | mqsR | Motility quorum-sensing regulator mqsR | 396479 | 396775 | 2 | 297 |
| P3.orf0366 | ygiT | transcriptional regulator, XRE family | 396777 | 397178 | 3 | 402 |
| P3.orf0367 | | hypothetical protein | 397787 | 398224 | 2 | 438 |
| P3.orf0368 | lcfA | long-chain-fatty-acid--CoA ligase | 400068 | 398320 | −1 | 1749 |
| P3.orf0369 | ygfF | short-chain dehydrogenase/reductase SDR | 400154 | 400912 | 2 | 759 |
| P3.orf0370 | bioC | methyltransferase | 400934 | 401659 | 2 | 726 |
| P3.orf0371 | | F377340_3 AraC | 402662 | 401670 | −3 | 993 |
| P3.orf0372 | | dienelactone hydrolase family protein | 402712 | 403524 | 1 | 813 |
| P3.orf0373 | | conserved hypothetical protein | 403624 | 404664 | 1 | 1041 |
| P3.orf0374 | pleC | sensory transduction histidine kinase | 406997 | 404673 | −3 | 2325 |
| P3.orf0375 | dht | dihydropyrimidinase | 408628 | 407168 | −2 | 1461 |
| P3.orf0376 | pucI | cytosine/purines, uracil, thiamine, allantoin transporter | 410219 | 408690 | −3 | 1530 |
| P3.orf0377 | yeiA | dihydroorotate dehydrogenase family protein | 411740 | 410436 | −3 | 1305 |
| P3.orf0378 | yeiT | putative oxidoreductase | 413141 | 411768 | −3 | 1374 |
| P3.orf0379 | hyuC | amidase, hydantoinase/carbamoylase family | 414563 | 413307 | −3 | 1257 |
| P3.orf0380 | mmsA | methylmalonate-semialdehyde dehydrogenase | 416162 | 414663 | −3 | 1500 |
| P3.orf0381 | rutR | transcriptional regulator, TetR family protein | 416868 | 417575 | 3 | 708 |
| P3.orf0382 | suhB | putative inositol monophosphatase | 417572 | 418438 | 2 | 867 |
| P3.orf0383 | | CRISPR-associated protein Cas2 | 418894 | 418604 | −2 | 291 |
| P3.orf0384 | | conserved hypothetical protein | 420031 | 418940 | −2 | 1092 |

-continued

| Locus | Gene | Product | Start | End | Strand | Length |
|---|---|---|---|---|---|---|
| P3.orf0385 | | putative crispr-associated protein cas4 | 420690 | 420028 | −1 | 663 |
| P3.orf0386 | | CRISPR-associated Csh2 family protein | 421602 | 420730 | −1 | 873 |
| P3.orf0387 | | CRISPR-associated protein, Csd1 family | 423567 | 421660 | −1 | 1908 |
| P3.orf0388 | | CRISPR-associated protein Cas5 family | 424163 | 423564 | −3 | 600 |
| P3.orf0389 | | helicase | 426840 | 424429 | −1 | 2412 |
| P3.orf0390 | | conserved hypothetical protein | 427477 | 427037 | −2 | 441 |
| P3.orf0391 | | Pirin domain protein | 428530 | 427601 | −2 | 930 |
| P3.orf0392 | ybfI | transcriptional regulator, AraC family | 429531 | 428647 | −1 | 885 |
| P3.orf0393 | mdeA | Cystathionine gamma-synthase | 429596 | 430801 | 2 | 1206 |
| P3.orf0394 | ydeL | transcriptional regulator, GntR family with aminotransferase domain protein | 432223 | 430811 | −2 | 1413 |
| P3.orf0395 | | FMN-binding negative transcriptional regulator | 432301 | 432936 | 1 | 636 |
| P3.orf0396 | | putative nitronate monooxygenase | 434092 | 433112 | −2 | 981 |
| P3.orf0397 | | HxlR family transcriptional regulator | 434310 | 434867 | 3 | 558 |
| P3.orf0398 | | conserved hypothetical protein | 435492 | 434926 | −1 | 567 |
| P3.orf0399 | | D-isomer specific 2-hydroxyacid dehydrogenase NAD-binding | 435713 | 436675 | 2 | 963 |
| P3.orf0400 | | hypothetical protein | 438321 | 436699 | −1 | 1623 |
| P3.orf0401 | | 2OG-Fe(II) oxygenase family protein | 438775 | 439785 | 1 | 1011 |
| P3.orf0402 | | hypothetical protein | 438564 | 438355 | −1 | 210 |
| P3.orf0403 | | Glyoxalase/bleomycin resistance protein/dioxygenase | 439832 | 440221 | 2 | 390 |
| P3.orf0404 | med | Bmp family membrane protein | 440300 | 441394 | 2 | 1095 |
| P3.orf0405 | yufO | ABC transporter related protein | 441436 | 442977 | 1 | 1542 |
| P3.orf0406 | yufP | inner-membrane translocator | 442970 | 444100 | 2 | 1131 |
| P3.orf0407 | yufQ | branched chain amino acid ABC transporter, permease protein | 444097 | 445029 | 1 | 933 |
| P3.orf0408 | amn | AMP nucleosidase | 445120 | 446628 | 1 | 1509 |
| P3.orf0409 | | hypothetical protein | 446711 | 447028 | 2 | 318 |
| P3.orf0410 | | HicB family protein | 447193 | 447432 | 1 | 240 |
| P3.orf0411 | | conserved hypothetical protein | 447502 | 448788 | 1 | 1287 |
| P3.orf0412 | | SupD | 448785 | 449744 | 3 | 960 |
| P3.orf0413 | yakc | aldo/keto reductase | 449848 | 450882 | 1 | 1035 |
| P3.orf0414 | yhgD | TetR family transcriptional regulator | 450910 | 451506 | 1 | 597 |
| P3.orf0415 | | AraC family transcriptional regulator | 451595 | 452563 | 2 | 969 |
| P3.orf0416 | | major facilitator transporter | 452652 | 453845 | 3 | 1194 |
| P3.orf0417 | fyuA | TonB-dependent receptor | 453931 | 456051 | 1 | 2121 |
| P3.orf0418 | | O-methyltransferase family protein | 456051 | 457061 | 3 | 1011 |
| P3.orf0419 | yafC | transcriptional regulator protein | 457981 | 457088 | −2 | 894 |
| P3.orf0420 | stp | transporter protein | 458114 | 459625 | 2 | 1512 |
| P3.orf0421 | NQO1 | NAD(P)H quinone oxidoreductase | 460322 | 459654 | −3 | 669 |
| P3.orf0422 | nahR | LysR substrate binding domain protein | 460421 | 461374 | 2 | 954 |
| P3.orf0423 | yebE | Inner membrane protein yebE | 462176 | 461334 | −3 | 843 |
| P3.orf0424 | | acetyl-CoA carboxylase | 462381 | 463019 | 3 | 639 |
| P3.orf0425 | yjbB | Na/Pi-cotransporter II-related protein | 464741 | 463029 | −3 | 1713 |
| P3.orf0426 | | hypothetical protein | 465315 | 464797 | −1 | 519 |
| P3.orf0427 | | hypothetical protein | 465715 | 465299 | −2 | 417 |
| P3.orf0428 | | NADH-ubiquinone oxidoreductase | 466049 | 465705 | −3 | 345 |
| P3.orf0429 | PED1 | Acetyl-CoA C-acyltransferase | 467453 | 466269 | −3 | 1185 |
| P3.orf0430 | braG | putative high-affinity branched-chain amino acid transport ATP-binding proteinputative | 468382 | 467660 | −2 | 723 |
| P3.orf0431 | braF | ABC superfamily ATP binding cassette transporter, ABC protein | 469152 | 468379 | −1 | 774 |
| P3.orf0432 | | branched-chain amino acid ABC transporter | 470993 | 469149 | −3 | 1845 |
| P3.orf0433 | | putative branched-chain amino acid ABC transporter, periplasmic substrate-binding protein | 472322 | 471105 | −3 | 1218 |
| P3.orf0434 | | dehydrogenase | 473394 | 472480 | −1 | 915 |
| P3.orf0435 | rsmA | Methyltransferase type 12 | 474041 | 473445 | −3 | 597 |
| P3.orf0436 | iorB | Aldehyde oxidase and xanthine dehydrogenase, molybdopterin binding protein | 476400 | 474082 | −1 | 2319 |
| P3.orf0437 | iorA | Membrane-bound aldehyde dehydrogenase iron-sulfur protein | 476874 | 476410 | −1 | 465 |
| P3.orf0438 | yqhC | transcriptional regulator protein | 477114 | 478010 | 3 | 897 |
| P3.orf0439 | apl | putative alkaline phosphatase protein | 478111 | 478704 | 1 | 594 |
| P3.orf0440 | sbcD | nuclease SbcCD, D subunit | 478813 | 480060 | 1 | 1248 |
| P3.orf0441 | sbcC | exonuclease SbcC | 480060 | 483848 | 3 | 3789 |
| P3.orf0442 | | aminotransferase | 485304 | 483934 | −1 | 1371 |
| P3.orf0443 | ydeL | transcriptional regulator, GntR family | 485526 | 486989 | 3 | 1464 |
| P3.orf0444 | mocR | transcriptional regulator | 488515 | 487031 | −2 | 1485 |
| P3.orf0445 | bam | Indoleacetamide hydrolase | 488833 | 490233 | 1 | 1401 |
| P3.orf0446 | ytcJ | amidohydrolase-like | 490463 | 492109 | 2 | 1647 |
| P3.orf0447 | | cobalamin synthesis protein, P47K | 492109 | 493038 | 1 | 930 |
| P3.orf0448 | ALD4 | aldehyde dehydrogenase 5 | 493082 | 494605 | 2 | 1524 |
| P3.orf0449 | | conserved hypothetical protein | 494617 | 495354 | 1 | 738 |
| P3.orf0450 | appA | extracellular solute-binding protein family 5 | 495476 | 497071 | 2 | 1596 |

-continued

| Locus | Gene | Product | Start | End | Strand | Length |
|---|---|---|---|---|---|---|
| P3.orf0451 | dppB | binding-protein dependent transport system inner membrane protein | 497178 | 498197 | 3 | 1020 |
| P3.orf0452 | appC | binding-protein-dependent transport systems inner membrane component | 498194 | 499108 | 2 | 915 |
| P3.orf0453 | | oligopeptide/dipeptide ABC transporter, ATPase subunit | 499108 | 500118 | 1 | 1011 |
| P3.orf0454 | appF | oligopeptide/dipeptide ABC transporter, ATPase subunit | 500115 | 501104 | 3 | 990 |
| P3.orf0455 | acdS | 1-aminocyclopropane-1-carboxylate deaminase | 502175 | 501159 | −3 | 1017 |
| P3.orf0456 | lrp | leucine-responsive regulatory protein | 502373 | 502843 | 2 | 471 |
| P3.orf0457 | | NADH dehydrogenase protein | 504282 | 502864 | −1 | 1419 |
| P3.orf0458 | | putative addiction module antidote protein, CopG/Arc/MetJ family | 505113 | 505406 | 3 | 294 |
| P3.orf0459 | | conserved hypothetical protein | 505091 | 504606 | −3 | 486 |
| P3.orf0460 | yoaH | chemotaxis sensory transducer | 506986 | 505490 | −2 | 1497 |
| P3.orf0461 | glnQ | polar amino acid transport system ATP-binding protein | 507949 | 507197 | −2 | 753 |
| P3.orf0462 | | polar amino acid ABC transporter, inner membrane subunit | 508586 | 507936 | −3 | 651 |
| P3.orf0463 | yecS | glutamine ABC superfamily ATP binding cassette transporter, membrane protein | 509304 | 508579 | −1 | 726 |
| P3.orf0464 | glnH | amino acid ABC transporter substrate-binding protein | 510214 | 509390 | −2 | 825 |
| P3.orf0465 | lutR | GntR domain-containing protein | 510487 | 511170 | 1 | 684 |
| P3.orf0466 | alc1 | allantoicase | 511212 | 512225 | 3 | 1014 |
| P3.orf0467 | allA | ureidoglycolate hydrolase | 512234 | 512761 | 2 | 528 |
| P3.orf0468 | | hypothetical protein | 514441 | 512849 | −2 | 1593 |
| P3.orf0469 | | hypothetical protein | 514877 | 515026 | 2 | 150 |
| P3.orf0470 | | hypothetical protein | 514651 | 514505 | −2 | 147 |
| P3.orf0471 | nrdZ | putative B12-dependent ribonucleoside-diphosphate/-triphosphate reductase (nrdJ-like) | 516753 | 515536 | −1 | 1218 |
| P3.orf0472 | | hypothetical protein | 517886 | 518038 | 2 | 153 |
| P3.orf0473 | ydcR | Bifunctional -- Transcriptional Regulator, GntR family/Aminotransferase, class I and II | 519443 | 518043 | −3 | 1401 |
| P3.orf0474 | | MFS transporter | 519730 | 521019 | 1 | 1290 |
| P3.orf0475 | | transcriptional regulator, BadM/Rrf2 family | 521021 | 521401 | 2 | 381 |
| P3.orf0476 | | HPr kinase | 521401 | 522249 | 1 | 849 |
| P3.orf0477 | | sulfotransferase | 522246 | 523112 | 3 | 867 |
| P3.orf0478 | glcF | Glycolate oxidase iron-sulfur subunit | 525337 | 523952 | −2 | 1386 |
| P3.orf0479 | glcE | glycolate oxidase, subunit glcE | 526566 | 525334 | −1 | 1233 |
| P3.orf0480 | glcD | FAD linked oxidase-like protein | 528058 | 526571 | −2 | 1488 |
| P3.orf0481 | rpmJ | 50S ribosomal protein L36 | 528391 | 528266 | −2 | 126 |
| P3.orf0482 | | hypothetical protein | 528619 | 529317 | 1 | 699 |
| P3.orf0483 | | Putative phosphoethanolamine N-methyltransferase | 530285 | 529314 | −3 | 972 |
| P3.orf0484 | lcfA | acyl-CoA synthetase | 532444 | 530696 | −2 | 1749 |
| P3.orf0485 | | biotin dependent acyl-CoA carboxylase | 532599 | 534194 | 3 | 1596 |
| P3.orf0486 | des | fatty acid desaturase | 534570 | 535637 | 3 | 1068 |
| P3.orf0487 | | conserved hypothetical protein | 536061 | 535885 | −1 | 177 |
| P3.orf0488 | | XRE family transcriptional regulator | 537253 | 536912 | −2 | 342 |
| P3.orf0489 | | hypothetical protein | 537835 | 537951 | 1 | 117 |
| P3.orf0490 | | fad dependent oxidoreductase; protein | 539165 | 537972 | −3 | 1194 |
| P3.orf0491 | | valyl-tRNA synthetase | 541083 | 539137 | −1 | 1947 |
| P3.orf0492 | betB | Aldehyde Dehydrogenase | 542856 | 541297 | −1 | 1560 |
| P3.orf0493 | | 6-phosphogluconate dehydrogenase NAD-binding | 543742 | 542873 | −2 | 870 |
| P3.orf0494 | cynR | LysR family transcriptional regulator | 543784 | 544932 | 1 | 1149 |
| P3.orf0495 | | acetyltransferase (GNAT) family protein | 545532 | 545140 | −1 | 393 |
| P3.orf0496 | | conserved hypothetical protein | 545943 | 545662 | −1 | 282 |
| P3.orf0497 | | ABC transporter related protein | 546858 | 546079 | −1 | 780 |
| P3.orf0498 | | binding-protein dependent transport system inner membrane protein | 547711 | 546917 | −2 | 795 |
| P3.orf0499 | ssuA | putative sulfonate/nitrate transport system substrate-binding protein | 548718 | 547735 | −1 | 984 |
| P3.orf0500 | | agmatinase | 549766 | 548759 | −2 | 1008 |
| P3.orf0501 | cmpR | putative LysR-family regulatory protein | 549871 | 550782 | 1 | 912 |
| P3.orf0502 | | putative membrane protein | 550993 | 551823 | 1 | 831 |
| P3.orf0503 | | conserved hypothetical protein | 551829 | 552332 | 3 | 504 |
| P3.orf0504 | sdaA | L-serine dehydratase 1 | 552433 | 553821 | 1 | 1389 |
| P3.orf0505 | ytnL | putative hydrolase | 553879 | 555078 | 1 | 1200 |
| P3.orf0506 | dgdR | transcriptional regulator, LysR family | 555974 | 555093 | −3 | 882 |
| P3.orf0507 | icd | isocitrate dehydrogenase | 556111 | 557196 | 1 | 1086 |
| P3.orf0508 | | conserved hypothetical protein | 557266 | 557913 | 1 | 648 |
| P3.orf0509 | | methyl-accepting chemotaxis protein | 559595 | 557919 | −3 | 1677 |
| P3.orf0510 | | methyl-accepting chemotaxis protein | 561525 | 559840 | −1 | 1686 |

-continued

| Locus | Gene | Product | Start | End | Strand | Length |
|---|---|---|---|---|---|---|
| P3.orf0511 | mcp3 | methyl-accepting chemotaxis sensory transducer | 563423 | 561738 | −3 | 1686 |
| P3.orf0512 | | anti-sigma factor, ChrR | 563646 | 564329 | 3 | 684 |
| P3.orf0513 | yhbS | GCN5-related N-acetyltransferase | 564359 | 564871 | 2 | 513 |
| P3.orf0514 | Aass | Alpha-aminoadipic semialdehyde synthase | 565472 | 566539 | 2 | 1068 |
| P3.orf0515 | | putative transcriptional regulator, AsnC family protein | 565324 | 564887 | −2 | 438 |
| P3.orf0516 | | CRISPR-associated protein Cas2 | 567419 | 567090 | −3 | 330 |
| P3.orf0517 | | conserved hypothetical protein | 568244 | 567429 | −3 | 816 |
| P3.orf0518 | | conserved hypothetical protein | 571430 | 568281 | −3 | 3150 |
| P3.orf0519 | | hypothetical protein | 571876 | 571736 | −2 | 141 |
| P3.orf0520 | | putative ABC transporter-binding protein | 572058 | 573365 | 3 | 1308 |
| P3.orf0521 | | binding-protein-dependent transport systems inner membrane component | 573362 | 574309 | 2 | 948 |
| P3.orf0522 | yurM | maltose/maltodextrin ABC transporter permease protein MalG | 574306 | 575139 | 1 | 834 |
| P3.orf0523 | smoK | maltose | 575149 | 576219 | 1 | 1071 |
| P3.orf0524 | rpfC | GAF sensor hybrid histidine kinase | 576303 | 578552 | 3 | 2250 |
| P3.orf0525 | gstA | conserved hypothetical protein | 578676 | 579287 | 3 | 612 |
| P3.orf0526 | dctA | sodium: dicarboxylate symporter | 580834 | 579419 | −2 | 1416 |
| P3.orf0527 | dctB | histidine kinase | 581119 | 583020 | 1 | 1902 |
| P3.orf0528 | dctD | C4-dicarboxylate transport transcriptional regulatory protein dctD | 583017 | 584396 | 3 | 1380 |
| P3.orf0529 | MGLL | hydrolase | 585291 | 584416 | −1 | 876 |
| P3.orf0530 | ydaM | diguanylate cyclase | 587186 | 585414 | −3 | 1773 |
| P3.orf0531 | tnaA | tryptophanase | 587561 | 589075 | 2 | 1515 |
| P3.orf0532 | | conserved hypothetical protein | 589207 | 589812 | 1 | 606 |
| P3.orf0533 | sodB | superoxide dismutase | 589927 | 590535 | 1 | 609 |
| P3.orf0534 | trpI | LysR family transcriptional regulator | 591413 | 590499 | −3 | 915 |
| P3.orf0535 | pdxA | 4-hydroxythreonine-4-phosphate dehydrogenase | 591591 | 592613 | 3 | 1023 |
| P3.orf0536 | ydbB | Cupin domain protein | 592618 | 593676 | 1 | 1059 |
| P3.orf0537 | | putative oxidoreductase protein | 594448 | 593699 | −2 | 750 |
| P3.orf0538 | yhjC | transcriptional regulator protein | 594536 | 595471 | 2 | 936 |
| P3.orf0539 | | transporter | 596621 | 595425 | −3 | 1197 |
| P3.orf0540 | pat | Phosphinothricin acetyltransferase | 597202 | 596618 | −2 | 585 |
| P3.orf0541 | cmpR | LysR family transcriptional regulator | 597267 | 598265 | 3 | 999 |
| P3.orf0542 | ywnB | Rrf2-linked NADH-flavin reductase | 599486 | 598875 | −3 | 612 |
| P3.orf0543 | ytfH | HTH-type transcriptional regulator ytfH | 599657 | 600055 | 2 | 399 |
| P3.orf0544 | | TetR family transcriptional regulator | 600669 | 600043 | −1 | 627 |
| P3.orf0545 | | putative NAD(P)H dehydrogenase | 600774 | 601382 | 3 | 609 |
| P3.orf0546 | | cyclase family protein | 601466 | 602404 | 2 | 939 |
| P3.orf0547 | tpm | thiopurine S-methyltransferase | 603073 | 602429 | −2 | 645 |
| P3.orf0548 | moaR | transcriptional regulator, LuxR family | 603210 | 603926 | 3 | 717 |
| P3.orf0549 | | amine oxidase | 605247 | 603910 | −1 | 1338 |
| P3.orf0550 | | short-chain dehydrogenase/reductase family oxidoreductase | 606076 | 605336 | −2 | 741 |
| P3.orf0551 | | AraC family transcriptional regulator | 606190 | 607110 | 1 | 921 |
| P3.orf0552 | | major facilitator superfamily MFS_1 | 607197 | 608450 | 3 | 1254 |
| P3.orf0553 | tdhA | TonB-dependent heme/hemoglobin receptor family protein | 610963 | 608438 | −2 | 2526 |
| P3.orf0554 | | FecR protein | 611984 | 611058 | −3 | 927 |
| P3.orf0555 | | FecI-like protein | 612481 | 611981 | −2 | 501 |
| P3.orf0556 | ycdO | conserved hypothetical protein | 613577 | 612753 | −3 | 825 |
| P3.orf0557 | ycdB | Dyp-type peroxidase family protein | 614927 | 613623 | −3 | 1305 |
| P3.orf0558 | ycdO | conserved hypothetical protein | 616107 | 614929 | −1 | 1179 |
| P3.orf0559 | efeU | iron permease FTR1 | 616956 | 616109 | −2 | 846 |
| P3.orf0560 | | conserved hypothetical protein | 623392 | 623982 | 1 | 591 |
| P3.orf0561 | pleC | sensor histidine kinase (non-motile and phage-resistance protein) | 624021 | 625847 | 3 | 1827 |
| P3.orf0562 | pleC | Signal transduction histidine kinase | 627293 | 625860 | −3 | 1434 |
| P3.orf0563 | purU | formyltetrahydrofolate deformylase | 627659 | 628516 | 2 | 858 |
| P3.orf0564 | | TRAP transporter solute receptor TAXI family protein | 628659 | 629678 | 3 | 1020 |
| P3.orf0565 | | TRAP transporter, 4TM/12TM fusion protein | 629779 | 631911 | 1 | 2133 |
| P3.orf0566 | | conserved hypothetical protein | 631908 | 632378 | 3 | 471 |
| P3.orf0567 | | membrane protein-like protein | 632378 | 633676 | 2 | 1299 |
| P3.orf0568 | | cupin 2 domain-containing protein | 633719 | 634216 | 2 | 498 |
| P3.orf0569 | fabG | short-chain dehydrogenase/reductase SDR | 634978 | 634232 | −2 | 747 |
| P3.orf0570 | | hypothetical protein | 635089 | 635322 | 1 | 234 |
| P3.orf0571 | luxQ | two-component hybrid sensor and regulator | 635442 | 638924 | 3 | 3483 |
| P3.orf0572 | agmR | two-component response regulator | 639596 | 638943 | −3 | 654 |
| P3.orf0573 | proP | major facilitator superfamily | 641507 | 639789 | −3 | 1719 |
| P3.orf0574 | | putative hydrolase/carboxylic esterase | 642770 | 641817 | −3 | 954 |
| P3.orf0575 | | Leu/Ile/Val-binding protein | 644023 | 642791 | −2 | 1233 |
| P3.orf0576 | mexR | MarR family transcriptional regulator | 644239 | 644751 | 1 | 513 |
| P3.orf0577 | | conserved hypothetical protein | 644833 | 645165 | 1 | 333 |

-continued

| Locus | Gene | Product | Start | End | Strand | Length |
|---|---|---|---|---|---|---|
| P3.orf0578 | | conserved hypothetical protein | 645504 | 645773 | 3 | 270 |
| P3.orf0579 | | transcriptional regulator, XRE family | 645764 | 646111 | 2 | 348 |
| P3.orf0580 | yvoA | transcriptional regulator, GntR family | 647380 | 648111 | 1 | 732 |
| P3.orf0581 | | amidohydrolase 2 | 647292 | 646474 | −1 | 819 |
| P3.orf0582 | | conserved hypothetical protein | 648226 | 649182 | 1 | 957 |
| P3.orf0583 | | conserved hypothetical protein | 649184 | 649621 | 2 | 438 |
| P3.orf0584 | | integral membrane protein | 649637 | 651130 | 2 | 1494 |
| P3.orf0585 | | conserved hypothetical protein | 651713 | 651135 | −3 | 579 |
| P3.orf0586 | mnmA | tRNA (5-methylaminomethyl-2-thiouridylate)-methyltransferase | 653006 | 651852 | −3 | 1155 |
| P3.orf0587 | | Transcriptional activator, TenA family protein | 653783 | 653061 | −3 | 723 |
| P3.orf0588 | fdxB | 2Fe—2S ferredoxin | 654279 | 653947 | −1 | 333 |
| P3.orf0589 | | Iron-sulfur assembly protein | 654862 | 654530 | −2 | 333 |
| P3.orf0590 | mdtA | secretion protein | 655170 | 656342 | 3 | 1173 |
| P3.orf0591 | | hydrophobic/amphiphilic exporter-1 | 656364 | 659462 | 3 | 3099 |
| P3.orf0592 | ybaL | potassium efflux system protein | 661960 | 660227 | −2 | 1734 |
| P3.orf0593 | | hypothetical protein | 662198 | 662629 | 2 | 432 |
| P3.orf0594 | secD | protein-export membrane protein SECD | 662767 | 665103 | 1 | 2337 |
| P3.orf0595 | grsT | Type II thioesterase | 665186 | 665971 | 2 | 786 |
| P3.orf0596 | phbA | Membrane protease subunit stomatin/prohibitin-like protein | 667426 | 665975 | −2 | 1452 |
| P3.orf0597 | yojI | Cyclic peptide transporter | 669105 | 667423 | −1 | 1683 |
| P3.orf0598 | | hypothetical protein | 669427 | 669215 | −2 | 213 |
| P3.orf0599 | | GTPase domain-containing protein | 670123 | 669551 | −2 | 573 |
| P3.orf0600 | | cation/multidrug efflux pump protein | 673337 | 670374 | −3 | 2964 |
| P3.orf0601 | | putative HlyD-like secretion protein | 674600 | 673467 | −3 | 1134 |
| P3.orf0602 | lgrC | OciB protein | 674941 | 681312 | 1 | 6372 |
| P3.orf0603 | pksJ | linear gramicidin synthetase subunit D | 681309 | 686699 | 3 | 5391 |
| P3.orf0604 | lgrC | non-ribosomal peptide synthetase | 686696 | 690688 | 2 | 3993 |
| P3.orf0605 | lgrC | putative nonribosomal peptide synthetases (NPRS) | 690664 | 702225 | 1 | 11562 |
| P3.orf0606 | lgrC | erythronolide synthase | 702250 | 707367 | 1 | 5118 |
| P3.orf0607 | pksJ | HctF | 707383 | 712224 | 1 | 4842 |
| P3.orf0608 | pksJ | non-ribosomal peptide synthetase/polyketide synthase | 712221 | 716462 | 3 | 4242 |
| P3.orf0609 | lgrC | non-ribosomal peptide synthetase | 716459 | 720319 | 2 | 3861 |
| P3.orf0610 | lgrC | non-ribosomal peptide synthetase | 720291 | 722912 | 3 | 2622 |
| P3.orf0611 | lgrC | peptide synthetase | 722909 | 729400 | 2 | 6492 |
| P3.orf0612 | mbtH | MbtH domain-containing protein | 729464 | 729697 | 2 | 234 |
| P3.orf0613 | | conserved hypothetical protein | 731518 | 731312 | −2 | 207 |
| P3.orf0614 | | hypothetical protein | 732225 | 732362 | 3 | 138 |
| P3.orf0615 | | hypothetical protein | 732366 | 732548 | 3 | 183 |
| P3.orf0616 | | conserved hypothetical protein | 733333 | 732761 | −2 | 573 |
| P3.orf0617 | | conserved hypothetical protein | 734754 | 734527 | −1 | 228 |
| P3.orf0618 | yyaK | CAAX amino terminal protease family | 736217 | 735243 | −3 | 975 |
| P3.orf0619 | yycB | cyanate transport system protein | 737535 | 736339 | −1 | 1197 |
| P3.orf0620 | | transcriptional regulator, GntR family | 738299 | 737532 | −3 | 768 |
| P3.orf0621 | | putative SURF1 family protein | 739095 | 738403 | −1 | 693 |
| P3.orf0622 | cyoD | cytochrome o ubiquinol oxidase subunit IV | 739619 | 739194 | −3 | 426 |
| P3.orf0623 | cyoC | cytochrome o ubiquinol oxidase subunit III | 740278 | 739616 | −2 | 663 |
| P3.orf0624 | cyoB | cytochrome o ubiquinol oxidase, subunit I (ubiquinol oxidase chain A) | 742286 | 740283 | −3 | 2004 |
| P3.orf0625 | cyoA | ubiquinol oxidase, subunit II | 743480 | 742305 | −3 | 1176 |
| P3.orf0626 | | type III effector protein | 744090 | 744644 | 3 | 555 |
| P3.orf0627 | | hypothetical protein | 744655 | 745092 | 1 | 438 |
| P3.orf0628 | | DNA methylase N-4/N-6 | 745248 | 748043 | 3 | 2796 |
| P3.orf0629 | | type III restriction enzyme, res subunit | 748063 | 751170 | 1 | 3108 |
| P3.orf0630 | | UvrD/REP type DNA helicase | 753318 | 751198 | −1 | 2121 |
| P3.orf0631 | pdxJ | pyridoxal phosphate biosynthetic protein PdxJ | 754149 | 753397 | −1 | 753 |
| P3.orf0632 | | hypothetical protein | 754142 | 754318 | 2 | 177 |
| P3.orf0633 | ggpS | alpha,alpha-trehalose-phosphate synthase | 755880 | 754360 | −1 | 1521 |
| P3.orf0634 | ggpS | alpha,alpha-trehalose-phosphate synthase | 756681 | 755959 | −1 | 723 |
| P3.orf0635 | gpsA | glycerol-3-phosphate dehydrogenase | 757862 | 756681 | −3 | 1182 |
| P3.orf0636 | aglA | putative alpha-glucosidase AglA | 758072 | 759703 | 2 | 1632 |
| P3.orf0637 | | glutathione-dependent formaldehyde-activating GFA | 759738 | 760196 | 3 | 459 |
| P3.orf0638 | | TetR family transcriptional regulator | 760355 | 760999 | 2 | 645 |
| P3.orf0639 | ilvE | aminotransferase, class IV | 761003 | 761953 | 2 | 951 |
| P3.orf0640 | | conserved hypothetical protein | 761953 | 763626 | 1 | 1674 |
| P3.orf0641 | crt | 3-hydroxybutyryl-CoA dehydratase | 764644 | 763850 | −2 | 795 |
| P3.orf0642 | oruR | AraC family transcriptional regulator | 764810 | 765886 | 2 | 1077 |
| P3.orf0643 | | FAD/FMN-containing dehydrogenases | 767279 | 765852 | −3 | 1428 |
| P3.orf0644 | lutR | transcriptional regulator, GntR family/amidohydrolase family protein | 767533 | 769188 | 1 | 1656 |
| P3.orf0645 | yiaO | putative periplasmic substrate-binding transport protein | 769391 | 770386 | 2 | 996 |

-continued

| Locus | Gene | Product | Start | End | Strand | Length |
|---|---|---|---|---|---|---|
| P3.orf0646 | siaT | TRAP-type C4-dicarboxylate transport system, small permease component | 770492 | 770998 | 2 | 507 |
| P3.orf0647 | ygiK | C4-dicarboxylate transport system (permease large protein) | 770995 | 772278 | 1 | 1284 |
| P3.orf0648 | cysB | cystathionine beta-synthase | 772491 | 773513 | 3 | 1023 |
| P3.orf0649 | | 2-isopropylmalate synthase | 773510 | 774922 | 2 | 1413 |
| P3.orf0650 | | conserved hypothetical protein | 774877 | 775938 | 1 | 1062 |
| P3.orf0651 | | conserved hypothetical protein | 776020 | 777183 | 1 | 1164 |
| P3.orf0652 | | Argininosuccinate lyase 2 | 777193 | 778479 | 1 | 1287 |
| P3.orf0653 | | conserved hypothetical protein | 778476 | 779720 | 3 | 1245 |
| P3.orf0654 | | hypothetical protein | 779737 | 781011 | 1 | 1275 |
| P3.orf0655 | | short chain dehydrogenase | 782717 | 781806 | −3 | 912 |
| P3.orf0656 | | transcriptional regulator, TetR family | 782822 | 783403 | 2 | 582 |
| P3.orf0657 | iclR | IclR family transcriptional regulator | 784283 | 783417 | −3 | 867 |
| P3.orf0658 | | gentisate 1,2-dioxygenase | 784491 | 785555 | 3 | 1065 |
| P3.orf0659 | | fumarylacetoacetat hydroxylase | 785552 | 786268 | 2 | 717 |
| P3.orf0660 | siaP | TRAP dicarboxylate transporter- DctP subunit | 786340 | 787383 | 1 | 1044 |
| P3.orf0661 | | hypothetical protein | 787380 | 787946 | 3 | 567 |
| P3.orf0662 | siaT | trap dicarboxylate transporter, dctm subunit | 787953 | 789257 | 3 | 1305 |
| P3.orf0663 | maiA | maleylacetoacetate isomerase | 789271 | 789945 | 1 | 675 |
| P3.orf0664 | | HTH-type transcriptional regulator | 790355 | 790053 | −3 | 303 |
| P3.orf0665 | iscS | Cysteine desulfurase | 791652 | 790423 | −1 | 1230 |
| P3.orf0666 | iscS | Cysteine sulfinate desulfinase/cysteine desulfurase and related enzyme | 792881 | 791745 | −3 | 1137 |
| P3.orf0667 | iscR | transcriptional regulator, BadM/Rrf2 family | 793399 | 792878 | −2 | 522 |
| P3.orf0668 | cysE | serine O-acetyltransferase | 794181 | 793441 | −1 | 741 |
| P3.orf0669 | | hydrolase of the alpha/beta superfamily | 794379 | 795017 | 3 | 639 |
| P3.orf0670 | thrC | threonine synthase-like protein | 796344 | 795088 | −1 | 1257 |
| P3.orf0671 | siaT | TRAP transporter, 4TM/12TM fusion protein | 798272 | 796416 | −3 | 1857 |
| P3.orf0672 | | TRAP transporter solute receptor, TAXI family | 799414 | 798431 | −2 | 984 |
| P3.orf0673 | kdgR | IclR family transcriptional regulator | 800322 | 799525 | −1 | 798 |
| P3.orf0674 | pepQ | peptidase M24 | 801581 | 800361 | −3 | 1221 |
| P3.orf0675 | zntA | heavy metal translocating P-type ATPase | 804002 | 801801 | −3 | 2202 |
| P3.orf0676 | zntR | transcriptional regulator, MerR family protein | 804141 | 804641 | 3 | 501 |
| P3.orf0677 | rsmA | phospholipid N-methyltransferase protein | 804744 | 805394 | 3 | 651 |
| P3.orf0678 | anmK | anhydro-N-acetylmuramic acid kinase | 807521 | 805377 | −3 | 2145 |
| P3.orf0679 | tyrS | tyrosyl-tRNA synthetase | 807709 | 808965 | 1 | 1257 |
| P3.orf0680 | | YceI family protein | 809682 | 809047 | −1 | 636 |
| P3.orf0681 | slyA | MarR family transcriptional regulator | 809891 | 810358 | 2 | 468 |
| P3.orf0682 | | major facilitator transporter | 810360 | 811934 | 3 | 1575 |
| P3.orf0683 | emrA | secretion protein HlyD | 811942 | 812994 | 1 | 1053 |
| P3.orf0684 | | conserved hypothetical protein | 816400 | 813002 | −2 | 3399 |
| P3.orf0685 | glnE | glutamate-ammonia-ligase adenylyltransferase | 816637 | 819669 | 1 | 3033 |
| P3.orf0686 | bcp | Redoxin | 819666 | 820127 | 3 | 462 |
| P3.orf0687 | | conserved hypothetical protein | 820143 | 821033 | 3 | 891 |
| P3.orf0688 | yncA | GCN5-related N-acetyltransferase | 821069 | 821593 | 2 | 525 |
| P3.orf0689 | | conserved hypothetical protein | 821947 | 822381 | 1 | 435 |
| P3.orf0690 | | conserved hypothetical protein | 824286 | 823750 | −1 | 537 |
| P3.orf0691 | | conserved hypothetical protein | 823753 | 822395 | −2 | 1359 |
| P3.orf0692 | | conserved hypothetical protein | 824445 | 825173 | 3 | 729 |
| P3.orf0693 | | major facilitator superfamily MFS_1 | 826398 | 825151 | −1 | 1248 |
| P3.orf0694 | ydeM | putative acyl dehydratase | 826905 | 826429 | −1 | 477 |
| P3.orf0695 | | ubiquinone/menaquinone biosynthesis methyltransferase protein | 827735 | 826902 | −3 | 834 |
| P3.orf0696 | | radical SAM domain protein | 830039 | 827772 | −3 | 2268 |
| P3.orf0697 | rhiR | LuxR family transcriptional regulator | 830445 | 831188 | 3 | 744 |
| P3.orf0698 | rhlI | N-acyl-L-homoserine lactone synthetase MsaI | 831221 | 831901 | 2 | 681 |
| P3.orf0699 | ydeM | MaoC domain protein dehydratase | 831898 | 832386 | 1 | 489 |
| P3.orf0700 | | alpha/beta hydrolase fold protein | 833473 | 832415 | −2 | 1059 |
| P3.orf0701 | prfB | peptide chain release factor RF-2 | 834438 | 833473 | −1 | 966 |
| P3.orf0702 | mrcA | penicillin binding protein 1A | 837211 | 834671 | −2 | 2541 |
| P3.orf0703 | amiC | N-acetylmuramoyl-L-alanine amidase | 838844 | 837453 | −3 | 1392 |
| P3.orf0704 | rne | Ribonuclease E and G | 839847 | 843209 | 3 | 3363 |
| P3.orf0705 | aspC | putative aminotransferase protein | 844504 | 843335 | −2 | 1170 |
| P3.orf0706 | GGT1 | gamma-glutamyltranspeptidase precursor | 845878 | 844637 | −2 | 1242 |
| P3.orf0707 | | putative Zn-dependent protease | 845982 | 847358 | 3 | 1377 |
| P3.orf0708 | | outer membrane protein | 847424 | 848182 | 2 | 759 |
| P3.orf0709 | gph | phosphoglycolate phosphatase | 848873 | 848187 | −3 | 687 |
| P3.orf0710 | | conserved hypothetical protein | 849082 | 849558 | 1 | 477 |
| P3.orf0711 | vagC | SpoVT/AbrB-like protein | 849653 | 849895 | 2 | 243 |
| P3.orf0712 | | PilT protein domain protein | 849894 | 850296 | 1 | 303 |
| P3.orf0713 | | conserved hypothetical protein | 850860 | 850378 | −1 | 483 |
| P3.orf0714 | nahR | LysR family transcriptional regulator | 850859 | 851845 | 2 | 987 |
| P3.orf0715 | bdlA | methyl-accepting chemotaxis sensory transducer with Pas/Pac sensor | 852122 | 853828 | 2 | 1707 |
| P3.orf0716 | | fumarylacetoacetate hydrolase family protein | 854906 | 853923 | −3 | 984 |
| P3.orf0717 | | homogentisate 12-dioxygenase | 856060 | 854909 | −2 | 1152 |

-continued

| Locus | Gene | Product | Start | End | Strand | Length |
|---|---|---|---|---|---|---|
| P3.orf0718 | vllY | 4-hydroxyphenylpyruvate dioxygenase | 857153 | 856053 | −3 | 1101 |
| P3.orf0719 | | transcriptional regulator, MarR family protein | 857344 | 857895 | 1 | 552 |
| P3.orf0720 | | methyl-accepting chemotaxis sensory transducer | 858317 | 859390 | 2 | 1074 |
| P3.orf0721 | cya | adenylate cyclase protein | 859494 | 861215 | 3 | 1722 |
| P3.orf0722 | | Argininosuccinate lyase 2 | 862511 | 861219 | −3 | 1293 |
| P3.orf0723 | | conserved hypothetical protein | 863485 | 862508 | −2 | 978 |
| P3.orf0724 | | fatty acid desaturase | 864225 | 863482 | −1 | 744 |
| P3.orf0725 | | conserved hypothetical protein | 865333 | 864473 | −2 | 861 |
| P3.orf0726 | iolS | aldo/keto reductase | 866343 | 865357 | −1 | 987 |
| P3.orf0727 | lgrD | amino acid adenylation domain protein | 869822 | 866340 | −3 | 3483 |
| P3.orf0728 | gshB | glutathione synthase | 871153 | 870191 | −2 | 963 |
| P3.orf0729 | GST | glutathione S-transferase | 872056 | 871313 | −2 | 744 |
| P3.orf0730 | thiG | bifunctional sulfur carrier protein/thiazole synthase protein | 873100 | 872105 | −2 | 996 |
| P3.orf0731 | aroQ | 3-dehydroquinate dehydratase | 873253 | 873732 | 1 | 480 |
| P3.orf0732 | accB | acetyl-CoA carboxylase, biotin carboxyl carrier protein | 873725 | 874207 | 2 | 483 |
| P3.orf0733 | accC | acetyl-CoA carboxylase | 874221 | 875564 | 3 | 1344 |
| P3.orf0734 | | D-serine dehydratase | 875663 | 876799 | 2 | 1137 |
| P3.orf0735 | ycjX | conserved hypothetical protein | 876931 | 878382 | 1 | 1452 |
| P3.orf0736 | | membrane protein | 878379 | 879446 | 3 | 1068 |
| P3.orf0737 | | leucyl/phenylalanyl-tRNA--protein transferase | 879579 | 880301 | 3 | 723 |
| P3.orf0738 | | conserved hypothetical protein | 880751 | 880308 | −3 | 444 |
| P3.orf0739 | | ABC superfamily ATP binding cassette transporter substrate binding protein | 881269 | 880748 | −2 | 522 |
| P3.orf0740 | | NADH dehydrogenase | 881697 | 881350 | −1 | 348 |
| P3.orf0741 | nrdJ | Ribonucleotide reductase large subunit | 882342 | 886010 | 3 | 3669 |
| P3.orf0742 | | putative aminopeptidase protein | 886135 | 886365 | 1 | 231 |
| P3.orf0743 | | domain of unknown function DUF1814 | 886362 | 887063 | 3 | 702 |
| P3.orf0744 | | nuclease | 888130 | 887069 | −2 | 1062 |
| P3.orf0745 | | conserved hypothetical protein | 889257 | 888127 | −1 | 1131 |
| P3.orf0746 | | conserved hypothetical protein | 890082 | 889258 | −1 | 825 |
| P3.orf0747 | | putative transmembrane protein | 891508 | 890066 | −2 | 1443 |
| P3.orf0748 | | conserved hypothetical protein | 892071 | 891652 | −1 | 420 |
| P3.orf0749 | livG | ABC transporter related protein | 892719 | 893525 | 3 | 807 |
| P3.orf0750 | livF | ABC transporter related protein | 893545 | 894264 | 1 | 720 |
| P3.orf0751 | livH | hydrophobic amino acid ABC transporter permease | 894261 | 895124 | 3 | 864 |
| P3.orf0752 | braE | inner-membrane translocator | 895124 | 896110 | 2 | 987 |
| P3.orf0753 | nepI | major facilitator family transporter | 897320 | 896151 | −3 | 1170 |
| P3.orf0754 | yafC | Transcriptional regulator, LysR family | 898325 | 897456 | −3 | 870 |
| P3.orf0755 | mauR | LysR family transcriptional regulator | 899245 | 898304 | −2 | 942 |
| P3.orf0756 | | sodium/sulphate symporter | 899382 | 900788 | 3 | 1407 |
| P3.orf0757 | | Glyoxalase/bleomycin resistance protein/dioxygenase | 901172 | 900798 | −3 | 375 |
| P3.orf0758 | | conserved hypothetical protein | 902518 | 901277 | −2 | 1242 |
| P3.orf0759 | | sigma-54 interacting transcription regulator protein | 902714 | 904321 | 2 | 1608 |
| P3.orf0760 | nsrR | HTH-type transcriptional regulator nsrR | 904774 | 904325 | −2 | 450 |
| P3.orf0761 | braC | extracellular ligand-binding receptor | 906172 | 904952 | −2 | 1221 |
| P3.orf0762 | | hypothetical protein | 906686 | 906889 | 2 | 204 |
| P3.orf0763 | xdhA | aldehyde oxidase and xanthine dehydrogenase molybdopterin binding | 907429 | 910212 | 1 | 2784 |
| P3.orf0764 | hcrC | putative deshydrogenase/oxidoreductase; | 910209 | 910781 | 3 | 573 |
| P3.orf0765 | | Gluconate 2-dehydrogenase (acceptor) | 910778 | 912058 | 2 | 1281 |
| P3.orf0766 | | AMP-dependent synthetase and ligase | 913897 | 912082 | −1 | 1806 |
| P3.orf0767 | livF | ABC transporter related protein | 914711 | 913884 | −3 | 828 |
| P3.orf0768 | livK | Extracellular ligand-binding receptor | 916006 | 914780 | −2 | 1227 |
| P3.orf0769 | livM | inner-membrane translocator | 917130 | 916087 | −1 | 1044 |
| P3.orf0770 | livH | inner-membrane translocator | 918063 | 917185 | −1 | 879 |
| P3.orf0771 | braF | ABC transporter related protein | 918916 | 918149 | −2 | 768 |
| P3.orf0772 | yqjP | Beta-lactamase-like | 920316 | 919276 | −1 | 1041 |
| P3.orf0773 | | acyl-CoA dehydrogenase | 922322 | 920526 | −3 | 1797 |
| P3.orf0774 | | hypothetical protein | 923029 | 922643 | −2 | 387 |
| P3.orf0775 | asnO | asparagine synthase | 925222 | 923261 | −2 | 1962 |
| P3.orf0776 | | conserved hypothetical protein | 925873 | 925373 | −2 | 501 |
| P3.orf0777 | sir1 | sulfite reductase (ferredoxin) | 927872 | 925857 | −3 | 2016 |
| P3.orf0778 | cya | adenylate cyclase 1 | 929331 | 928132 | −1 | 1200 |
| P3.orf0779 | | conserved hypothetical protein | 929415 | 929771 | 3 | 357 |
| P3.orf0780 | | 2OG-Fe(II) oxygenase | 930407 | 929787 | −3 | 621 |
| P3.orf0781 | | conserved hypothetical protein | 930792 | 932603 | 3 | 1812 |
| P3.orf0782 | mmgC | acyl-CoA dehydrogenase | 934470 | 932680 | −1 | 1791 |
| P3.orf0783 | fadN | 3-hydroxyacyl-CoA dehydrogenase | 936829 | 934496 | −2 | 2334 |
| P3.orf0784 | fadA | 3-ketoacyl-CoA thiolase | 938014 | 936875 | −2 | 1140 |
| P3.orf0785 | | transcriptional regulator, MerR family protein | 938540 | 938148 | −3 | 393 |
| P3.orf0786 | lcfA | long-chain-fatty-acid--CoA ligase | 940431 | 938701 | −1 | 1731 |

-continued

| Locus | Gene | Product | Start | End | Strand | Length |
|---|---|---|---|---|---|---|
| P3.orf0787 | | Helix-turn-helix motif protein | 941092 | 940724 | −2 | 369 |
| P3.orf0788 | | plasmid maintenance system killer | 941296 | 941174 | −2 | 123 |
| P3.orf0789 | | hypothetical protein | 942032 | 941577 | −3 | 456 |
| P3.orf0790 | | conserved hypothetical protein | 942675 | 942043 | −1 | 633 |
| P3.orf0791 | | conserved hypothetical protein | 943429 | 942773 | −2 | 657 |
| P3.orf0792 | | ArgK protein | 944530 | 943568 | −2 | 963 |
| P3.orf0793 | ppdK | pyruvate phosphate dikinase | 947228 | 944574 | −3 | 2655 |
| P3.orf0794 | glyS | glycyl-tRNA synthetase beta chain | 949324 | 947249 | −2 | 2076 |
| P3.orf0795 | | hypothetical protein | 950163 | 950405 | 3 | 243 |
| P3.orf0796 | glyQ | Glycyl-tRNA synthetase alpha chain | 950135 | 949329 | −3 | 807 |
| P3.orf0797 | | hypothetical protein | 950700 | 950449 | −1 | 252 |
| P3.orf0798 | | peptidase S49 | 951588 | 950713 | −1 | 876 |
| P3.orf0799 | | methyltransferase small | 952466 | 951648 | −3 | 819 |
| P3.orf0800 | | conserved hypothetical protein | 952771 | 952463 | −2 | 309 |
| P3.orf0801 | ispB | Polyprenyl synthetase | 953124 | 954125 | 3 | 1002 |
| P3.orf0802 | pleC | integral membrane sensor hybrid histidine kinase | 954513 | 955805 | 3 | 1293 |
| P3.orf0803 | ADS1 | fatty-acid desaturase | 955953 | 956948 | 3 | 996 |
| P3.orf0804 | ppsA | Beta-ketoacyl synthase | 957140 | 957436 | 2 | 297 |
| P3.orf0805 | | cyclopropane-fatty-acyl-phospholipid synthase | 957464 | 958363 | 2 | 900 |
| P3.orf0806 | | amino acid adenylation | 958379 | 960163 | 2 | 1785 |
| P3.orf0807 | | acyl-CoA dehydrogenase domain protein | 960167 | 961330 | 2 | 1164 |
| P3.orf0808 | crt | F148266_1 unknown | 961327 | 962502 | 1 | 1176 |
| P3.orf0809 | cmoA | methyltransferase type 12 | 963218 | 962508 | −3 | 711 |
| P3.orf0810 | | conserved hypothetical protein | 963792 | 963313 | −1 | 480 |
| P3.orf0811 | | conserved hypothetical protein | 964293 | 963898 | −1 | 396 |
| P3.orf0812 | | HDDC2 protein | 964561 | 965175 | 1 | 615 |
| P3.orf0813 | ycfQ | transcriptional regulator, TetR family | 965820 | 965188 | −1 | 633 |
| P3.orf0814 | estB | beta-lactamase | 965903 | 967150 | 2 | 1248 |
| P3.orf0815 | | TetR-family transcriptional regulator | 967743 | 967138 | −1 | 606 |
| P3.orf0816 | gst3 | glutathione S-transferase domain-containing protein | 967843 | 968511 | 1 | 669 |
| P3.orf0817 | | conserved hypothetical protein | 969588 | 968770 | −1 | 819 |
| P3.orf0818 | yfhB | phenazine biosynthesis protein | 971074 | 970151 | −2 | 924 |
| P3.orf0819 | | GntR family transcriptional regulator with aminotransferase domain | 971121 | 972512 | 3 | 1392 |
| P3.orf0820 | | putative flagellin | 972583 | 974163 | 1 | 1581 |
| P3.orf0821 | | conserved hypothetical protein | 974616 | 974173 | −1 | 444 |
| P3.orf0822 | FMO5 | Dimethylaniline monooxygenase [N-oxide-forming] 5 | 976226 | 974622 | −3 | 1605 |
| P3.orf0823 | | biotin/lipoyl attachment domain-containing protein | 976537 | 976319 | −2 | 219 |
| P3.orf0824 | accC | carbamoyl-phosphate synthase L chain ATP-binding | 977933 | 976590 | −3 | 1344 |
| P3.orf0825 | | conserved hypothetical protein | 978049 | 978747 | 1 | 699 |
| P3.orf0826 | | transcriptional regulator, XRE family | 978834 | 979655 | 3 | 822 |
| P3.orf0827 | ybhB | putative phosphatidylethanolamine-binding protein | 980209 | 979643 | −2 | 567 |
| P3.orf0828 | ybcM | AraC protein | 981184 | 980306 | −2 | 879 |
| P3.orf0829 | | conserved hypothetical protein | 981345 | 982268 | 3 | 924 |
| P3.orf0830 | rhtB | amino acid efflux protein | 982913 | 982272 | −3 | 642 |
| P3.orf0831 | mutB | methylmalonyl-CoA mutase | 985204 | 983015 | −2 | 2190 |
| P3.orf0832 | mutA | methylmalonyl-CoA mutase | 987113 | 985209 | −3 | 1905 |
| P3.orf0833 | | Enoyl-CoA hydratase/isomerase | 988058 | 987369 | −3 | 690 |
| P3.orf0834 | | hypothetical protein | 988638 | 988207 | −1 | 432 |
| P3.orf0835 | | hypothetical protein | 989373 | 988879 | −1 | 495 |
| P3.orf0836 | hmuR | TonB-dependent receptor plug | 989660 | 991966 | 2 | 2307 |
| P3.orf0837 | yddA | putative ABC transport system, ATP-binding protein | 991971 | 993755 | 3 | 1785 |
| P3.orf0838 | yrpG | putative oxidoreductase | 994690 | 993740 | −2 | 951 |
| P3.orf0839 | | 3-ketoacyl-(acyl-carrier-protein) reductase | 995724 | 994966 | −1 | 759 |
| P3.orf0840 | | NHL repeat-containing protein | 996113 | 997576 | 2 | 1464 |
| P3.orf0841 | | GCN5-related N-acetyltransferase | 997593 | 998120 | 3 | 528 |
| P3.orf0842 | npdA | NAD-dependent deacetylase | 998882 | 998127 | −3 | 756 |
| P3.orf0843 | | nitro reductase | 999578 | 998934 | −3 | 645 |
| P3.orf0844 | | hypothetical protein | 999914 | 999597 | −3 | 318 |
| P3.orf0845 | pleC | multi-sensor signal transduction histidine kinase | 1002236 | 1000074 | −3 | 2163 |
| P3.orf0846 | | ATP-dependent protease HslVU (ClpYQ), ATPase subunit | 1003513 | 1002365 | −2 | 1149 |
| P3.orf0847 | | cytochrome c family protein | 1003815 | 1004216 | 3 | 402 |
| P3.orf0848 | | conserved hypothetical protein | 1004257 | 1004955 | 1 | 699 |
| P3.orf0849 | acoR | transcriptional regulator | 1005170 | 1007215 | 2 | 2046 |
| P3.orf0850 | acoX | ATP-NAD/AcoX kinase | 1007579 | 1008661 | 2 | 1083 |
| P3.orf0851 | acoA | acetoin dehydrogenase complex, E1 component, alpha subunit | 1008740 | 1009744 | 2 | 1005 |

-continued

| Locus | Gene | Product | Start | End | Strand | Length |
|---|---|---|---|---|---|---|
| P3.orf0852 | acoB | pyruvate dehydrogenase E1 component, beta subunit | 1009779 | 1010786 | 3 | 1008 |
| P3.orf0853 | acoC | branched-chain alpha-keto acid dehydrogenase subunit E2 | 1010805 | 1011917 | 3 | 1113 |
| P3.orf0854 | budC | short-chain dehydrogenase/reductase SDR | 1011922 | 1012716 | 1 | 795 |
| P3.orf0855 | | hypothetical protein | 1013102 | 1013245 | 2 | 144 |
| P3.orf0856 | | Lysine-specific demethylase | 1013381 | 1014550 | 2 | 1170 |
| P3.orf0857 | | aspartyl/asparaginyl beta-hydroxylase | 1015527 | 1014553 | −1 | 975 |
| P3.orf0858 | | conserved hypothetical protein | 1015809 | 1015531 | −1 | 279 |
| P3.orf0859 | | prolyl 4-hydroxylase, alpha subunit | 1015971 | 1016600 | 3 | 630 |
| P3.orf0860 | | conserved hypothetical protein | 1016930 | 1016616 | −3 | 315 |
| P3.orf0861 | asnO | Asparagine synthase (glutamine-hydrolyzing) | 1017430 | 1019361 | 1 | 1932 |
| P3.orf0862 | | sulfotransferase | 1020238 | 1019384 | −2 | 855 |
| P3.orf0863 | | HPr kinase | 1021071 | 1020238 | −1 | 834 |
| P3.orf0864 | viuB | siderophore-interacting protein | 1022343 | 1021240 | −1 | 1104 |
| P3.orf0865 | | solute-binding periplasmic protein of iron/siderophore ABC transporter | 1023521 | 1022385 | −3 | 1137 |
| P3.orf0866 | fhuA | OMR family ferrichrome outer membrane transporter | 1025656 | 1023536 | −2 | 2121 |
| P3.orf0867 | | TetR family transcriptional regulator | 1025958 | 1026647 | 3 | 690 |
| P3.orf0868 | | alpha/beta hydrolase fold | 1027782 | 1026658 | −1 | 1125 |
| P3.orf0869 | paaG | enoyl-CoA hydratase | 1028657 | 1027845 | −3 | 813 |
| P3.orf0870 | | Acetyl-CoA C-acetyltransferase | 1029949 | 1028765 | −2 | 1185 |
| P3.orf0871 | yncB | oxidoreductase, zinc-binding dehydrogenase family | 1030187 | 1031251 | 2 | 1065 |
| P3.orf0872 | pleC | two-component sensor histidine kinase | 1031517 | 1032734 | 3 | 1218 |
| P3.orf0873 | | putative lipoprotein | 1033471 | 1032830 | −2 | 642 |
| P3.orf0874 | | hypothetical protein | 1033737 | 1033501 | −1 | 237 |
| P3.orf0875 | | putative 2-hydroxychromene-2-carboxylate isomerase | 1034622 | 1034008 | −1 | 615 |
| P3.orf0876 | | 5-carboxymethyl-2-hydroxymuconate delta-isomerase | 1034781 | 1035623 | 3 | 843 |
| P3.orf0877 | yjcC | conserved hypothetical protein | 1035829 | 1037511 | 1 | 1683 |
| P3.orf0878 | | conserved hypothetical protein | 1038050 | 1037535 | −3 | 516 |
| P3.orf0879 | | transcriptional regulator, XRE family | 1038394 | 1038999 | 1 | 606 |
| P3.orf0880 | | sulfonate/nitrate/taurine transport system ATP-binding protein | 1039664 | 1040437 | 2 | 774 |
| P3.orf0881 | | sulfonate/nitrate/taurine transport system permease protein | 1040430 | 1041365 | 3 | 936 |
| P3.orf0882 | | sulfonate/nitrate/taurine transport system permease protein | 1041362 | 1042516 | 2 | 1155 |
| P3.orf0883 | | sulfonate/nitrate/taurine transport system substrate-binding protein | 1042687 | 1043700 | 1 | 1014 |
| P3.orf0884 | | diguanylate cyclase/phosphodiesterase with PAS/PAC sensor(s) | 1043849 | 1045435 | 2 | 1587 |
| P3.orf0885 | ytsP | conserved hypothetical protein | 1045456 | 1045956 | 1 | 501 |
| P3.orf0886 | yhjX | major facilitator superfamily MFS_1 | 1047664 | 1046012 | −2 | 1653 |
| P3.orf0887 | cynR | LysR-family transcriptional regulator | 1048839 | 1047913 | −1 | 927 |
| P3.orf0888 | yhcA | EmrB/QacA family drug resistance transporter | 1050376 | 1048943 | −2 | 1434 |
| P3.orf0889 | slyA | regulatory protein, MarR | 1050906 | 1050373 | −1 | 534 |
| P3.orf0890 | kipR | IclR family regulatory protein | 1051954 | 1051049 | −2 | 906 |
| P3.orf0891 | acoA | Thiamine pyrophosphate-dependent dehydrogenase, E1 component alpha subunit | 1052403 | 1053386 | 3 | 984 |
| P3.orf0892 | pdhB | putative pyruvate dehydrogenase E1 beta subunit | 1053383 | 1054354 | 2 | 972 |
| P3.orf0893 | | outer membrane efflux protein | 1056161 | 1054611 | −3 | 1551 |
| P3.orf0894 | stan | VCBS | 1059657 | 1056286 | −1 | 3372 |
| P3.orf0895 | Fat4 | Putative Ig domain family | 1076476 | 1059644 | −2 | 16833 |
| P3.orf0896 | | conserved hypothetical protein | 1082145 | 1076527 | −1 | 5619 |
| P3.orf0897 | | conserved hypothetical protein | 1082623 | 1082946 | 1 | 324 |
| P3.orf0898 | | Tail Collar domain protein | 1082954 | 1083649 | 2 | 696 |
| P3.orf0899 | | tail collar domain-containing protein | 1083750 | 1084343 | 3 | 594 |
| P3.orf0900 | | phage tail collar domain-containing protein | 1084375 | 1084974 | 1 | 600 |
| P3.orf0901 | | phage tail collar domain-containing protein | 1085296 | 1085622 | 1 | 327 |
| P3.orf0902 | | peptidase M50 | 1088761 | 1086569 | −2 | 2193 |
| P3.orf0903 | mdtA | Multidrug resistance protein mdtA | 1090330 | 1088765 | −2 | 1566 |
| P3.orf0904 | | conserved hypothetical protein | 1091271 | 1090327 | −1 | 945 |
| P3.orf0905 | | conserved hypothetical protein | 1092302 | 1091397 | −3 | 906 |
| P3.orf0906 | sam | S-adenosylmethionine uptake transporter | 1092538 | 1093491 | 1 | 954 |
| P3.orf0907 | yodQ | acetylornithine deacetylase or succinyl-diaminopimelate desuccinylase | 1093542 | 1094795 | 3 | 1254 |
| P3.orf0908 | | conserved hypothetical protein | 1095826 | 1095146 | −2 | 681 |
| P3.orf0909 | ydjG | aldo/keto reductase | 1096797 | 1095826 | −1 | 972 |
| P3.orf0910 | | membrane protein | 1097557 | 1096910 | −2 | 648 |
| P3.orf0911 | | hypothetical protein | 1097741 | 1097571 | −3 | 171 |
| P3.orf0912 | | hypothetical protein | 1098183 | 1097731 | −1 | 453 |
| P3.orf0913 | fabG | short-chain dehydrogenase/reductase SDR | 1099050 | 1098265 | −1 | 786 |

| Locus | Gene | Product | Start | End | Strand | Length |
|---|---|---|---|---|---|---|
| P3.orf0914 | linX | short-chain dehydrogenase/reductase SDR | 1099871 | 1099077 | −3 | 795 |
| P3.orf0915 | yiaN | DctM9 | 1101186 | 1099900 | −1 | 1287 |
| P3.orf0916 | | DctQ9 | 1101722 | 1101183 | −3 | 540 |
| P3.orf0917 | siaP | TRAP dicarboxylate transporter, DctP subunit | 1102788 | 1101802 | −1 | 987 |
| P3.orf0918 | | hypothetical protein | 1103201 | 1103016 | −3 | 186 |
| P3.orf0919 | fixI | cation transport ATPase | 1105679 | 1103229 | −3 | 2451 |
| P3.orf0920 | | nitrogen fixation protein fixH | 1106284 | 1105700 | −2 | 585 |
| P3.orf0921 | fixG | nitrogen fixation protein fixG | 1107868 | 1106360 | −2 | 1509 |
| P3.orf0922 | petJ | cytochrome-c oxidase fixP | 1108809 | 1107940 | −1 | 870 |
| P3.orf0923 | | cytochrome-c oxidase FixO2 | 1109728 | 1109003 | −2 | 726 |
| P3.orf0924 | fixN | cbb3-type cytochrome c oxidase subunit I | 1111223 | 1109733 | −3 | 1491 |
| P3.orf0925 | | hypothetical protein | 1111513 | 1111256 | −2 | 258 |
| P3.orf0926 | | conserved hypothetical protein | 1111787 | 1112620 | 2 | 834 |
| P3.orf0927 | | hypothetical protein | 1112860 | 1112642 | −2 | 219 |
| P3.orf0928 | livF | ABC transporter ATP-binding protein | 1113652 | 1112957 | −2 | 696 |
| P3.orf0929 | livG | ABC transporter ATP-binding protein | 1114401 | 1113649 | −1 | 753 |
| P3.orf0930 | | ABC transporter permease protein | 1115462 | 1114398 | −3 | 1065 |
| P3.orf0931 | livH | inner-membrane translocator | 1116426 | 1115491 | −1 | 936 |
| P3.orf0932 | | Extracellular ligand-binding receptor | 1117676 | 1116489 | −3 | 1188 |
| P3.orf0933 | | transcriptional regulator, AsnC family protein | 1118010 | 1117768 | −1 | 243 |
| P3.orf0934 | | conserved hypothetical protein | 1119103 | 1119681 | 1 | 579 |
| P3.orf0935 | | GCN5-related N-acetyltransferase | 1119806 | 1121011 | 2 | 1206 |
| P3.orf0936 | lysX | RimK domain protein ATP-grasp | 1121016 | 1122521 | 3 | 1506 |
| P3.orf0937 | yncD | putative TonB-dependent receptor protein | 1122565 | 1124988 | 1 | 2424 |
| P3.orf0938 | | transcriptional regulator | 1125283 | 1124993 | −2 | 291 |
| P3.orf0939 | | addiction module killer protein | 1125581 | 1125276 | −3 | 306 |
| P3.orf0940 | | thioesterase superfamily protein | 1126135 | 1125626 | −2 | 510 |
| P3.orf0941 | menE | O-succinylbenzoate--CoA ligase | 1126640 | 1126176 | −3 | 465 |
| P3.orf0942 | fadD | AMP-dependent synthetase and ligase | 1126818 | 1126660 | −1 | 159 |
| P4.orf0001 | hcpC | Putative beta-lactamase hcpC | 1 | 1233 | 1 | 1233 |
| P4.orf0002 | | rifampin ADP-ribosylating transferase | 1724 | 1275 | −3 | 450 |
| P4.orf0003 | | conserved hypothetical protein | 2205 | 1702 | −1 | 504 |
| P4.orf0004 | | ThiJ/PfpI | 3391 | 2255 | −2 | 1137 |
| P4.orf0005 | glxA | transcriptional regulator, AraC family | 3495 | 4505 | 3 | 1011 |
| P4.orf0006 | pleC | Signal transduction histidine kinase | 6703 | 4697 | −2 | 2007 |
| P4.orf0007 | | putative endonuclease involved in recombination | 7431 | 6823 | −1 | 609 |
| P4.orf0008 | gatC | aspartyl/glutamyl-tRNA(Asn/Gln) amidotransferase subunit C | 7647 | 7934 | 3 | 288 |
| P4.orf0009 | gatA | aspartyl/glutamyl-tRNA(Asn/Gln) amidotransferase subunit A | 7931 | 9433 | 2 | 1503 |
| P4.orf0010 | gatB | aspartyl-tRNA(Asn)/glutamyl-tRNA (Gln) amidotransferase subunit B | 9430 | 10881 | 1 | 1452 |
| P4.orf0011 | | hypothetical protein | 11112 | 11450 | 3 | 339 |
| P4.orf0012 | | Putative lipoprotein | 11505 | 12014 | 3 | 510 |
| P4.orf0013 | yafP | N-acetyltransferase yafP | 12042 | 12503 | 3 | 462 |
| P4.orf0014 | | CopG family DNA-binding protein | 12528 | 12803 | 3 | 276 |
| P4.orf0015 | | hypothetical protein | 13120 | 12971 | −2 | 150 |
| P4.orf0016 | | toxin complex protein | 13164 | 20768 | 3 | 7605 |
| P4.orf0017 | metI | binding-protein-dependent transport systems inner membrane component | 21511 | 20828 | −2 | 684 |
| P4.orf0018 | metN | D-methionine transport system ATP-binding protein | 22577 | 21495 | −3 | 1083 |
| P4.orf0019 | ygcF | 7-carboxy-7-deazaguanine synthase homolog | 22800 | 23543 | 3 | 744 |
| P4.orf0020 | queD | putative 6-pyruvoyl tetrahydropterin synthase | 23543 | 23929 | 2 | 387 |
| P4.orf0021 | queC | exsB protein | 23926 | 24669 | 1 | 744 |
| P4.orf0022 | | 23S rRNA methyltransferase | 24686 | 25204 | 2 | 519 |
| P4.orf0023 | menE | AMP-dependent synthetase and ligase | 26973 | 25480 | −1 | 1494 |
| P4.orf0024 | fadR | transcriptional regulator AcrR family | 27670 | 27053 | −2 | 618 |
| P4.orf0025 | | conserved hypothetical protein | 28000 | 28827 | 1 | 828 |
| P4.orf0026 | | putative Rossmann fold nucleotide-binding protein | 29784 | 30428 | 3 | 645 |
| P4.orf0027 | glpR | transcriptional regulator | 29699 | 28854 | −3 | 846 |
| P4.orf0028 | phnV | ABC transporter permease protein | 30599 | 31381 | 2 | 783 |
| P4.orf0029 | potA | ABC transporter ATP-binding protein | 31392 | 32417 | 3 | 1026 |
| P4.orf0030 | | spermidine/putrescine transport system substrate-binding protein | 32495 | 33592 | 2 | 1098 |
| P4.orf0031 | potB | Spermidine/putrescine transport system permease protein | 33705 | 34526 | 3 | 822 |
| P4.orf0032 | siaP | TRAP-type bacterial extracellular solute-binding protein | 35753 | 34626 | −3 | 1128 |
| P4.orf0033 | siaT | TrapT family protein | 37113 | 35791 | −1 | 1323 |
| P4.orf0034 | | Tripartite ATP-independent periplasmic | 37598 | 37110 | −3 | 489 |
| P4.orf0035 | glpR | putative transcriptional regulator | 38445 | 37690 | −1 | 756 |
| P4.orf0036 | | oxidoreductase, FAD-binding protein | 38634 | 40082 | 3 | 1449 |
| P4.orf0037 | ooxA | Opine oxidase subunit A | 40100 | 41329 | 2 | 1230 |
| P4.orf0038 | glpK | glycerol kinase | 41326 | 42756 | 1 | 1431 |

-continued

| Locus | Gene | Product | Start | End | Strand | Length |
|---|---|---|---|---|---|---|
| P4.orf0039 | | conserved hypothetical protein | 43607 | 42732 | −3 | 876 |
| P4.orf0040 | | hypothetical protein | 43635 | 43880 | 3 | 246 |
| P4.orf0041 | citE | Citrate lyase | 44886 | 43918 | −1 | 969 |
| P4.orf0042 | puuR | XRE family-like protein | 45473 | 44883 | −3 | 591 |
| P4.orf0043 | artJ | ABC-type amino acid transport | 45870 | 46616 | 3 | 747 |
| P4.orf0044 | glnM | amino acid ABC transporter permease protein | 46777 | 47400 | 1 | 624 |
| P4.orf0045 | tcyC | amino acid ABC transporter ATP-binding protein | 47397 | 48128 | 3 | 732 |
| P4.orf0046 | puuB | FAD dependent oxidoreductase | 48489 | 49658 | 3 | 1170 |
| P4.orf0047 | | putative bleomycin resistance protein | 50018 | 49659 | −3 | 360 |
| P4.orf0048 | fhuC | ABC transporter related protein | 50845 | 50063 | −2 | 783 |
| P4.orf0049 | yojI | pyoverdine biosynthesis protein PvdE | 52485 | 50845 | −1 | 1641 |
| P4.orf0050 | viuB | FAD-binding 9 siderophore-interacting domain-containing protein | 53240 | 52482 | −3 | 759 |
| P4.orf0051 | fhuB | transport system permease protein | 55216 | 53237 | −2 | 1980 |
| P4.orf0052 | fhuD | iron complex transport system substrate-binding protein | 56103 | 55213 | −1 | 891 |
| P4.orf0053 | foxA | putative TonB-dependent receptor | 58628 | 56106 | −3 | 2523 |
| P4.orf0054 | fecR | FecR protein | 59723 | 58737 | −3 | 987 |
| P4.orf0055 | sigW | DNA-directed RNA polymerase specialized sigma subunit | 60330 | 59815 | −1 | 516 |
| P4.orf0056 | | conserved hypothetical protein | 60860 | 60522 | −3 | 339 |
| P4.orf0057 | | conserved hypothetical protein | 61234 | 62583 | 1 | 1350 |
| P4.orf0058 | | mrp protein | 63861 | 62650 | −1 | 1212 |
| P4.orf0059 | hflK | HflK protein | 64296 | 65366 | 3 | 1071 |
| P4.orf0060 | hflC | membrane protease subunit HflC | 65385 | 66287 | 3 | 903 |
| P4.orf0061 | | conserved hypothetical protein | 66495 | 66776 | 3 | 282 |
| P4.orf0062 | | conserved hypothetical protein | 67990 | 68175 | 1 | 186 |
| P4.orf0063 | degP | Peptidase S1C, Do | 68267 | 69739 | 2 | 1473 |
| P4.orf0064 | tas | aldo/keto reductase | 67819 | 66809 | −2 | 1011 |
| P4.orf0065 | | phosphoserine phosphatase SerB | 70742 | 69825 | −3 | 918 |
| P4.orf0066 | miaA | tRNA delta(2)-isopentenylpyrophosphate transferase | 70814 | 71782 | 2 | 969 |
| P4.orf0067 | ilvI | acetolactate synthase, large subunit | 72021 | 73772 | 3 | 1752 |
| P4.orf0068 | ilvH | acetolactate synthase 3 regulatory subunit | 73882 | 74418 | 1 | 537 |
| P4.orf0069 | ilvC | ketol-acid reductoisomerase | 74480 | 75607 | 2 | 1128 |
| P4.orf0070 | yfkH | ribonuclease BN | 75627 | 76763 | 3 | 1137 |
| P4.orf0071 | | conserved hypothetical protein | 77386 | 76790 | −2 | 597 |
| P4.orf0072 | | conserved hypothetical protein | 77913 | 77488 | −1 | 426 |
| TM.orf0001 | dnaA | chromosomal replication initiation protein | 1 | 1578 | 1 | 1578 |
| TM.orf0002 | dnaN | DNA polymerase III subunit beta | 1786 | 2907 | 1 | 1122 |
| TM.orf0003 | recF | recombination protein F | 2904 | 4169 | 2 | 1266 |
| TM.orf0004 | gyrB | DNA gyrase subunit B | 4183 | 6687 | 1 | 2505 |
| TM.orf0005 | | putative transcription regulator protein | 6772 | 6981 | 1 | 210 |
| TM.orf0006 | | conserved hypothetical protein | 6978 | 7244 | 2 | 267 |
| TM.orf0007 | ygiD | Catalytic LigB subunit of aromatic ring-opening dioxygenase | 8093 | 7278 | −2 | 816 |
| TM.orf0008 | pbpG | penicillin binding protein | 8240 | 10417 | 3 | 2178 |
| TM.orf0009 | bcr | drug resistance transporter, Bcr/CflA subfamily | 11649 | 10429 | −1 | 1221 |
| TM.orf0010 | citA | Citrate (Si)-synthase | 12169 | 13266 | 1 | 1098 |
| TM.orf0011 | | conserved hypothetical protein | 14238 | 13351 | −1 | 888 |
| TM.orf0012 | | 2-amino-3-carboxymuconate-6-semialdehyde decarboxylase | 15546 | 14329 | −1 | 1218 |
| TM.orf0013 | leuA | pyruvate carboxyltransferase | 16189 | 17394 | 1 | 1206 |
| TM.orf0014 | | Pc06g00060 | 17400 | 18092 | 2 | 693 |
| TM.orf0015 | | CADD protein | 18203 | 18883 | 3 | 681 |
| TM.orf0016 | potC | binding-protein-dependent transport systems inner membrane component | 19730 | 18945 | −2 | 786 |
| TM.orf0017 | potH | binding-protein-dependent transport systems inner membrane component | 20912 | 19737 | −2 | 1176 |
| TM.orf0018 | potA | putative spermidine/putrescine ABC transporter, ATP-binding protein | 21979 | 20909 | −3 | 1071 |
| TM.orf0019 | | spermidine/putrescine-binding periplasmic protein | 23147 | 22092 | −2 | 1056 |
| TM.orf0020 | | ABC-2 type transporter | 24256 | 23381 | −3 | 876 |
| TM.orf0021 | nodI | ABC transporter related protein | 25005 | 24253 | −1 | 753 |
| TM.orf0022 | | conserved hypothetical protein | 25155 | 25655 | 2 | 501 |
| TM.orf0023 | regB | two-component sensor histidine kinase | 25652 | 27001 | 3 | 1350 |
| TM.orf0024 | regA | photosynthetic apparatus regulatory protein RegA | 27055 | 27645 | 1 | 591 |
| TM.orf0025 | yneP | thioesterase family protein | 27784 | 28308 | 1 | 525 |
| TM.orf0026 | mprA | two component transcriptional regulator, winged helix family | 29239 | 28325 | −3 | 915 |
| TM.orf0027 | argD | acetylornithine and succinylornithine aminotransferase | 29533 | 30732 | 1 | 1200 |
| TM.orf0028 | argF | ornithine carbamoyltransferase | 30729 | 31256 | 2 | 528 |
| TM.orf0029 | argF | ornithine carbamoyltransferase | 31267 | 31704 | 1 | 438 |

-continued

| Locus | Gene | Product | Start | End | Strand | Length |
|---|---|---|---|---|---|---|
| TM.orf0030 | hslO | molecular chaperone Hsp33 | 31701 | 32687 | 2 | 987 |
| TM.orf0031 | | Acyl-CoA synthetases (AMP-forming)/AMP-acid ligases II | 32743 | 33399 | 1 | 657 |
| TM.orf0032 | gylR | IclR family regulatory protein | 33543 | 34448 | 2 | 906 |
| TM.orf0033 | menC | N-acylamino acid racemase | 35583 | 34474 | −1 | 1110 |
| TM.orf0034 | | beta-lactamase | 37011 | 35704 | −1 | 1308 |
| TM.orf0035 | nudF | adp-ribose pyrophosphatase | 37620 | 37156 | −1 | 465 |
| TM.orf0036 | | TetR family transcriptional regulator | 38271 | 37663 | −1 | 609 |
| TM.orf0037 | crp | transcriptional regulator | 38805 | 39485 | 2 | 681 |
| TM.orf0038 | fixR | halohydrin epoxidase A | 39570 | 40316 | 2 | 747 |
| TM.orf0039 | | hypothetical protein | 40712 | 40512 | −2 | 201 |
| TM.orf0040 | | secretion activator protein | 41274 | 40729 | −1 | 546 |
| TM.orf0041 | | hypothetical protein | 41399 | 41271 | −2 | 129 |
| TM.orf0042 | | putative tail fiber protein | 43942 | 41588 | −3 | 2355 |
| TM.orf0043 | | conserved hypothetical protein | 46922 | 43947 | −2 | 2976 |
| TM.orf0044 | | conserved hypothetical protein | 49201 | 46919 | −3 | 2283 |
| TM.orf0045 | | conserved hypothetical protein | 52092 | 49198 | −1 | 2895 |
| TM.orf0046 | | hypothetical protein | 52646 | 52092 | −2 | 555 |
| TM.orf0047 | | conserved hypothetical protein | 54580 | 52646 | −3 | 1935 |
| TM.orf0048 | | conserved hypothetical protein | 55198 | 54584 | −3 | 615 |
| TM.orf0049 | | hypothetical protein | 55520 | 55203 | −2 | 318 |
| TM.orf0050 | | conserved hypothetical protein | 56404 | 55535 | −3 | 870 |
| TM.orf0051 | | hypothetical protein | 57586 | 56708 | −3 | 879 |
| TM.orf0052 | | hypothetical protein | 57893 | 57606 | −2 | 288 |
| TM.orf0053 | | conserved hypothetical protein | 59500 | 57890 | −3 | 1611 |
| TM.orf0054 | | conserved hypothetical protein | 60285 | 59713 | −1 | 573 |
| TM.orf0055 | | conserved hypothetical protein | 61524 | 60295 | −1 | 1230 |
| TM.orf0056 | | conserved hypothetical protein | 62297 | 61770 | −2 | 528 |
| TM.orf0057 | | DNA primase | 64465 | 62915 | −3 | 1551 |
| TM.orf0058 | | conserved hypothetical protein | 65855 | 64749 | −2 | 1107 |
| TM.orf0059 | | hypothetical protein | 65984 | 66289 | 3 | 306 |
| TM.orf0060 | | hypothetical protein | 66645 | 66322 | −1 | 324 |
| TM.orf0061 | | conserved hypothetical protein | 66920 | 66645 | −2 | 276 |
| TM.orf0062 | | hypothetical protein | 67428 | 67204 | −1 | 225 |
| TM.orf0063 | | conserved hypothetical protein | 67775 | 67425 | −2 | 351 |
| TM.orf0064 | | hypothetical protein | 68454 | 68194 | −1 | 261 |
| TM.orf0065 | | conserved hypothetical protein | 68687 | 68451 | −2 | 237 |
| TM.orf0066 | | hypothetical protein | 69642 | 69863 | 2 | 222 |
| TM.orf0067 | | hypothetical protein | 69856 | 70269 | 1 | 414 |
| TM.orf0068 | | conserved hypothetical protein | 70675 | 71391 | 1 | 717 |
| TM.orf0069 | | hypothetical protein | 71388 | 71807 | 2 | 420 |
| TM.orf0070 | | hypothetical protein | 71804 | 72085 | 3 | 282 |
| TM.orf0071 | | hypothetical protein | 72105 | 72434 | 2 | 330 |
| TM.orf0072 | | hypothetical protein | 72421 | 72678 | 1 | 258 |
| TM.orf0073 | | hypothetical protein | 72678 | 72995 | 2 | 318 |
| TM.orf0074 | | phage integrase family protein | 72995 | 74203 | 3 | 1209 |
| TM.orf0075 | | hypothetical protein | 74694 | 74437 | −1 | 258 |
| TM.orf0076 | | hypothetical protein | 75004 | 75219 | 1 | 216 |
| TM.orf0077 | | hypothetical protein | 75230 | 75640 | 3 | 411 |
| TM.orf0078 | | conserved hypothetical protein | 75646 | 75903 | 1 | 258 |
| TM.orf0079 | | L-lactate permease | 77675 | 76167 | −2 | 1509 |
| TM.orf0080 | | hypothetical protein | 77831 | 79300 | 3 | 1470 |
| TM.orf0081 | fh | fumarate hydratase, class II | 80821 | 79415 | −3 | 1407 |
| TM.orf0082 | | HemY protein | 82392 | 80995 | −1 | 1398 |
| TM.orf0083 | | conserved hypothetical protein | 83888 | 82389 | −2 | 1500 |
| TM.orf0084 | hemD | uroporphyrinogen III synthase HEM4 | 84784 | 84008 | −3 | 777 |
| TM.orf0085 | HEMC | Porphobilinogen deaminase, chloroplastic | 85834 | 84845 | −3 | 990 |
| TM.orf0086 | gcp | O-sialoglycoprotein endopeptidase | 85940 | 87097 | 3 | 1158 |
| TM.orf0097 | | conserved hypothetical protein | 88155 | 87109 | −1 | 1047 |
| TM.orf0088 | | conserved hypothetical protein | 89324 | 88152 | −2 | 1173 |
| TM.orf0089 | | conserved hypothetical protein | 90512 | 89349 | −2 | 1164 |
| TM.orf0090 | | transmembrane protein | 91469 | 90630 | −2 | 840 |
| TM.orf0091 | | NmrA-like protein | 92583 | 91600 | −1 | 984 |
| TM.orf0092 | ycil | YCII-related protein | 92841 | 93125 | 2 | 285 |
| TM.orf0093 | | Thymocyte nuclear protein | 93147 | 93566 | 2 | 420 |
| TM.orf0094 | petC | Rieske | 93568 | 93927 | 1 | 360 |
| TM.orf0095 | acsA | acetyl-coenzyme A synthetase | 94040 | 95998 | 3 | 1959 |
| TM.orf0096 | | GMC oxidoreductase | 97714 | 96806 | −3 | 909 |
| TM.orf0097 | | hypothetical protein | 98517 | 98398 | −1 | 120 |
| TM.orf0098 | | conserved hypothetical protein | 99271 | 98888 | −3 | 384 |
| TM.orf0099 | | conserved hypothetical protein | 99605 | 99426 | −2 | 180 |
| TM.orf0100 | htpX | heat shock protein HtpX | 99762 | 100673 | 2 | 912 |
| TM.orf0101 | rsmB | Sun protein | 100681 | 102306 | 1 | 1626 |
| TM.orf0102 | rpe | ribulose-phosphate 3-epimerase | 102358 | 103083 | 1 | 726 |
| TM.orf0103 | | conserved hypothetical protein | 103162 | 105234 | 1 | 2073 |
| TM.orf0104 | rrf2 | FeS assembly SUF system regulator | 105385 | 105822 | 1 | 438 |
| TM.orf0105 | | FeS assembly protein SufB | 105949 | 107394 | 1 | 1446 |

| Locus | Gene | Product | Start | End | Strand | Length |
|---|---|---|---|---|---|---|
| TM.orf0106 | sufC | FeS assembly ATPase SufC | 107488 | 108246 | 1 | 759 |
| TM.orf0107 | | FeS assembly protein SufD | 108251 | 109600 | 3 | 1350 |
| TM.orf0108 | sufS | cysteine desulfurase, SufS subfamily | 109597 | 110844 | 1 | 1248 |
| TM.orf0109 | nifU | NifU family SUF system FeS assembly protein | 110856 | 111359 | 2 | 504 |
| TM.orf0110 | yitW | conserved hypothetical protein | 111435 | 111776 | 2 | 342 |
| TM.orf0111 | | conserved hypothetical protein | 111898 | 112584 | 1 | 687 |
| TM.orf0112 | mhqR | transcriptional regulator, MarR family | 112665 | 113168 | 2 | 504 |
| TM.orf0113 | | conserved hypothetical protein | 113153 | 113515 | 3 | 363 |
| TM.orf0114 | ydfH | transcriptional regulatory protein | 114188 | 113553 | −2 | 636 |
| TM.orf0115 | | choline/carnitine/betaine transporter | 116182 | 114206 | −3 | 1977 |
| TM.orf0116 | | hypothetical protein | 116447 | 116590 | 3 | 144 |
| TM.orf0117 | ybbK | conserved hypothetical protein | 117109 | 116603 | −3 | 507 |
| TM.orf0118 | meaA | methylmalonyl-CoA mutase | 119139 | 117109 | −1 | 2031 |
| TM.orf0119 | | crotonyl-CoA reductase | 119561 | 120847 | 3 | 1287 |
| TM.orf0120 | yngJ | Acyl-CoA dehydrogenase | 121098 | 122777 | 2 | 1680 |
| TM.orf0121 | | hypothetical protein | 122896 | 123093 | 1 | 198 |
| TM.orf0122 | | ATP: cob(I)alamin adenosyltransferase | 123188 | 123763 | 3 | 576 |
| TM.orf0123 | etfB | Electron transfer flavoprotein, beta subunit | 124053 | 124802 | 2 | 750 |
| TM.orf0124 | etfA | electron transfer flavoprotein alpha subunit | 124805 | 125737 | 3 | 933 |
| TM.orf0125 | hbdA | 3-hydroxyacyl-CoA dehydrogenase | 125872 | 126744 | 1 | 873 |
| TM.orf0126 | | Thiol: disulfide interchange protein TlpA | 127403 | 126807 | −2 | 597 |
| TM.orf0127 | argH | argininosuccinate lyase | 127533 | 128948 | 2 | 1416 |
| TM.orf0128 | lysA | diaminopimelate decarboxylase | 129193 | 130452 | 1 | 1260 |
| TM.orf0129 | | hypoxanthine phosphoribosyltransferase | 131105 | 130545 | −2 | 543 |
| TM.orf0130 | | conserved hypothetical protein | 131816 | 131157 | −2 | 660 |
| TM.orf0131 | ftsE | putative ATPase involved in cell division | 132046 | 132810 | 1 | 765 |
| TM.orf0132 | | cell division protein | 132807 | 133694 | 2 | 888 |
| TM.orf0133 | | conserved hypothetical protein | 133763 | 134383 | 3 | 621 |
| TM.orf0134 | | phospholipid/glycerol acyltransferase | 134380 | 135102 | 1 | 723 |
| TM.orf0135 | yigI | thioesterase superfamily protein | 135712 | 135278 | −3 | 435 |
| TM.orf0136 | | thioesterase superfamily protein | 136197 | 135709 | −1 | 489 |
| TM.orf0137 | chaC | Cation transport protein chaC | 136860 | 136246 | −1 | 615 |
| TM.orf0138 | | conserved hypothetical protein | 137089 | 138096 | 1 | 1008 |
| TM.orf0139 | tyrC | cyclohexadienyl dehydrogenase | 139029 | 138133 | −1 | 897 |
| TM.orf0140 | hisC | histidinol-phosphate aminotransferase | 140208 | 139108 | −1 | 1101 |
| TM.orf0141 | pheA | chorismate mutase | 141267 | 140347 | −1 | 921 |
| TM.orf0142 | metX | homoserine O-acetyltransferase | 141696 | 142784 | 2 | 1089 |
| TM.orf0143 | | putative methionine biosynthesis protein (MetW) | 142781 | 143473 | 3 | 693 |
| TM.orf0144 | pleC | non-motile and phage-resistance protein | 144628 | 143483 | −3 | 1146 |
| TM.orf0145 | yiaO | TRAP dicarboxylate transporter, DctP subunit | 145134 | 146123 | 2 | 990 |
| TM.orf0146 | | tripartite ATP-independent periplasmic transporter DctQ | 146223 | 146735 | 2 | 513 |
| TM.orf0147 | | TRAP dicarboxylate transporter, DctM subunit | 146752 | 148017 | 1 | 1266 |
| TM.orf0148 | | SAM-dependent methyltransferases | 148765 | 147989 | −3 | 777 |
| TM.orf0149 | gloB | metallo-beta-lactamase family protein | 148965 | 149744 | 2 | 780 |
| TM.orf0150 | yibF | Glutathione S-transferase | 149898 | 150503 | 2 | 606 |
| TM.orf0151 | | hypothetical protein | 150954 | 150544 | −1 | 411 |
| TM.orf0152 | | conserved hypothetical protein | 151812 | 151060 | −1 | 753 |
| TM.orf0153 | phbB | acetoacetyl-CoA reductase | 152634 | 151909 | −1 | 726 |
| TM.orf0154 | phaA | acetyl-CoA acetyltransferase | 153993 | 152821 | −1 | 1173 |
| TM.orf0155 | phbC | polyhydroxyalkanoate synthase | 155401 | 154136 | −3 | 1266 |
| TM.orf0156 | | polyhydroxyalkanoate synthesis repressor PhaR | 156093 | 156713 | 2 | 621 |
| TM.orf0157 | | conserved hypothetical protein | 157735 | 156914 | −3 | 822 |
| TM.orf0158 | arcB | PAS/PAC sensor hybrid histidine kinase | 161874 | 157891 | −1 | 3984 |
| TM.orf0159 | | hypothetical protein | 162127 | 162324 | 1 | 198 |
| TM.orf0160 | | ABC superfamily ATP binding cassette transporter, binding protein | 162639 | 163628 | 2 | 990 |
| TM.orf0161 | | ABC-type transport system, permease component | 164038 | 164925 | 1 | 888 |
| TM.orf0162 | | Cobalt import ATP-binding protein cbiO 2 | 164944 | 165738 | 1 | 795 |
| TM.orf0163 | | NUDIX hydrolase | 165845 | 166438 | 3 | 594 |
| TM.orf0164 | | NHL repeat-containing protein | 166621 | 168297 | 1 | 1677 |
| TM.orf0165 | ispZ | intracellular septation protein | 168936 | 168310 | −1 | 627 |
| TM.orf0166 | ftsY | Signal recognition particle GTPase | 169885 | 168941 | −3 | 945 |
| TM.orf0167 | | MiaB-like tRNA modifying enzyme | 171300 | 169882 | −1 | 1419 |
| TM.orf0168 | dapF | diaminopimelate epimerase | 172243 | 171332 | −3 | 912 |
| TM.orf0169 | divL | sensor protein divL | 174357 | 172282 | −1 | 2076 |
| TM.orf0170 | ahcY | S-adenosyl-L-homocysteine hydrolase | 175792 | 174497 | −3 | 1296 |
| TM.orf0171 | ptsH | phosphocarrier protein HPr | 176294 | 175995 | −2 | 300 |
| TM.orf0172 | manX | PTS system, IIA component | 176722 | 176315 | −3 | 408 |
| TM.orf0173 | | 3448_RHORT RecName: Full = UPF0042 nucleotide-binding protein Rru_A3448 | 177782 | 176838 | −2 | 945 |
| TM.orf0174 | hprK | HPr kinase | 178240 | 177779 | −3 | 462 |
| TM.orf0175 | ptsN | phosphotransferase system mannitol/fructose-specific IIA domain-containing protein | 178760 | 178296 | −2 | 465 |

-continued

| Locus | Gene | Product | Start | End | Strand | Length |
|---|---|---|---|---|---|---|
| TM.orf0176 | | sigma 54 modulation protein | 179526 | 178927 | −1 | 600 |
| TM.orf0177 | | RNA polymerase factor sigma-54 | 181269 | 179695 | −1 | 1575 |
| TM.orf0178 | | ABC transporter, ATP-binding protein | 182080 | 181280 | −3 | 801 |
| TM.orf0179 | | conserved hypothetical protein | 182789 | 182148 | −2 | 642 |
| TM.orf0180 | | lipopolysaccharide export system protein LptC | 183433 | 182804 | −3 | 630 |
| TM.orf0181 | | Predicted sugar phosphate isomerase involved in capsule formation | 184530 | 183538 | −1 | 993 |
| TM.orf0182 | rnd | 3'-5' exonuclease | 185288 | 184677 | −2 | 612 |
| TM.orf0183 | | NADH-ubiquinone oxidoreductase 39 kDa subunit precursor | 185536 | 186507 | 1 | 972 |
| TM.orf0184 | gltD | putative oxidoreductase | 187193 | 188638 | 3 | 1446 |
| TM.orf0185 | gltB | glutamate synthase(NADPH) large subunit | 188662 | 193212 | 1 | 4551 |
| TM.orf0186 | gdhA | Glu/Leu/Phe/Val dehydrogenase | 193479 | 194759 | 2 | 1281 |
| TM.orf0187 | | RarD protein | 194918 | 195850 | 3 | 933 |
| TM.orf0188 | | glutathione S-transferase | 195862 | 196530 | 1 | 669 |
| TM.orf0189 | yjeS | putative iron-sulfur cluster binding protein | 196511 | 197725 | 3 | 1215 |
| TM.orf0190 | yeeZ | NAD-dependent epimerase/dehydratase | 197722 | 198687 | 1 | 966 |
| TM.orf0191 | | ABC transporter, ATP-binding protein | 200274 | 198694 | −1 | 1581 |
| TM.orf0192 | | hydrolase | 201221 | 200403 | −2 | 819 |
| TM.orf0193 | | Glycosyltransferase | 201550 | 202644 | 1 | 1095 |
| TM.orf0194 | rfaF | ADP-heptose of LPS heptosyltransferase | 202641 | 203612 | 2 | 972 |
| TM.orf0195 | infC | translation initiation factor IF-3 | 203868 | 204446 | 2 | 579 |
| TM.orf0196 | rpmI | 50S ribosomal protein L35 | 204715 | 204912 | 1 | 198 |
| TM.orf0197 | rplT | ribosomal protein L20 | 204999 | 205367 | 2 | 369 |
| TM.orf0198 | pheS | phenylalanyl-tRNA synthetase alpha chain | 205622 | 206701 | 3 | 1080 |
| TM.orf0199 | pheT | phenylalanyl-tRNA synthetase beta chain | 206718 | 209126 | 2 | 2409 |
| TM.orf0200 | cyaA | putative adenylate cyclase | 209411 | 210817 | 3 | 1407 |
| TM.orf0201 | lepA | GTP-binding protein | 210967 | 212766 | 1 | 1800 |
| TM.orf0202 | | hypothetical protein | 213156 | 212833 | −1 | 324 |
| TM.orf0203 | | major facilitator superfamily MFS_1 | 214904 | 213621 | −2 | 1284 |
| TM.orf0204 | | regulatory protein ArsR | 215206 | 214874 | −3 | 333 |
| TM.orf0205 | icfA | Putative carbonic anhydrase precursor | 216181 | 215435 | −3 | 747 |
| TM.orf0206 | yxbA | conserved hypothetical protein | 216380 | 216661 | 3 | 282 |
| TM.orf0207 | | GCN5-related N-acetyltransferase | 216787 | 217368 | 1 | 582 |
| TM.orf0208 | | conserved hypothetical protein | 217661 | 217350 | −2 | 312 |
| TM.orf0209 | | microcystin-dependent protein | 218298 | 218855 | 2 | 558 |
| TM.orf0210 | | putative microcystin dependent protein | 218946 | 219497 | 2 | 552 |
| TM.orf0211 | | tail collar domain-containing protein | 219511 | 220071 | 1 | 561 |
| TM.orf0212 | | cytochrome B561 | 220281 | 220988 | 2 | 708 |
| TM.orf0213 | | cytochrome C | 221508 | 221068 | −1 | 441 |
| TM.orf0214 | mcp4 | Pmethyl-accepting chemotaxis receptor/sensory transducer | 222175 | 223602 | 1 | 1428 |
| TM.orf0215 | dadA | D-amino acid dehydrogenase small subunit | 224981 | 223725 | −2 | 1257 |
| TM.orf0216 | dadB | putative alanine racemase, catabolic | 226230 | 225064 | −1 | 1167 |
| TM.orf0217 | | Leucine-responsive regulatory protein | 226382 | 226843 | 3 | 462 |
| TM.orf0218 | linC | UcpA protein | 226937 | 227698 | 3 | 762 |
| TM.orf0219 | ydeE | transcriptional regulatory protein | 228561 | 227701 | −1 | 861 |
| TM.orf0220 | | conserved hypothetical protein | 228712 | 229140 | 1 | 429 |
| TM.orf0221 | htr5 | methyl-accepting chemotaxis protein | 230871 | 229171 | −1 | 1701 |
| TM.orf0222 | ydhC | drug resistance transporter, Bcr/CflA subfamily | 232207 | 230993 | −3 | 1215 |
| TM.orf0223 | | short-chain dehydrogenase/reductase SDR | 233060 | 232257 | −2 | 804 |
| TM.orf0224 | | 2-oxoglutarate and iron-dependent oxygenase domain-containing protein 1 | 233851 | 233171 | −3 | 681 |
| TM.orf0225 | mmgC | putative acyl-CoA dehydrogenase | 234531 | 235685 | 2 | 1155 |
| TM.orf0226 | lcfB | Acyl-CoA synthetase/AMP-acid ligase II | 235682 | 237250 | 3 | 1569 |
| TM.orf0227 | sam | S-adenosylmethionine uptake transporter | 238234 | 237323 | −3 | 912 |
| TM.orf0228 | | possible acetyltransferase | 238800 | 238231 | −1 | 570 |
| TM.orf0229 | Cml2 | chemotaxis sensory transducer | 238976 | 241060 | 3 | 2085 |
| TM.orf0230 | ileS | Isoleucyl-tRNA synthetase | 241390 | 242553 | 1 | 1164 |
| TM.orf0231 | gcvA | transcriptional regulator | 242561 | 243562 | 3 | 1002 |
| TM.orf0232 | | GDSL-like lipase/acylhydrolase | 244208 | 243579 | −2 | 630 |
| TM.orf0233 | ntcA | cAMP-binding protein - catabolite protein activator and regulatory subunit of cAMP-dependent protein kinase | 244888 | 244205 | −3 | 684 |
| TM.orf0234 | | conserved hypothetical protein | 245056 | 245658 | 1 | 603 |
| TM.orf0235 | | class II aldolase/adducin family protein | 245663 | 246508 | 3 | 846 |
| TM.orf0236 | | Carboxymethylenebutenolidase | 246645 | 247532 | 2 | 888 |
| TM.orf0237 | | Monofunctional biosynthetic peptidoglycan transglycosylase | 248200 | 247553 | −3 | 648 |
| TM.orf0238 | | Extracellular serine protease | 248526 | 255200 | 2 | 6675 |
| TM.orf0239 | | aromatic compounds catabolic protein | 255761 | 255240 | −2 | 522 |
| TM.orf0240 | mhqR | MarR family transcriptional regulator | 255862 | 256290 | 1 | 429 |
| TM.orf0241 | | putative lysine decarboxylase | 256878 | 256297 | −1 | 582 |
| TM.orf0242 | dctP | putative C4 dicarboxylate binding protein | 257203 | 258192 | 1 | 990 |
| TM.orf0243 | siaT | Tripartite ATP-independent periplasmic transporter DctQ component | 258225 | 258797 | 2 | 573 |
| TM.orf0244 | siaT | TRAP dicarboxylate transporter, DctM subunit | 258794 | 260089 | 3 | 1296 |

-continued

| Locus | Gene | Product | Start | End | Strand | Length |
|---|---|---|---|---|---|---|
| TM.orf0245 | | conserved hypothetical protein | 260423 | 260172 | −2 | 252 |
| TM.orf0246 | gcvA | LysR family transcriptional regulator | 260662 | 261588 | 1 | 927 |
| TM.orf0247 | | conserved hypothetical protein | 261623 | 262540 | 3 | 918 |
| TM.orf0248 | cysA | sulfate ABC transporter, ATPase subunit | 262652 | 263767 | 3 | 1116 |
| TM.orf0249 | yhaZ | conserved hypothetical protein | 264557 | 263808 | −2 | 750 |
| TM.orf0250 | yetL | regulatory protein, MarR | 265045 | 264554 | −3 | 492 |
| TM.orf0251 | bchO | ethyl ferulate-hydrolyzing esterase | 266038 | 265088 | −3 | 951 |
| TM.orf0252 | | FAD dependent oxidoreductase | 267555 | 266038 | −1 | 1518 |
| TM.orf0253 | | TetR family transcriptional regulator | 267715 | 268386 | 1 | 672 |
| TM.orf0254 | ybaN | Inner membrane protein ybaN | 268811 | 268383 | −2 | 429 |
| TM.orf0255 | katA | catalase | 270504 | 269020 | −1 | 1485 |
| TM.orf0256 | | 2-polyprenyl-6-methoxyphenol hydroxylase | 271822 | 270644 | −3 | 1179 |
| TM.orf0257 | | Major facilitator superfamily domain-containing protein 3 | 273069 | 271819 | −1 | 1251 |
| TM.orf0258 | fyuA | TonB-dependent receptor | 275101 | 273074 | −3 | 2028 |
| TM.orf0259 | pchR | transcriptional regulator, arac family | 275300 | 276286 | 3 | 987 |
| TM.orf0260 | | cation diffusion facilitator family transporter | 277241 | 276246 | −2 | 996 |
| TM.orf0261 | tcmP | O-methyltransferase domain-containing protein | 278163 | 277291 | −1 | 873 |
| TM.orf0262 | oxyR | hydrogen peroxide-inducible genes activator | 279196 | 278279 | −3 | 918 |
| TM.orf0263 | | hypothetical protein | 279330 | 279716 | 2 | 387 |
| TM.orf0264 | proS | prolyl-tRNA synthetase | 279842 | 281365 | 3 | 1524 |
| TM.orf0265 | | conserved hypothetical protein | 281575 | 282030 | 1 | 456 |
| TM.orf0266 | | zinc-finger protein | 282178 | 282603 | 1 | 426 |
| TM.orf0267 | ohrR | transcriptional regulator, MarR family | 282856 | 283302 | 1 | 447 |
| TM.orf0268 | ydhC | transcriptional regulator | 284050 | 283334 | −3 | 717 |
| TM.orf0269 | | class II aldolase/adducin family protein | 284230 | 285009 | 1 | 780 |
| TM.orf0270 | gsiB | ABC transporter substrate binding protein | 285156 | 286703 | 2 | 1548 |
| TM.orf0271 | appB | oligopeptide ABC transporter | 286825 | 287802 | 1 | 978 |
| TM.orf0272 | appC | ABC transporter permease protein | 287799 | 288638 | 2 | 840 |
| TM.orf0273 | gsiA | ABC transporter ATP-binding protein | 288650 | 290305 | 3 | 1656 |
| TM.orf0274 | ghrA | D-isomer specific 2-hydroxyacid dehydrogenase NAD-binding | 290302 | 291273 | 1 | 972 |
| TM.orf0275 | aphA | histone deacetylase family protein | 291313 | 292341 | 1 | 1029 |
| TM.orf0276 | | aminotransferase | 292397 | 293764 | 3 | 1368 |
| TM.orf0277 | exoT | putative succinoglycan transport protein | 294288 | 295754 | 2 | 1467 |
| TM.orf0278 | | conserved hypothetical protein | 296735 | 297058 | 3 | 324 |
| TM.orf0279 | | hypothetical protein | 297314 | 297114 | −2 | 201 |
| TM.orf0280 | | conserved hypothetical protein | 298793 | 298524 | −2 | 270 |
| TM.orf0281 | lutR | transcriptional regulator-like | 299671 | 298943 | −3 | 729 |
| TM.orf0282 | | TRAP dicarboxylate transporter, DctQ subunit | 300331 | 299783 | −3 | 549 |
| TM.orf0283 | | C4-dicarboxylate transporter | 301644 | 300337 | −1 | 1308 |
| TM.orf0284 | dctB | possible TrapT family, dctP subunit, C4-dicarboxylate periplasmic binding protein | 302889 | 301747 | −1 | 1143 |
| TM.orf0285 | | aminoglycoside phosphotransferase | 304023 | 302923 | −1 | 1101 |
| TM.orf0286 | crt | enoyl-CoA hydratase | 304211 | 305059 | 3 | 849 |
| TM.orf0287 | potI | binding-protein dependent transport system inner membrane protein | 306353 | 305532 | −2 | 822 |
| TM.orf0288 | potH | binding-protein dependent transport system inner membrane protein | 307310 | 306372 | −2 | 939 |
| TM.orf0289 | potG | putrescine transport ATP-binding protein PotG | 308592 | 307378 | −1 | 1215 |
| TM.orf0290 | potF | PotF | 309829 | 308690 | −3 | 1140 |
| TM.orf0291 | puuA | glutamine synthetase | 311504 | 310074 | −2 | 1431 |
| TM.orf0292 | dppF | putative oligopeptide ABC transporter (ATP binding protein) | 313018 | 311990 | −3 | 1029 |
| TM.orf0293 | appD | oligopeptide/dipeptide ABC transporter, ATPase subunit | 314052 | 313015 | −1 | 1038 |
| TM.orf0294 | dppC | Dipeptide transport system permease protein dppC | 315002 | 314124 | −2 | 879 |
| TM.orf0295 | | binding-protein-dependent transport systems inner membrane component | 315975 | 315019 | −1 | 957 |
| TM.orf0296 | hbpA | extracellular solute-binding protein | 317578 | 316088 | −3 | 1491 |
| TM.orf0297 | | peptidase S58 DmpA | 318724 | 317585 | −3 | 1140 |
| TM.orf0298 | glxR | 2-hydroxy-3-oxopropionate reductase | 319943 | 318963 | −2 | 981 |
| TM.orf0299 | | pyridoxamine 5′-phosphate oxidase family protein | 320088 | 320702 | 2 | 615 |
| TM.orf0300 | | conserved hypothetical protein | 321132 | 321632 | 2 | 501 |
| TM.orf0301 | proC | pyrroline-5-carboxylate reductase | 321639 | 322481 | 2 | 843 |
| TM.orf0302 | | conserved hypothetical protein | 322663 | 323526 | 1 | 864 |
| TM.orf0303 | | Carboxymethylenebutenolidase | 324313 | 323603 | −3 | 711 |
| TM.orf0304 | | conserved hypothetical protein | 324611 | 325759 | 3 | 1149 |
| TM.orf0305 | | conserved hypothetical protein | 325814 | 326329 | 3 | 516 |
| TM.orf0306 | engD | Predicted GTPase, probable translation factor | 327522 | 326422 | −1 | 1101 |
| TM.orf0307 | pth | peptidyl-tRNA hydrolase | 328177 | 327527 | −3 | 651 |
| TM.orf0308 | rplY | 50S ribosomal protein L25/general stress protein Ctc | 328797 | 328183 | −1 | 615 |
| TM.orf0309 | prs | ribose-phosphate pyrophosphokinase | 329931 | 328942 | −1 | 990 |

-continued

| Locus | Gene | Product | Start | End | Strand | Length |
|---|---|---|---|---|---|---|
| TM.orf0310 | | conserved hypothetical protein | 330683 | 330189 | −2 | 495 |
| TM.orf0311 | ade | adenine deaminase | 332662 | 330908 | −3 | 1755 |
| TM.orf0312 | | conserved hypothetical protein | 333599 | 332781 | −2 | 819 |
| TM.orf0313 | midA | conserved hypothetical protein | 334801 | 333623 | −3 | 1179 |
| TM.orf0314 | | Prolipoprotein diacylglyceryl transferase | 335616 | 334798 | −1 | 819 |
| TM.orf0315 | | protein conserved in bacteria | 335984 | 336340 | 3 | 357 |
| TM.orf0316 | | putative membrane protein | 336346 | 337263 | 1 | 918 |
| TM.orf0317 | sdpR | transcriptional regulator, ArsR family | 337414 | 338223 | 1 | 810 |
| TM.orf0318 | rpmB | ribosomal protein L28 | 338503 | 338814 | 1 | 312 |
| TM.orf0319 | | conserved hypothetical protein | 339013 | 339561 | 1 | 549 |
| TM.orf0320 | hyfR | putative PAS/PAC sensor protein | 341505 | 339562 | −1 | 1944 |
| TM.orf0321 | nrtC | putative nitrate transporter component, nrtA | 341772 | 343175 | 2 | 1404 |
| TM.orf0322 | nrtB | possible nitrate transport system permease protein | 343200 | 344030 | 2 | 831 |
| TM.orf0323 | cmpD | nitrate ABC transporter, ATPase subunits C and D | 344049 | 344954 | 2 | 906 |
| TM.orf0364 | ydhP | putative transmembrane efflux precursor protein | 382165 | 383358 | 1 | 1194 |
| TM.orf0365 | | conserved hypothetical protein | 383415 | 383909 | 2 | 495 |
| TM.orf0366 | | conserved hypothetical protein | 383926 | 385074 | 1 | 1149 |
| TM.orf0367 | | 52.8 kDa protein in TAR-I ttuC' 3'region | 386612 | 385080 | −2 | 1533 |
| TM.orf0368 | | tricarboxylic transport | 387097 | 386630 | −3 | 468 |
| TM.orf0369 | yflP | conserved hypothetical protein | 388109 | 387102 | −2 | 1008 |
| TM.orf0370 | tctD | two component transcriptional regulator, winged helix family | 388416 | 389090 | 2 | 675 |
| TM.orf0371 | | hypothetical protein | 388417 | 388253 | −3 | 165 |
| TM.orf0372 | | histidine kinase | 389101 | 390489 | 1 | 1389 |
| TM.orf0373 | | extracellular solute-binding protein family 1 | 390486 | 391586 | 2 | 1101 |
| TM.orf0374 | ubiG | 3-demethylubiquinone-9 3-methyltransferase | 392398 | 391607 | −3 | 792 |
| TM.orf0375 | lysC | aspartate kinase | 392580 | 393800 | 2 | 1221 |
| TM.orf0376 | ptsP | Signal transduction protein containing GAF and PtsI domains | 393993 | 396263 | 2 | 2271 |
| TM.orf0377 | | conserved hypothetical protein | 396535 | 397770 | 1 | 1236 |
| TM.orf0378 | ispG | 4-hydroxy-3-methylbut-2-en-1-yl diphosphate synthase | 397921 | 399060 | 1 | 1140 |
| TM.orf0379 | hisS | Histidyl-tRNA synthetase, class IIa | 399126 | 400370 | 2 | 1245 |
| TM.orf0380 | prfA | peptide chain release factor RF-1 | 400381 | 401469 | 1 | 1089 |
| TM.orf0381 | hemK | HemK family modification methylase | 401466 | 402362 | 2 | 897 |
| TM.orf0382 | | conserved hypothetical protein | 402540 | 403709 | 2 | 1170 |
| TM.orf0383 | mal | MOSC domain containing protein | 404581 | 403811 | −3 | 771 |
| TM.orf0384 | clpB | ATP-dependent Clp protease ATP-binding subunit | 404822 | 407419 | 3 | 2598 |
| TM.orf0385 | yebA | Peptidase M23B | 408960 | 407533 | −1 | 1428 |
| TM.orf0386 | | outer membrane autotransporter barrel domain-containing protein | 415506 | 418865 | 2 | 3360 |
| TM.orf0387 | glpR | glycerol-3-phosphate transcriptional regulator protein | 418973 | 419752 | 3 | 780 |
| TM.orf0388 | mco | Multicopper oxidase family | 421157 | 419772 | −2 | 1386 |
| TM.orf0389 | pchR | PchR | 421349 | 422161 | 3 | 813 |
| TM.orf0390 | fhuA | outer membrane ferripyochelin receptor | 422306 | 424453 | 3 | 2148 |
| TM.orf0391 | | membrane protein | 424458 | 425720 | 2 | 1263 |
| TM.orf0392 | | PepSY-associated TM helix domain protein | 425720 | 426814 | 3 | 1095 |
| TM.orf0393 | | (Acyl-carrier protein) phosphodiesterase | 427469 | 426789 | −2 | 681 |
| TM.orf0394 | gcvA | LysR family transcriptional regulator | 427576 | 428472 | 1 | 897 |
| TM.orf0395 | yvbU | LysR family transcriptional regulator | 428469 | 429377 | 2 | 909 |
| TM.orf0396 | | conserved hypothetical protein | 429458 | 430402 | 3 | 945 |
| TM.orf0397 | ordL | FAD dependent oxidoreductase | 430538 | 431851 | 3 | 1314 |
| TM.orf0398 | | TRAP transporter, 4TM/12TM fusion protein | 433867 | 431906 | −3 | 1962 |
| TM.orf0399 | | TRAP transporter solute receptor TAXI family protein | 435070 | 434003 | −3 | 1068 |
| TM.orf0400 | ybiO | MscS Mechanosensitive ion channel | 435428 | 438028 | 3 | 2601 |
| TM.orf0401 | yadH | Inner membrane transport permease yadH | 438183 | 438971 | 2 | 789 |
| TM.orf0402 | | conserved hypothetical protein | 439111 | 439530 | 1 | 420 |
| TM.orf0403 | ftsK | cell divisionFtsK/SpoIIIE | 439527 | 441980 | 2 | 2454 |
| TM.orf0404 | | Glutathione peroxidase | 442138 | 442779 | 1 | 642 |
| TM.orf0405 | | conserved hypothetical protein | 443279 | 442806 | −2 | 474 |
| TM.orf0406 | | histone deacetylase | 444178 | 443276 | −3 | 903 |
| TM.orf0407 | | Outer membrane protein and related peptidoglycan-associated lipo protein | 444712 | 445557 | 1 | 846 |
| TM.orf0408 | asmA | AsmA protein | 445810 | 447792 | 1 | 1983 |
| TM.orf0409 | | conserved hypothetical protein | 447945 | 448235 | 2 | 291 |
| TM.orf0410 | hupC | cytochrome B561 | 448239 | 448796 | 2 | 558 |
| TM.orf0411 | | Ion transport 2 domain protein | 448999 | 449613 | 1 | 615 |
| TM.orf0412 | yajO | putative Oxidoreductase | 450653 | 449628 | −2 | 1026 |
| TM.orf0413 | | protein tyrosine phosphatase | 451254 | 450781 | −1 | 474 |
| TM.orf0414 | ppc | phosphoenolpyruvate carboxylase | 451412 | 454207 | 3 | 2796 |
| TM.orf0415 | dgdR | transcriptional regulator, LysR family | 454237 | 455127 | 1 | 891 |

-continued

| Locus | Gene | Product | Start | End | Strand | Length |
|---|---|---|---|---|---|---|
| TM.orf0416 | ndhF | putative NADH-quinone oxidoreductase subunit 5 | 455220 | 456689 | 2 | 1470 |
| TM.orf0417 | | conserved hypothetical protein | 456682 | 459156 | 1 | 2475 |
| TM.orf0418 | | nitrogen regulatory protein P-II | 459203 | 459559 | 3 | 357 |
| TM.orf0419 | regA | transcriptional regulator | 460693 | 459683 | −3 | 1011 |
| TM.orf0420 | fruB | phosphotransferase system, enzyme I | 460971 | 463514 | 2 | 2544 |
| TM.orf0421 | fruK | 1-phosphofructokinase | 463511 | 464491 | 3 | 981 |
| TM.orf0422 | fruA | PTS system, fructose-specific IIC component | 464526 | 466307 | 2 | 1782 |
| TM.orf0423 | ywoC | Amidases related to nicotinamidase | 467048 | 466344 | −2 | 705 |
| TM.orf0424 | foxA | TonB-dependent siderophore receptor | 467333 | 469402 | 3 | 2070 |
| TM.orf0425 | bioA | adenosylmethionine--8-amino-7-oxononanoate transaminase | 471910 | 470576 | −3 | 1335 |
| TM.orf0426 | bioD | dithiobiotin synthetase | 472545 | 471907 | −1 | 639 |
| TM.orf0427 | | 8-amino-7-oxononanoate synthase BioF | 473678 | 472542 | −2 | 1137 |
| TM.orf0428 | bioB | biotin synthase | 474574 | 473675 | −3 | 900 |
| TM.orf0429 | ydhC | transcriptional regulatory protein | 474814 | 475455 | 1 | 642 |
| TM.orf0430 | ydeP | oxidoreductase alpha (molybdopterin) subunit | 475529 | 477859 | 3 | 2331 |
| TM.orf0431 | gno | dehydrogenase | 478626 | 477841 | −1 | 786 |
| TM.orf0432 | | conserved hypothetical protein | 478688 | 480127 | 3 | 1440 |
| TM.orf0433 | potA | ABC transporter related protein | 480236 | 481363 | 3 | 1128 |
| TM.orf0434 | | ABC transporter, periplasmic solute-binding protein | 481456 | 482583 | 1 | 1128 |
| TM.orf0435 | potB | binding-protein-dependent transport systems inner membrane component | 482680 | 483660 | 1 | 981 |
| TM.orf0436 | potC | binding-protein-dependent transport systems inner membrane component | 483657 | 484469 | 2 | 813 |
| TM.orf0437 | | histidinol dehydrogenase | 484499 | 485821 | 3 | 1323 |
| TM.orf0438 | ureR | transcriptional regulator, AraC family protein | 486830 | 485865 | −2 | 966 |
| TM.orf0439 | | outer membrane protein W precursor | 487875 | 487210 | −1 | 666 |
| TM.orf0440 | hemN | oxygen-independent coproporphyrinogen III oxidase | 488180 | 489589 | 3 | 1410 |
| TM.orf0441 | dhlA | haloalkane dehalogenase | 490541 | 489624 | −2 | 918 |
| TM.orf0442 | | arginine exporter protein ArgO | 491285 | 490656 | −2 | 630 |
| TM.orf0443 | glpD | glycerol-3-phosphate dehydrogenase | 491733 | 493265 | 2 | 1533 |
| TM.orf0444 | glpK | glycerol kinase | 493445 | 494989 | 3 | 1545 |
| TM.orf0445 | | TPR repeat-containing protein | 495112 | 495654 | 1 | 543 |
| TM.orf0446 | | conserved hypothetical protein | 495786 | 496427 | 2 | 642 |
| TM.orf0447 | | hypothetical protein | 496544 | 496660 | 3 | 117 |
| TM.orf0448 | kdpA | potassium-transporting ATPase subunit A | 496804 | 498504 | 1 | 1701 |
| TM.orf0449 | kdpB | potassium-translocating P-type ATPase B subunit | 498519 | 500567 | 2 | 2049 |
| TM.orf0450 | kdpC | potassium-transporting ATPase subunit C | 500585 | 501175 | 3 | 591 |
| TM.orf0451 | kdpD | two-component system, OmpR family, sensor histidine kinase | 501204 | 503951 | 2 | 2748 |
| TM.orf0452 | kdpE | two-component system, response regulator | 503973 | 504704 | 2 | 732 |
| TM.orf0453 | | conserved hypothetical protein | 505112 | 504765 | −2 | 348 |
| TM.orf0454 | nthB | nitrile hydratase beta subunit | 505831 | 505157 | −3 | 675 |
| TM.orf0455 | nthA | nitrile hydratase alpha subunit | 506502 | 505828 | −1 | 675 |
| TM.orf0456 | gcvA | transcriptional regulator | 507496 | 506543 | −3 | 954 |
| TM.orf0457 | | hypothetical protein | 508111 | 507761 | −3 | 351 |
| TM.orf0458 | | globin | 508687 | 508247 | −3 | 441 |
| TM.orf0459 | | ErfK/YbiS/YcfS/YnhG | 508807 | 509469 | 1 | 663 |
| TM.orf0460 | | putative lipoprotein | 509478 | 510302 | 2 | 825 |
| TM.orf0461 | arsC | protein tyrosine phosphatase | 510431 | 510949 | 3 | 519 |
| TM.orf0462 | | GntR domain-containing protein | 511748 | 510972 | −2 | 777 |
| TM.orf0463 | | FMN-dependent alpha-hydroxy acid dehydrogenase | 511872 | 513029 | 2 | 1158 |
| TM.orf0464 | | isocitrate lyase and phosphorylmutase | 513155 | 514018 | 3 | 864 |
| TM.orf0465 | | hypothetical protein | 514015 | 514371 | 1 | 357 |
| TM.orf0466 | | ABC transporter substrate-binding protein | 514469 | 515752 | 3 | 1284 |
| TM.orf0467 | | conserved hypothetical protein | 517165 | 516215 | −3 | 951 |
| TM.orf0468 | | peptidase | 517201 | 517578 | 1 | 378 |
| TM.orf0469 | qseB | two-component transcriptional regulator FeuP, winged helix family | 517575 | 518240 | 2 | 666 |
| TM.orf0470 | phoQ | two-component sensor histidine kinase | 518237 | 519682 | 3 | 1446 |
| TM.orf0471 | iorB | Twin-arginine translocation pathway signal | 521914 | 519695 | −3 | 2220 |
| TM.orf0472 | iorA | putative aldehyde dehydrogenase subunit III | 522370 | 521918 | −3 | 453 |
| TM.orf0473 | | transcriptional regulator, AraC family | 522591 | 523544 | 2 | 954 |
| TM.orf0474 | lcfA | putative ligase | 525113 | 523548 | −2 | 1566 |
| TM.orf0475 | | Extracellular ligand-binding receptor | 526400 | 525171 | −2 | 1230 |
| TM.orf0476 | petP | transcriptional regulator | 526590 | 527138 | 2 | 549 |
| TM.orf0477 | | conserved hypothetical protein | 527847 | 527146 | −1 | 702 |
| TM.orf0478 | panC | pantoate--beta-alanine ligase | 528817 | 527900 | −3 | 918 |
| TM.orf0479 | | hypothetical protein | 529043 | 530308 | 3 | 1266 |
| TM.orf0480 | | hypothetical protein | 530716 | 530312 | −3 | 405 |
| TM.orf0481 | ribH | 6,7-dimethyl-8-ribityllumazine synthase | 531291 | 530773 | −1 | 519 |

-continued

| Locus | Gene | Product | Start | End | Strand | Length |
|---|---|---|---|---|---|---|
| TM.orf0482 | gmhB | Histidinol phosphatase and related phosphatases | 531698 | 532249 | 3 | 552 |
| TM.orf0483 | paaG | enoyl-CoA hydratase | 533046 | 532252 | −1 | 795 |
| TM.orf0484 | | radical SAM domain-containing protein | 533444 | 534793 | 3 | 1350 |
| TM.orf0485 | bchE | Radical SAM domain protein | 534908 | 536443 | 3 | 1536 |
| TM.orf0486 | | AMP-dependent synthetase and ligase | 536464 | 538260 | 1 | 1797 |
| TM.orf0487 | eryA | polyketide synthase | 538257 | 545873 | 2 | 7617 |
| TM.orf0488 | | thioesterase domain-containing protein | 545926 | 546360 | 1 | 435 |
| TM.orf0489 | acpP | acyl carrier protein | 546431 | 546682 | 3 | 252 |
| TM.orf0490 | fabF | 3-oxoacyl-[acyl-carrier-protein] synthase II (Beta-ketoacyl-ACP synthase II) (KAS II) | 546700 | 548034 | 1 | 1335 |
| TM.orf0491 | | phage tail Collar | 548247 | 548765 | 2 | 519 |
| TM.orf0492 | | Tail Collar domain protein | 548785 | 549333 | 1 | 549 |
| TM.orf0493 | | phage tail Collar | 549347 | 549880 | 3 | 534 |
| TM.orf0494 | | Nitrilase/cyanide hydratase and apolipoprotein N-acyltransferase | 551667 | 549940 | −1 | 1728 |
| TM.orf0495 | braG | putative branched-chain amino acid ABC transporter, ATP-binding protein | 552409 | 551714 | −3 | 696 |
| TM.orf0496 | braF | branched chain amino acid ABC transporter ATP-binding protein | 553173 | 552409 | −1 | 765 |
| TM.orf0497 | livM | putative branched-chain amino acid ABC transporter, permease protein | 554282 | 553170 | −2 | 1113 |
| TM.orf0498 | braD | putative permease component of ABC transporter | 555185 | 554292 | −2 | 894 |
| TM.orf0499 | amiC | Aliphatic amidase expression-regulating protein | 556529 | 555276 | −2 | 1254 |
| TM.orf0500 | amiR | two component response regulator | 557586 | 556978 | −1 | 609 |
| TM.orf0501 | amiC | two component sensor kinase | 558743 | 557613 | −2 | 1131 |
| TM.orf0502 | | major facilitator transporter | 559050 | 560237 | 2 | 1188 |
| TM.orf0503 | exoD | exopolysaccharide synthesis, ExoD | 560901 | 560248 | −1 | 654 |
| TM.orf0504 | | ABC-type transport system, periplasmic component | 561238 | 561855 | 1 | 618 |
| TM.orf0505 | | membrane protein | 561833 | 562960 | 3 | 1128 |
| TM.orf0506 | dokA | Signal transduction histidine kinase | 563084 | 564592 | 3 | 1509 |
| TM.orf0507 | | putative phosphohistidine phosphatase, SixA | 564654 | 565271 | 2 | 618 |
| TM.orf0508 | crtK | TspO and MBR like protein | 565318 | 565920 | 1 | 603 |
| TM.orf0509 | dhkA | PAS fold family | 565990 | 567486 | 1 | 1497 |
| TM.orf0510 | GCDH | acyl-CoA dehydrogenase domain-containing protein | 568693 | 567503 | −3 | 1191 |
| TM.orf0511 | | nitroreductase | 568851 | 569519 | 2 | 669 |
| TM.orf0512 | | Leu/Ile/Val-binding protein | 570792 | 569566 | −1 | 1227 |
| TM.orf0513 | lcfB | AMP-dependent synthetase and ligase | 571032 | 572663 | 2 | 1632 |
| TM.orf0514 | ybcL | putative efflux transporter | 573873 | 572689 | −1 | 1185 |
| TM.orf0515 | nahR | transcriptional regulator, LysR family | 574012 | 574938 | 1 | 927 |
| TM.orf0516 | ybaK | ybaK/ebsC protein | 575000 | 575491 | 3 | 492 |
| TM.orf0517 | | Phospholipase/Carboxylesterase | 576117 | 575497 | −1 | 621 |
| TM.orf0518 | | thioredoxin reductase | 577220 | 576114 | −2 | 1107 |
| TM.orf0519 | FMO5 | monooxygenase | 578828 | 577506 | −2 | 1323 |
| TM.orf0520 | | NAD-dependent epimerase/dehydratase | 579816 | 578839 | −1 | 978 |
| TM.orf0521 | acnR | putative TetR-family transcriptional regulator | 579957 | 580628 | 2 | 672 |
| TM.orf0522 | | acyl-CoA dehydrogenase domain protein | 580669 | 581832 | 1 | 1164 |
| TM.orf0523 | yfdE | L-carnitine dehydratase/bile acid-inducible protein F | 581847 | 582971 | 2 | 1125 |
| TM.orf0524 | htd2 | Hydroxyacyl-thioester dehydratase type 2 | 582968 | 583837 | 3 | 870 |
| TM.orf0525 | yciC | cobalamin synthesis protein P47K | 583974 | 585140 | 2 | 1167 |
| TM.orf0526 | | CH42_BURCC RecName: Full = GTP cyclohydrolase folE2 2 | 585216 | 586118 | 2 | 903 |
| TM.orf0527 | | carbonic anhydrase/acetyltransferase isoleucine patch superfamily | 586156 | 586716 | 1 | 561 |
| TM.orf0528 | thrS | threonyl-tRNA synthetase | 586723 | 588711 | 1 | 1989 |
| TM.orf0529 | allB | dihydroorotase | 588708 | 590063 | 2 | 1356 |
| TM.orf0530 | lmrA | regulatory protein, TetR | 590631 | 590041 | −1 | 591 |
| TM.orf0531 | pksS | cytochrome P450 | 590886 | 592121 | 2 | 1236 |
| TM.orf0532 | | Enoyl-CoA hydratase/isomerase | 592172 | 593083 | 3 | 912 |
| TM.orf0533 | | alanyl-tRNA synthetase-like protein | 593148 | 593792 | 2 | 645 |
| TM.orf0534 | | hypothetical protein | 593789 | 593926 | 3 | 138 |
| TM.orf0535 | | metal dependent phosphohydrolase | 594581 | 593940 | −2 | 642 |
| TM.orf0536 | | AraC family transcriptional regulator | 594749 | 595756 | 3 | 1008 |
| TM.orf0537 | phnO | acetyltransferase protein | 596183 | 595719 | −2 | 465 |
| TM.orf0538 | | thiolase | 597626 | 596370 | −2 | 1257 |
| TM.orf0539 | pab | para-aminobenzoate synthase | 597796 | 599931 | 1 | 2136 |
| TM.orf0540 | | conserved hypothetical protein | 600061 | 600906 | 1 | 846 |
| TM.orf0541 | qor | alcohol dehydrogenase | 602007 | 601015 | −1 | 993 |
| TM.orf0542 | mauR | transcriptional regulator protein | 602150 | 603052 | 3 | 903 |
| TM.orf0543 | catA | putative dioxygenase | 603116 | 603706 | 3 | 591 |
| TM.orf0544 | yeaM | AraC family transcriptional regulator | 604467 | 603676 | −1 | 792 |
| TM.orf0545 | | conserved hypothetical protein | 604608 | 605018 | 2 | 411 |

-continued

| Locus | Gene | Product | Start | End | Strand | Length |
|---|---|---|---|---|---|---|
| TM.orf0546 | iorA | indolepyruvate ferredoxin oxidoreductase subunit alpha/beta | 607828 | 605153 | −3 | 2676 |
| TM.orf0547 | ADH4 | putative iron-containing alcohol dehydrogenase | 609219 | 610397 | 2 | 1179 |
| TM.orf0548 | yncG | glutathione S-transferase domain-containing protein | 610399 | 611100 | 1 | 702 |
| TM.orf0549 | | thioesterase family protein | 611097 | 611534 | 2 | 438 |
| TM.orf0550 | | conserved hypothetical protein | 611534 | 611995 | 3 | 462 |
| TM.orf0551 | lcfB | putative AMP-dependent synthetase and ligase | 612106 | 613716 | 1 | 1611 |
| TM.orf0552 | | chemotaxis transducer | 613861 | 615543 | 1 | 1683 |
| TM.orf0553 | | conserved hypothetical protein | 616401 | 615544 | −1 | 858 |
| TM.orf0554 | acoA | Thiamine pyrophosphate-dependent dehydrogenase, E1 component alpha subunit | 616817 | 617848 | 3 | 1032 |
| TM.orf0555 | | putative pyruvate dehydrogenase E1 beta subunit | 617854 | 618828 | 1 | 975 |
| TM.orf0556 | yiaO | 2,3-diketo-L-gulonate-binding periplasmic protein yiaO | 618991 | 620031 | 1 | 1041 |
| TM.orf0557 | yiaM | Tripartite ATP-independent periplasmic transporter DctQ component | 620150 | 620704 | 3 | 555 |
| TM.orf0558 | | putative membrane permease | 620762 | 622084 | 3 | 1323 |
| TM.orf0559 | ilvB | putative acetolactate synthase large subunit | 622226 | 623998 | 3 | 1773 |
| TM.orf0560 | | conserved hypothetical protein | 624099 | 624686 | 2 | 588 |
| TM.orf0561 | prfC | peptide chain release factor 3 | 626404 | 624803 | −3 | 1602 |
| TM.orf0562 | | virulence-associated protein VapB-like protein | 626680 | 626970 | 1 | 291 |
| TM.orf0563 | | hydrolase-like protein protein of the alpha/beta-hydrolase fold family | 627843 | 627025 | −1 | 819 |
| TM.orf0564 | | conserved hypothetical protein | 627993 | 628298 | 2 | 306 |
| TM.orf0565 | exoI | nuclease (SNase-like) | 628791 | 628339 | −1 | 453 |
| TM.orf0566 | katG | catalase/peroxidase HPI | 634943 | 632781 | −2 | 2163 |
| TM.orf0567 | | cysteine desulfuration protein SufE | 635136 | 635567 | 2 | 432 |
| TM.orf0568 | | class II aldolase/adducin domain protein | 635598 | 636389 | 2 | 792 |
| TM.orf0569 | | OsmC family protein | 636514 | 636900 | 1 | 387 |
| TM.orf0570 | | Amidase | 636948 | 638387 | 2 | 1440 |
| TM.orf0571 | | conserved hypothetical protein | 638855 | 640081 | 3 | 1227 |
| TM.orf0572 | | hypothetical protein | 640122 | 640562 | 2 | 441 |
| TM.orf0573 | paaA | phenylacetic acid degradation protein (similar to paaA) | 640657 | 641412 | 1 | 756 |
| TM.orf0574 | soj | chromosome partitioning protein | 642261 | 643097 | 2 | 837 |
| TM.orf0575 | | conserved hypothetical protein | 643191 | 643934 | 2 | 744 |
| TM.orf0576 | | Heat shock protein DnaJ-like protein | 643951 | 644727 | 1 | 777 |
| TM.orf0577 | exoN | UTP--glucose-1-phosphate uridylyltransferase | 645077 | 645976 | 3 | 900 |
| TM.orf0578 | rkpK | putative UDP glucose dehydrogenase | 646078 | 647397 | 1 | 1320 |
| TM.orf0579 | exoC | phosphomannomutase/phosphoglucomutase | 647463 | 648872 | 2 | 1410 |
| TM.orf0580 | yjbE | putative transmembrane protein | 649638 | 648958 | −1 | 681 |
| TM.orf0581 | | putative methyl-accepting chemotaxis protein | 649939 | 651363 | 1 | 1425 |
| TM.orf0582 | | ribokinase | 652335 | 651364 | −1 | 972 |
| TM.orf0583 | | hypothetical protein | 652572 | 652417 | −1 | 156 |
| TM.orf0584 | dacF | D-alanyl-D-alanine carboxypeptidase | 654331 | 652757 | −3 | 1575 |
| TM.orf0585 | | conserved hypothetical protein | 654712 | 655467 | 1 | 756 |
| TM.orf0586 | | conserved hypothetical protein | 655702 | 656541 | 1 | 840 |
| TM.orf0587 | clpS | ATP-dependent Clp protease adaptor protein ClpS | 656820 | 657164 | 2 | 345 |
| TM.orf0588 | | ATP-dependent Clp protease ATP-binding subunit ClpA | 657164 | 659569 | 3 | 2406 |
| TM.orf0589 | | conserved hypothetical protein | 661060 | 660392 | −3 | 669 |
| TM.orf0590 | | hypothetical protein | 661403 | 661134 | −2 | 270 |
| TM.orf0591 | | hypothetical protein | 661698 | 661420 | −1 | 279 |
| TM.orf0592 | | conserved hypothetical protein | 662968 | 661796 | −3 | 1173 |
| TM.orf0593 | | conserved hypothetical protein | 663406 | 663008 | −3 | 399 |
| TM.orf0594 | | conserved hypothetical protein | 663738 | 663403 | −1 | 336 |
| TM.orf0595 | dhbF | syringomycin synthetase | 667650 | 663781 | −1 | 3870 |
| TM.orf0596 | | conserved hypothetical protein | 668332 | 667784 | −3 | 549 |
| TM.orf0597 | | Chain A, Crystal Structure Of Cmls, A Flavin-Dependent Halogenase | 670077 | 668353 | −1 | 1725 |
| TM.orf0598 | | putative acetyltransferase | 670754 | 670074 | −2 | 681 |
| TM.orf0599 | lcfB | Long-chain-fatty-acid--CoA ligase | 672127 | 670751 | −3 | 1377 |
| TM.orf0600 | fabG | short-chain dehydrogenase/reductase SDR | 672963 | 672124 | −1 | 840 |
| TM.orf0601 | htpX | putative protease htpX homolog | 674367 | 673189 | −1 | 1179 |
| TM.orf0602 | | conserved hypothetical protein | 675506 | 674370 | −2 | 1137 |
| TM.orf0603 | ilvI | acetolactate synthase 2 catalytic subunit | 677353 | 675629 | −3 | 1725 |
| TM.orf0604 | | translation initiation inhibitor | 677895 | 677428 | −1 | 468 |
| TM.orf0605 | dhaS | betaine-aldehyde dehydrogenase | 679419 | 677941 | −1 | 1479 |
| TM.orf0606 | nemA | GTN reductase | 680812 | 679697 | −3 | 1116 |
| TM.orf0607 | lrp | leucine-responsive regulatory protein | 681490 | 681008 | −3 | 483 |
| TM.orf0608 | putA | delta-1-pyrroline-5-carboxylate dehydrogenase | 681671 | 684853 | 3 | 3183 |
| TM.orf0609 | metA | Homoserine O-succinyltransferase | 685094 | 686035 | 3 | 942 |

-continued

| Locus | Gene | Product | Start | End | Strand | Length |
|---|---|---|---|---|---|---|
| TM.orf0610 | dhaR | transcriptional regulator, TetR family | 686626 | 686042 | −3 | 585 |
| TM.orf0611 | ybfB | major facilitator superfamily MFS-1 | 686797 | 688068 | 1 | 1272 |
| TM.orf0612 | PRX1 | BcpB protein | 688671 | 688087 | −1 | 585 |
| TM.orf0613 | | amino acid transporter LysE | 689327 | 688668 | −2 | 660 |
| TM.orf0614 | | conserved hypothetical protein | 690148 | 689324 | −3 | 825 |
| TM.orf0615 | cmoA | methyltransferase domain protein | 690891 | 690145 | −1 | 747 |
| TM.orf0616 | ydeG | MFS-type transporter ydeG | 692297 | 691077 | −2 | 1221 |
| TM.orf0617 | | inosine-uridine preferring nucleoside hydrolase family protein | 692498 | 693520 | 3 | 1023 |
| TM.orf0618 | hlyB | putative chemotaxis protein | 693705 | 695978 | 2 | 2274 |
| TM.orf0619 | | hypothetical protein | 696163 | 696546 | 1 | 384 |
| TM.orf0620 | bfr | bacterioferritin | 697119 | 696637 | −1 | 483 |
| TM.orf0621 | | hypothetical protein | 697540 | 697331 | −3 | 210 |
| TM.orf0622 | | acetyl-CoA synthetase | 699297 | 697648 | −1 | 1650 |
| TM.orf0623 | ydbL | conserved hypothetical protein | 699801 | 699409 | −1 | 393 |
| TM.orf0624 | ynbE | conserved hypothetical protein | 699995 | 699801 | −2 | 195 |
| TM.orf0625 | | conserved hypothetical protein | 702253 | 700028 | −3 | 2226 |
| TM.orf0626 | prtG | calcium binding hemolysin protein | 704409 | 702337 | −1 | 2073 |
| TM.orf0627 | cya | calcium binding hemolysin protein | 707645 | 704406 | −2 | 3240 |
| TM.orf0628 | hbd | 3-hydroxybutyryl-CoA dehydrogenase | 708626 | 707766 | −2 | 861 |
| TM.orf0629 | | acyl-CoA dehydrogenase family protein | 710498 | 708687 | −2 | 1812 |
| TM.orf0630 | yngJ | acyl-CoA dehydrogenase | 711807 | 710659 | −1 | 1149 |
| TM.orf0631 | yngJ | pimeloyl-CoA dehydrogenase, large subunit | 713033 | 711837 | −2 | 1197 |
| TM.orf0632 | | peroxisomal bifunctional enzyme | 715404 | 713272 | −1 | 2133 |
| TM.orf0633 | livF | ABC transporter related protein | 716251 | 715547 | −3 | 705 |
| TM.orf0634 | braF | ABC transporter related protein | 717000 | 716248 | −1 | 753 |
| TM.orf0635 | livM | inner-membrane translocator | 718319 | 717000 | −2 | 1320 |
| TM.orf0636 | livH | inner-membrane translocator | 719266 | 718316 | −3 | 951 |
| TM.orf0637 | | ABC transporter, periplasmic branched chain amino acid binding protein | 720794 | 719529 | −2 | 1266 |
| TM.orf0638 | | enoyl-CoA hydratase | 721169 | 721630 | 3 | 462 |
| TM.orf0639 | alkK | Acyl-CoA synthetases (AMP-forming)/AMP-acid ligase II | 723334 | 721679 | −3 | 1656 |
| TM.orf0640 | | stationary-phase survival protein SurE | 724368 | 723562 | −1 | 807 |
| TM.orf0641 | cpnA | dehydrogenase | 724537 | 725313 | 1 | 777 |
| TM.orf0642 | | short-chain dehydrogenase/reductase SDR | 725393 | 726169 | 3 | 777 |
| TM.orf0643 | | aminoglycoside phosphotransferase | 726257 | 727384 | 3 | 1128 |
| TM.orf0644 | | conserved hypothetical protein | 729404 | 727473 | −2 | 1932 |
| TM.orf0645 | | Helix-turn-helix motif | 730001 | 729531 | −2 | 471 |
| TM.orf0646 | | putative acyl-CoA dehydrogenase | 731374 | 730163 | −3 | 1212 |
| TM.orf0647 | acnR | TetR family transcriptional regulator | 731751 | 732479 | 2 | 729 |
| TM.orf0648 | | oxidoreductase, zinc-binding dehydrogenase family | 732536 | 733510 | 3 | 975 |
| TM.orf0649 | | methyl-accepting chemotaxis sensory transducer | 733792 | 735945 | 1 | 2154 |
| TM.orf0650 | | conserved hypothetical protein | 736107 | 736688 | 2 | 582 |
| TM.orf0651 | cutL | carbon-monoxide dehydrogenase (acceptor) | 739092 | 736771 | −1 | 2322 |
| TM.orf0652 | | chromate transporter | 739344 | 740543 | 2 | 1200 |
| TM.orf0653 | | transcriptional regulatory protein ZraR | 741144 | 740554 | −1 | 591 |
| TM.orf0654 | rpoH | RNA polymerase sigma-32 factor | 741640 | 742587 | 1 | 948 |
| TM.orf0655 | | soluble lytic murein transglycosylase and related regulatory protein | 743595 | 742660 | −1 | 936 |
| TM.orf0656 | | hypothetical protein | 744009 | 743890 | −1 | 120 |
| TM.orf0657 | phhA | phenylalanine 4-monooxygenase | 745351 | 744503 | −3 | 849 |
| TM.orf0658 | pat | GCN5-related N-acetyltransferase | 746049 | 745474 | −1 | 576 |
| TM.orf0659 | | N-formylglutamate amidohydrolase | 747143 | 746187 | −2 | 957 |
| TM.orf0660 | | conserved hypothetical protein | 747698 | 748045 | 3 | 348 |
| TM.orf0661 | | conserved hypothetical protein | 748108 | 748539 | 1 | 432 |
| TM.orf0662 | ybiC | malate dehydrogenase | 749609 | 748530 | −2 | 1080 |
| TM.orf0663 | | HTH-type transcriptional regulator in instable DNA locus | 749726 | 750433 | 3 | 708 |
| TM.orf0664 | dctP | c4-dicarboxylate-binding periplasmic protein | 750531 | 751577 | 2 | 1047 |
| TM.orf0665 | | Tripartite ATP-independent periplasmic transporter DctQ component | 751608 | 752219 | 2 | 612 |
| TM.orf0666 | siaT | C4-dicarboxylate TRAP-T family tripartite ATP-independent periplasmic transporter, membrane protein, large subunit | 752216 | 753484 | 3 | 1269 |
| TM.orf0667 | | conserved hypothetical protein | 754396 | 753521 | −3 | 876 |
| TM.orf0668 | | hypothetical protein | 754660 | 755205 | 1 | 546 |
| TM.orf0669 | | sodium/hydrogen exchanger family protein | 755322 | 757847 | 2 | 2526 |
| TM.orf0670 | | conserved hypothetical protein | 758235 | 757852 | −1 | 384 |
| TM.orf0671 | | conserved hypothetical protein | 758543 | 758232 | −2 | 312 |
| TM.orf0672 | codA | cytosine deaminase | 759953 | 758661 | −2 | 1293 |
| TM.orf0673 | yufQ | inner-membrane translocator | 760898 | 759957 | −2 | 942 |
| TM.orf0674 | yufP | inner-membrane translocator | 761966 | 760917 | −2 | 1050 |
| TM.orf0675 | yufO | ABC transporter component | 763503 | 761956 | −1 | 1548 |
| TM.orf0676 | med | Transcriptional activator protein med | 764695 | 763700 | −3 | 996 |

| Locus | Gene | Product | Start | End | Strand | Length |
|---|---|---|---|---|---|---|
| TM.orf0677 | ytxM | Putative esterase ytxM | 765825 | 764917 | −1 | 909 |
| TM.orf0678 | apl | dedA family protein | 766513 | 765920 | −3 | 594 |
| TM.orf0679 | | Arylformamidase | 766698 | 767585 | 2 | 888 |
| TM.orf0680 | hldE | rfaE bifunctional protein | 769104 | 767590 | −1 | 1515 |
| TM.orf0681 | gmhA | Phosphoheptose isomerase | 769759 | 769145 | −3 | 615 |
| TM.orf0682 | | cupin 2 domain-containing protein | 769946 | 770377 | 3 | 432 |
| TM.orf0683 | hldD | nucleoside-diphosphate-sugar epimerase | 771374 | 770388 | −2 | 987 |
| TM.orf0684 | | hypothetical protein | 771640 | 771888 | 1 | 249 |
| TM.orf0685 | gfcB | lipoprotein gfcB | 772654 | 771977 | −3 | 678 |
| TM.orf0686 | | sulfate adenylyltransferase subunit 2 sulfate adenylatetransferase sat ATP-sulfurylase small subunit | 772921 | 773724 | 1 | 804 |
| TM.orf0687 | tuf | sulfate adenylyltransferase, large subunit | 773744 | 774697 | 3 | 954 |
| TM.orf0688 | cysC | NodQ bifunctional enzyme | 774694 | 775674 | 1 | 981 |
| TM.orf0689 | lcfA | 4-coumarate-CoA ligase | 777276 | 775735 | −1 | 1542 |
| TM.orf0690 | | peroxisomal 2,4-dienoyl-CoA reductase | 778127 | 777318 | −2 | 810 |
| TM.orf0691 | | thiolase | 779269 | 778124 | −3 | 1146 |
| TM.orf0692 | | DUF35 | 779685 | 779266 | −1 | 420 |
| TM.orf0693 | | peroxisomal multifunctional enzyme type 2 | 780596 | 779682 | −2 | 915 |
| TM.orf0694 | | alpha-methylacyl-CoA racemase | 781834 | 780686 | −3 | 1149 |
| TM.orf0695 | slyA | transcriptional regulator, MarR family | 782310 | 781861 | −1 | 450 |
| TM.orf0696 | FOX2 | peroxisomal multifunctional enzyme type 2 | 783339 | 782434 | −1 | 906 |
| TM.orf0697 | | acyl-CoA dehydrogenase | 783507 | 784658 | 2 | 1152 |
| TM.orf0698 | lcfA | acyl-CoA synthase | 784655 | 786238 | 3 | 1584 |
| TM.orf0699 | | enoyl-CoA hydratase/isomerase | 786235 | 787038 | 1 | 804 |
| TM.orf0700 | siaT | trap dicarboxylate transporter, dctm subunit | 788453 | 787113 | −2 | 1341 |
| TM.orf0701 | | tripartite ATP-independent periplasmic transporter DctQ | 788963 | 788457 | −2 | 507 |
| TM.orf0702 | dctB | Bacterial extracellular solute-binding protein, family 7 | 790096 | 789038 | −3 | 1059 |
| TM.orf0703 | cysW | Sulfate ABC transporter permease CysW | 791154 | 790300 | −1 | 855 |
| TM.orf0704 | cysT | sulfate transport system permease protein | 792007 | 791159 | −3 | 849 |
| TM.orf0705 | sbp | sulfate ABC transporter, periplasmic sulfate-binding protein | 793059 | 792013 | −1 | 1047 |
| TM.orf0706 | | MUM4 (MUCILAGE-MODIFIED 4); UDP-4-keto-6-deoxy-glucose-3,5-epimerase/UDP-4-keto-rhamnose-4-keto-reductase/UDP-L-rhamnose synthase/UDP-glucose 4,6-dehydratase/catalytic | 794335 | 793313 | −3 | 1023 |
| TM.orf0707 | hldD | NAD-dependent epimerase/dehydratase | 795138 | 794335 | −1 | 804 |
| TM.orf0708 | rfbP | undecaprenyl-phosphate galactose phosphotransferase | 795619 | 796302 | 1 | 684 |
| TM.orf0709 | capI | NAD-dependent epimerase/dehydratase | 796462 | 797448 | 1 | 987 |
| TM.orf0710 | capL | UDP-N-acetyl-D-mannosaminuronate dehydrogenase | 797455 | 798807 | 1 | 1353 |
| TM.orf0711 | kpsD | polysaccharide biosynthesis/export protein | 798962 | 801733 | 3 | 2772 |
| TM.orf0712 | gfcD | lipoprotein gfcD | 801746 | 804310 | 3 | 2565 |
| TM.orf0713 | rfbF | glucose-1-phosphate cytidylyltransferase | 804589 | 805395 | 1 | 807 |
| TM.orf0714 | rfbN | glycosyl transferase, group 2 family protein | 805747 | 806772 | 1 | 1026 |
| TM.orf0715 | algA | GDP-mannose pyrophosphorylase EpsQ | 806941 | 808362 | 1 | 1422 |
| TM.orf0716 | | hypothetical protein | 809191 | 810693 | 1 | 1503 |
| TM.orf0717 | | transposase, IS4 | 811033 | 810656 | −3 | 378 |
| TM.orf0718 | | transposase | 811329 | 811030 | −1 | 300 |
| TM.orf0719 | | transposase | 812031 | 811762 | −1 | 270 |
| TM.orf0720 | | putative transposase number 1 of insertion sequence NGRIS-2b | 812834 | 812286 | −2 | 549 |
| TM.orf0721 | | nitroreductase | 813882 | 814241 | 2 | 360 |
| TM.orf0722 | | glycosyltransferase | 814291 | 815379 | 1 | 1089 |
| TM.orf0723 | | conserved hypothetical protein | 815651 | 815971 | 3 | 321 |
| TM.orf0724 | phnA | putative polybetahydroxybutyrate synthesis PhnA protein | 816051 | 816371 | 2 | 321 |
| TM.orf0725 | | conserved hypothetical protein | 816451 | 817203 | 1 | 753 |
| TM.orf0726 | | transcriptional regulator, TetR family protein | 817819 | 817235 | −3 | 585 |
| TM.orf0727 | yxaH | putative membrane protein | 817946 | 819001 | 3 | 1056 |
| TM.orf0728 | bioY | putative biotin transporter bioY | 819599 | 819009 | −2 | 591 |
| TM.orf0729 | yqjI | transcriptional regulator, PadR-like family | 819792 | 820448 | 2 | 657 |
| TM.orf0730 | | conserved hypothetical protein | 820445 | 820891 | 3 | 447 |
| TM.orf0731 | ynfM | Inner membrane transport protein ynfM | 822157 | 820892 | −3 | 1266 |
| TM.orf0732 | alsR | transcriptional regulator, LysR family | 822266 | 823165 | 3 | 900 |
| TM.orf0733 | | glyoxalase family protein | 823242 | 823730 | 2 | 489 |
| TM.orf0734 | ybaA | conserved hypothetical protein | 823730 | 824089 | 3 | 360 |
| TM.orf0735 | ttr | Putative acetyltransferase protein | 824625 | 824080 | −1 | 546 |
| TM.orf0736 | | XRE family transcriptional regulator | 825205 | 824636 | −3 | 570 |
| TM.orf0737 | pecS | transcriptional regulator protein | 825751 | 825248 | −3 | 504 |
| TM.orf0738 | pecM | putative transmembrane protein | 825858 | 826748 | 2 | 891 |
| TM.orf0739 | yfmJ | NADP-dependent dehydrogenase | 826767 | 827801 | 2 | 1035 |
| TM.orf0740 | ywfM | transporter ywfM | 828741 | 827788 | −1 | 954 |

-continued

| Locus | Gene | Product | Start | End | Strand | Length |
|---|---|---|---|---|---|---|
| TM.orf0741 | | ornithine cyclodeaminase/mu-crystallin | 829797 | 828844 | −1 | 954 |
| TM.orf0742 | | conserved hypothetical protein | 830365 | 829883 | −3 | 483 |
| TM.orf0743 | hosA | MarR family transcriptional regulator | 830469 | 830942 | 2 | 474 |
| TM.orf0744 | | conserved hypothetical protein | 831065 | 832447 | 3 | 1383 |
| TM.orf0745 | | arsenate reductase and related | 832953 | 832576 | −1 | 378 |
| TM.orf0746 | | peptidase M14, carboxypeptidase A | 834152 | 832953 | −2 | 1200 |
| TM.orf0747 | metC | Cys/Met metabolism pyridoxal-phosphate-dependent enzymes | 834281 | 835465 | 3 | 1185 |
| TM.orf0748 | rhlE | DEAD/DEAH box helicase domain-containing protein | 836034 | 837620 | 2 | 1587 |
| TM.orf0749 | bdlA | Methyl-accepting chemotaxis protein | 839419 | 837737 | −3 | 1683 |
| TM.orf0750 | | phenazine biosynthesis protein PhzF family | 840341 | 839514 | −2 | 828 |
| TM.orf0751 | | Multidrug resistance protein B | 841645 | 840386 | −3 | 1260 |
| TM.orf0752 | | peptidase C45, acyl-coenzyme A: 6-aminopenicillanic acid acyl-transferase | 842814 | 841633 | −1 | 1182 |
| TM.orf0753 | lysX | S6 modification enzyme RimK | 843734 | 842811 | −2 | 924 |
| TM.orf0754 | norM | MATE efflux family protein | 845343 | 843844 | −1 | 1500 |
| TM.orf0755 | | conserved hypothetical protein | 845638 | 846540 | 1 | 903 |
| TM.orf0756 | | conserved hypothetical protein | 846561 | 847322 | 2 | 762 |
| TM.orf0757 | | GGDEF domain containing protein | 847396 | 848274 | 1 | 879 |
| TM.orf0758 | | diguanylate cyclase with PAS/PAC sensor | 848280 | 848630 | 2 | 351 |
| TM.orf0759 | | hypothetical protein | 848932 | 849105 | 1 | 174 |
| TM.orf0760 | leuA | 2-isopropylmalate synthase | 849191 | 850897 | 3 | 1707 |
| TM.orf0761 | mreB | rod shape-determining protein MreB and related proteins | 851190 | 852230 | 2 | 1041 |
| TM.orf0762 | mreC | Rod shape-determining protein MreC | 852430 | 853335 | 1 | 906 |
| TM.orf0763 | | Cell shape-determining protein | 853352 | 853867 | 3 | 516 |
| TM.orf0764 | mrdA | penicillin binding protein 2 | 853953 | 855959 | 2 | 2007 |
| TM.orf0765 | mrdB | Bacterial cell division membrane protein | 855956 | 857107 | 3 | 1152 |
| TM.orf0766 | | hypothetical protein | 857429 | 857650 | 3 | 222 |
| TM.orf0767 | pldC | phospholipase D/transphosphatidylase | 859194 | 857668 | −1 | 1527 |
| TM.orf0768 | yjaB | GCN5-related N-acetyltransferase | 859390 | 859845 | 1 | 456 |
| TM.orf0769 | rutF | flavin reductase domain-containing protein | 860411 | 859860 | −2 | 552 |
| TM.orf0770 | yhgD | transcriptional regulator, TetR family | 860595 | 861254 | 2 | 660 |
| TM.orf0771 | eutG | maleylacetate reductase | 862448 | 861276 | −2 | 1173 |
| TM.orf0772 | | conserved hypothetical protein | 862698 | 863018 | 2 | 321 |
| TM.orf0773 | | Bbp2 | 863033 | 863611 | 3 | 579 |
| TM.orf0774 | | hypothetical protein | 863608 | 863973 | 1 | 366 |
| TM.orf0775 | | C repressor protein | 864710 | 863964 | −2 | 747 |
| TM.orf0776 | | conserved hypothetical protein | 864876 | 865304 | 2 | 429 |
| TM.orf0777 | | conserved hypothetical protein | 865831 | 865328 | −3 | 504 |
| TM.orf0778 | | hypothetical protein | 866147 | 865857 | −2 | 291 |
| TM.orf0779 | exoI | putative nuclease | 867100 | 866357 | −3 | 744 |
| TM.orf0780 | thrS | threonyl-tRNA synthetase | 867419 | 869302 | 3 | 1884 |
| TM.orf0781 | | Outer membrane lipoprotein-like | 869483 | 870010 | 3 | 528 |
| TM.orf0782 | | conserved hypothetical protein | 870055 | 870642 | 1 | 588 |
| TM.orf0783 | | filamentation induced by cAMP protein Fic | 870812 | 871078 | 3 | 267 |
| TM.orf0784 | | hypothetical protein | 871209 | 872570 | 2 | 1362 |
| TM.orf0785 | | hypothetical protein | 872707 | 873117 | 1 | 411 |
| TM.orf0786 | arsB | membrane anion transport protein | 873236 | 874462 | 3 | 1227 |
| TM.orf0787 | | conserved hypothetical protein | 874551 | 876017 | 2 | 1467 |
| TM.orf0788 | | transcriptional regulator | 876446 | 876036 | −2 | 411 |
| TM.orf0789 | cry2 | Deoxyribodipyrimidine photolyase | 876900 | 878381 | 2 | 1482 |
| TM.orf0790 | icc | metallophosphoesterase | 878427 | 879224 | 2 | 798 |
| TM.orf0791 | glxA | transcriptional regulator, AraC family | 880193 | 879255 | −2 | 939 |
| TM.orf0792 | | ThiJ/PfpI family protein | 880283 | 880981 | 3 | 699 |
| TM.orf0793 | | extracellular ligand-binding receptor | 882269 | 880995 | −2 | 1275 |
| TM.orf0794 | | oxidoreductase, short chain dehydrogenase/reductase family | 883289 | 882483 | −2 | 807 |
| TM.orf0795 | | Short-chain dehydrogenase/reductase SDR | 883557 | 884315 | 2 | 759 |
| TM.orf0796 | | Rhomboid family protein | 884613 | 885104 | 2 | 492 |
| TM.orf0797 | | conserved hypothetical protein | 885466 | 885122 | −3 | 345 |
| TM.orf0798 | | conserved hypothetical protein | 885588 | 886211 | 2 | 624 |
| TM.orf0799 | | acetyltransferase | 886436 | 886909 | 3 | 474 |
| TM.orf0800 | | possible periplasmic substrate-binding protein, ABC-type amino acid ABC transporter | 887349 | 888662 | 2 | 1314 |
| TM.orf0801 | braD | inner-membrane translocator | 888777 | 889673 | 2 | 897 |
| TM.orf0802 | | inner-membrane translocator | 889688 | 890713 | 3 | 1026 |
| TM.orf0803 | livG | ABC transporter related protein | 890710 | 891459 | 1 | 750 |
| TM.orf0804 | livF | ABC transporter related protein | 891479 | 892138 | 3 | 660 |
| TM.orf0805 | lcfB | putative acyl coenzyme A synthetase, long-chain-fatty-acid--CoA ligase | 892181 | 893356 | 3 | 1176 |
| TM.orf0806 | istB | IstB domain protein ATP-binding protein | 894205 | 893414 | −3 | 792 |
| TM.orf0807 | istA | Integrase, catalytic region | 895700 | 894192 | −2 | 1509 |
| TM.orf0808 | intZ | site-specific recombinase, phage integrase family | 897748 | 895811 | −3 | 1938 |
| TM.orf0809 | | hypothetical protein | 898105 | 897965 | −3 | 141 |

-continued

| Locus | Gene | Product | Start | End | Strand | Length |
|---|---|---|---|---|---|---|
| TM.orf0810 | | YGGT family protein | 898781 | 898464 | −2 | 318 |
| TM.orf0811 | | Na+/solute symporter (Ssf family) | 900627 | 898861 | −1 | 1767 |
| TM.orf0812 | | membrane protein | 900934 | 900641 | −3 | 294 |
| TM.orf0813 | | hypothetical protein | 901151 | 901759 | 3 | 609 |
| TM.orf0814 | dnaQ | DNA polymerase III, epsilon subunit | 901740 | 903149 | 2 | 1410 |
| TM.orf0815 | | Predicted signal-transduction protein containing cAMP-binding and CBS domains | 903243 | 904697 | 2 | 1455 |
| TM.orf0816 | pldB | alpha/beta hydrolase fold protein | 904706 | 905701 | 3 | 996 |
| TM.orf0817 | | short-chain dehydrogenase/reductase SDR | 906481 | 905702 | −3 | 780 |
| TM.orf0818 | ybfI | AraC family transcriptional regulator | 907367 | 906504 | −2 | 864 |
| TM.orf0819 | caiE | phenylacetic acid degradation protein PaaY | 907543 | 908148 | 1 | 606 |
| TM.orf0820 | | putative ABC transporter ATP-binding protein | 908308 | 909990 | 1 | 1683 |
| TM.orf0821 | | virulence-associated protein D | 910204 | 910410 | 1 | 207 |
| TM.orf0822 | mlaC | toluene tolerance transporter | 911169 | 910477 | −1 | 693 |
| TM.orf0823 | | Surface lipoprotein | 912117 | 911266 | −1 | 852 |
| TM.orf0824 | | transcriptional regulator | 912352 | 913419 | 1 | 1068 |
| TM.orf0825 | metF | 5,10-methylenetetrahydrofolate reductase | 913416 | 914360 | 2 | 945 |
| TM.orf0826 | metH | 5-methyltetrahydrofolate--homocysteine methyltransferase | 914413 | 917922 | 1 | 3510 |
| TM.orf0827 | | NAD(P)(+) transhydrogenase (AB-specific) | 918395 | 919534 | 3 | 1140 |
| TM.orf0828 | | NAD(P)(+) transhydrogenase (AB-specific) | 919531 | 919950 | 1 | 420 |
| TM.orf0829 | pntB | NAD(P) transhydrogenase, beta subunit | 919961 | 921364 | 3 | 1404 |
| TM.orf0830 | tauD | putative alpha-ketoglutarate-dependent taurine dioxygenase | 922702 | 921779 | −3 | 924 |
| TM.orf0831 | | Transcriptional regulator, AraC family protein | 922852 | 923916 | 1 | 1065 |
| TM.orf0832 | | conserved hypothetical protein | 924188 | 923874 | −2 | 315 |
| TM.orf0833 | | 30S ribosomal protein S21 | 924597 | 924391 | −1 | 207 |
| TM.orf0834 | | transcriptional activator, TenA family | 924910 | 925581 | 1 | 672 |
| TM.orf0835 | COQ9 | Ubiquinone biosynthesis protein | 925664 | 926437 | 3 | 774 |
| TM.orf0836 | purK | phosphoribosylaminoimidazole carboxylase ATPase subunit | 927569 | 926454 | −2 | 1116 |
| TM.orf0837 | purE | phosphoribosylcarboxyaminoimidazole mutase | 928135 | 927611 | −3 | 525 |
| TM.orf0838 | | conserved hypothetical protein | 928319 | 928906 | 3 | 588 |
| TM.orf0839 | | sulfatase | 929009 | 930739 | 3 | 1731 |
| TM.orf0840 | | 2-nitropropane dioxygenase | 930795 | 931772 | 2 | 978 |
| TM.orf0841 | | putative transcriptional regulator family | 931811 | 932302 | 3 | 492 |
| TM.orf0842 | | conserved hypothetical protein | 932637 | 932819 | 2 | 183 |
| TM.orf0843 | ubiX | aromatic acid decarboxylase | 933975 | 933316 | −1 | 660 |
| TM.orf0844 | | conserved hypothetical protein | 934076 | 934243 | 3 | 168 |
| TM.orf0845 | alkK | Acyl-CoA synthetase (AMP-forming)/AMP-acid ligase II | 936065 | 934428 | −2 | 1638 |
| TM.orf0846 | acsA | AMP-dependent synthetase and ligase | 938073 | 936157 | −1 | 1917 |
| TM.orf0847 | | hypothetical protein | 938444 | 938578 | 3 | 135 |
| TM.orf0848 | ybfB | MFS-type transporter ybfB | 938618 | 939883 | 3 | 1266 |
| TM.orf0849 | | AAA ATPase | 939969 | 942092 | 2 | 2124 |
| TM.orf0850 | | conserved hypothetical protein | 942089 | 943507 | 3 | 1419 |
| TM.orf0851 | | conserved hypothetical protein | 944176 | 943583 | −3 | 594 |
| TM.orf0852 | | quinone oxidoreductase | 945380 | 944355 | −2 | 1026 |
| TM.orf0853 | rnz | beta-lactamase superfamily hydrolase | 946345 | 945536 | −3 | 810 |
| TM.orf0854 | rnz | beta-lactamase domain protein | 946664 | 947518 | 3 | 855 |
| TM.orf0855 | | cyclase family protein | 948746 | 947757 | −2 | 990 |
| TM.orf0856 | | 3-hydroxybutyrate dehydrogenase | 949225 | 950004 | 1 | 780 |
| TM.orf0857 | | alpha/beta hydrolase fold | 950054 | 950875 | 3 | 822 |
| TM.orf0858 | | putative excisonase protein | 950962 | 951405 | 1 | 444 |
| TM.orf0859 | rutR | TetR family transcriptional regulator | 952074 | 951400 | −1 | 675 |
| TM.orf0860 | yufQ | inner-membrane translocator | 953023 | 952079 | −3 | 945 |
| TM.orf0861 | yufP | permease protein of sugar ABC transporter | 954109 | 953020 | −1 | 1089 |
| TM.orf0862 | yufO | ABC transporter, ATP-binding protein | 955661 | 954105 | −2 | 1557 |
| TM.orf0863 | med | Basic membrane lipoprotein | 956701 | 955721 | −3 | 981 |
| TM.orf0864 | | putative iron/ascorbate oxidoreductase | 956986 | 958041 | 1 | 1056 |
| TM.orf0865 | | sulfite reductase | 959499 | 958093 | −1 | 1407 |
| TM.orf0866 | | hypothetical protein | 959937 | 959536 | −1 | 402 |
| TM.orf0867 | | putative cache sensor protein | 960487 | 959996 | −3 | 492 |
| TM.orf0868 | | glycine betaine/proline transport system substrate-binding protein | 961483 | 960599 | −3 | 885 |
| TM.orf0869 | | binding-protein-dependent transport systems inner membrane component | 962426 | 961581 | −2 | 846 |
| TM.orf0870 | proV | glycine betaine/L-proline ABC transporter, ATPase subunit | 963712 | 962426 | −3 | 1287 |
| TM.orf0871 | | putative addiction module antidote protein, CopG/Arc/MetJ family | 964193 | 964423 | 3 | 231 |
| TM.orf0872 | hspB | small heat shock protein | 965045 | 964605 | −2 | 441 |
| TM.orf0873 | ybfL | transposase, is4 family | 965331 | 966446 | 2 | 1116 |
| TM.orf0874 | rpmE | large subunit ribosomal protein L31 | 966850 | 966629 | −3 | 222 |
| TM.orf0875 | ytxE | OmpA/MotB domain protein | 968218 | 966944 | −3 | 1275 |
| TM.orf0876 | | conserved hypothetical protein | 969468 | 968293 | −1 | 1176 |
| TM.orf0877 | | hypothetical protein | 969997 | 969587 | −3 | 411 |

-continued

| Locus | Gene | Product | Start | End | Strand | Length |
|---|---|---|---|---|---|---|
| TM.orf0878 | suhB | fructose-1 6-bisphosphatase | 971114 | 970272 | −2 | 843 |
| TM.orf0879 | efp | elongation factor P | 971848 | 971282 | −3 | 567 |
| TM.orf0880 | thiE | thiamine-phosphate pyrophosphorylase | 972731 | 972063 | −2 | 669 |
| TM.orf0881 | fbaB | fructose-bisphosphate aldolase | 973648 | 972728 | −3 | 921 |
| TM.orf0882 | | hypothetical protein | 974192 | 973854 | −2 | 339 |
| TM.orf0883 | pgk | phosphoglycerate kinase | 975422 | 974226 | −2 | 1197 |
| TM.orf0884 | gap | glyceraldehyde-3-phosphate dehydrogenase | 976536 | 975532 | −1 | 1005 |
| TM.orf0885 | | hypothetical protein | 976579 | 976710 | 1 | 132 |
| TM.orf0886 | cbbT | transketolase | 978670 | 976667 | −3 | 2004 |
| TM.orf0887 | glnT | putative amino acid carrier protein(sodium/alanine symporter) | 979078 | 980508 | 1 | 1431 |
| TM.orf0888 | aspA | aspartate ammonia-lyase | 980586 | 981959 | 2 | 1374 |
| TM.orf0889 | ansA | cytoplasmic asparaginase I | 982881 | 982036 | −1 | 846 |
| TM.orf0890 | | Aspartate racemase | 983627 | 982881 | −2 | 747 |
| TM.orf0891 | | putative transcriptional regulator | 983797 | 984603 | 1 | 807 |
| TM.orf0892 | | hypothetical protein | 984949 | 985254 | 1 | 306 |
| TM.orf0893 | | conserved hypothetical protein | 985283 | 985633 | 3 | 351 |
| TM.orf0894 | | 5-formyltetrahydrofolate cyclo-ligase | 985909 | 986610 | 1 | 702 |
| TM.orf0895 | ymdB | metallophosphoesterase | 986721 | 987059 | 2 | 339 |
| TM.orf0896 | ymdB | conserved hypothetical protein | 987053 | 987598 | 3 | 546 |
| TM.orf0897 | | conserved hypothetical protein | 987733 | 988482 | 1 | 750 |
| TM.orf0898 | ruvC | crossover junction endodeoxyribonuclease | 988521 | 989021 | 2 | 501 |
| TM.orf0899 | ruvA | Holliday junction ATP-dependent DNA helicase | 989054 | 989701 | 3 | 648 |
| TM.orf0900 | ruvB | Holliday junction DNA helicase B | 989698 | 990759 | 1 | 1062 |
| TM.orf0901 | | tol-pal system-associated acyl-CoA thioesterase | 990862 | 991296 | 1 | 435 |
| TM.orf0902 | gatA | Glutamyl-tRNA(Gln) amidotransferase subunit A | 992736 | 991339 | −1 | 1398 |
| TM.orf0903 | tolQ | biopolymer transport protein | 993294 | 994028 | 2 | 735 |
| TM.orf0904 | tolR | biopolymer transport protein | 994032 | 994490 | 2 | 459 |
| TM.orf0905 | | hypothetical protein | 995062 | 994682 | −3 | 381 |
| TM.orf0906 | | TolA protein | 995410 | 995754 | 1 | 345 |
| TM.orf0907 | tolB | translocation protein TolB | 995751 | 997130 | 2 | 1380 |
| TM.orf0908 | | Outer membrane protein and related peptidoglycan-associated lipo protein | 997284 | 997796 | 2 | 513 |
| TM.orf0909 | | tol-pal system protein YbgF | 998013 | 999008 | 2 | 996 |
| TM.orf0910 | tilS | putative PP-loop superfamily ATPase | 999013 | 1000494 | 1 | 1482 |
| TM.orf0911 | ftsH | cell division protease | 1000491 | 1002434 | 2 | 1944 |
| TM.orf0912 | folP | dihydropteroate synthase | 1002461 | 1003666 | 3 | 1206 |
| TM.orf0913 | glmM | phosphoglucosamine mutase | 1003826 | 1005181 | 3 | 1356 |
| TM.orf0914 | thiD | phosphomethylpyrimidine kinase | 1005334 | 1006173 | 1 | 840 |
| TM.orf0915 | | phosphomethylpyrimidine kinase | 1006170 | 1007015 | 2 | 846 |
| TM.orf0916 | | isomerase | 1007384 | 1008172 | 3 | 789 |
| TM.orf0917 | | GGDEF domain-containing protein | 1009326 | 1008169 | −1 | 1158 |
| TM.orf0918 | serC | phosphoserine aminotransferase | 1009580 | 1010746 | 3 | 1167 |
| TM.orf0919 | serA | D-3-phosphoglycerate dehydrogenase | 1010864 | 1012441 | 3 | 1578 |
| TM.orf0920 | hisZ | ATP phosphoribosyltransferase regulatory subunit | 1012760 | 1013935 | 3 | 1176 |
| TM.orf0921 | purA | adenylosuccinate synthetase | 1013949 | 1015232 | 2 | 1284 |
| TM.orf0922 | | conserved hypothetical protein | 1015398 | 1017425 | 2 | 2028 |
| TM.orf0923 | | conserved hypothetical protein | 1017441 | 1017908 | 2 | 468 |
| TM.orf0924 | livF | branched-chain amino acid ABC transporter, ATP-binding protein | 1018685 | 1017936 | −2 | 750 |
| TM.orf0925 | braF | branched-chain amino acid ABC transporter, ATP-binding protein | 1019443 | 1018685 | −3 | 759 |
| TM.orf0926 | braE | inner-membrane translocator | 1020607 | 1019456 | −3 | 1152 |
| TM.orf0927 | livH | inner-membrane translocator | 1021634 | 1020609 | −2 | 1026 |
| TM.orf0928 | | ABC-type branched-chain amino acid transporter | 1023101 | 1021761 | −2 | 1341 |
| TM.orf0929 | | transcriptional regulator, XRE family protein | 1023300 | 1024766 | 2 | 1467 |
| TM.orf0930 | arlR | protein containing response regulator domain, but no DNA binding domain | 1024837 | 1025208 | 1 | 372 |
| TM.orf0931 | | hypothetical protein | 1025230 | 1025514 | 1 | 285 |
| TM.orf0932 | | Na+/solute symporter | 1025519 | 1028239 | 3 | 2721 |
| TM.orf0933 | | transcriptional regulator MazE | 1028523 | 1028293 | −1 | 231 |
| TM.orf0934 | rpoH | RNA polymerase factor sigma-32 | 1029554 | 1028631 | −2 | 924 |
| TM.orf0935 | rluD | Pseudouridylate synthases, 23S RNA-specific | 1031385 | 1030168 | −1 | 1218 |
| TM.orf0936 | | hypothetical protein | 1031422 | 1031904 | 1 | 483 |
| TM.orf0937 | | Mov34/MPN/PAD-1 | 1031901 | 1032383 | 2 | 483 |
| TM.orf0938 | | (Uracil-5)-methyltransferase | 1032463 | 1034070 | 1 | 1608 |
| TM.orf0939 | ltaE | putative low specificity L-threonine aldolase | 1034067 | 1035119 | 2 | 1053 |
| TM.orf0940 | lcfB | malonyl-CoA synthase | 1035551 | 1037068 | 3 | 1518 |
| TM.orf0941 | ywbO | thiol oxidoreductase FrnE | 1037195 | 1037962 | 3 | 768 |
| TM.orf0942 | mdcF | malonate transporter | 1038916 | 1037981 | −3 | 936 |
| TM.orf0943 | | N-acetyl-gamma-glutamyl-phosphate reductase | 1039420 | 1040418 | 1 | 999 |

| Locus | Gene | Product | Start | End | Strand | Length |
|---|---|---|---|---|---|---|
| TM.orf0944 | puuR | HTH-type transcriptional regulator puuR | 1041265 | 1040717 | −3 | 549 |
| TM.orf0945 | | omega-amino acid-pyruvate aminotransferase | 1041612 | 1042934 | 2 | 1323 |
| TM.orf0946 | ald | alanine dehydrogenase | 1043080 | 1044204 | 1 | 1125 |
| TM.orf0947 | | addiction module antitoxin, RelB/DinJ family | 1044340 | 1044486 | 1 | 147 |
| TM.orf0948 | | putative multidrug-efflux transporter | 1045981 | 1044515 | −3 | 1467 |
| TM.orf0949 | pleC | PAS/PAC sensor signal transduction histidine kinase | 1046185 | 1047351 | 1 | 1167 |
| TM.orf0950 | dadA | glycine/D-amino acid oxidase | 1048626 | 1047364 | −1 | 1263 |
| TM.orf0951 | ygdD | inner membrane protein ygdD | 1048788 | 1049189 | 2 | 402 |
| TM.orf0952 | | hypothetical protein | 1049217 | 1049336 | 2 | 120 |
| TM.orf0953 | | AAA ATPase central domain protein | 1049427 | 1050308 | 2 | 882 |
| TM.orf0954 | | conserved hypothetical protein | 1050366 | 1051544 | 2 | 1179 |
| TM.orf0955 | | hypothetical protein | 1051833 | 1052648 | 2 | 816 |
| TM.orf0956 | macB | ABC transporter related protein | 1054578 | 1052626 | −1 | 1953 |
| TM.orf0957 | macA | RND family efflux transporter MFP subunit | 1055783 | 1054575 | −2 | 1209 |
| TM.orf0958 | | conserved hypothetical protein | 1055843 | 1056796 | 3 | 954 |
| TM.orf0959 | | membrane protein | 1056813 | 1058180 | 2 | 1368 |
| TM.orf0960 | aprE | HlyD family secretion protein | 1059543 | 1058170 | −1 | 1374 |
| TM.orf0961 | aprD | ABC transporter, ATP-binding protein | 1061372 | 1059540 | −2 | 1833 |
| TM.orf0962 | yhjN | Putative ammonia monooxygenase | 1062612 | 1061521 | −1 | 1092 |
| TM.orf0963 | | histone deacetylase-like amidohydrolase | 1062890 | 1063828 | 3 | 939 |
| TM.orf0964 | xseB | Exonuclease VII small subunit | 1063936 | 1064193 | 1 | 258 |
| TM.orf0965 | ispA | geranyltranstferase | 1064250 | 1065176 | 2 | 927 |
| TM.orf0966 | dxs | deoxyxylulose-5-phosphate synthase | 1065466 | 1067403 | 1 | 1938 |
| TM.orf0967 | yqxC | Predicted rRNA methylase | 1067420 | 1068229 | 3 | 810 |
| TM.orf0968 | fnr | transcriptional regulator, Crp | 1068283 | 1068984 | 1 | 702 |
| TM.orf0969 | phbC | PHB de-polymerase | 1070115 | 1068994 | −1 | 1122 |
| TM.orf0970 | | conserved hypothetical protein | 1070686 | 1070255 | −3 | 432 |
| TM.orf0971 | | rhodanese-related sulfurtransferase | 1070835 | 1071209 | 2 | 375 |
| TM.orf0972 | | hypothetical protein | 1071363 | 1071199 | −1 | 165 |
| TM.orf0973 | lcfB | putative long-chain-fatty-acid CoA ligase | 1072995 | 1071436 | −1 | 1560 |
| TM.orf0974 | fadR | TetR family transcriptional regulator | 1073737 | 1073117 | −3 | 621 |
| TM.orf0975 | SCP2 | lipid-transfer protein | 1074051 | 1075232 | 2 | 1182 |
| TM.orf0976 | | conserved hypothetical protein | 1075263 | 1075730 | 2 | 468 |
| TM.orf0977 | FOX2 | MaoC-like dehydratase | 1075727 | 1076113 | 3 | 387 |
| TM.orf0978 | | short-chain dehydrogenase/reductase SDR | 1076176 | 1077003 | 1 | 828 |
| TM.orf0979 | | acyl-CoA dehydrogenase domain protein | 1077080 | 1078240 | 3 | 1161 |
| TM.orf0980 | | conserved hypothetical protein | 1078598 | 1078299 | −2 | 300 |
| TM.orf0981 | | putative epimerase PhzC/PhzF-like protein | 1079828 | 1078869 | −2 | 960 |
| TM.orf0982 | ynjA | conserved hypothetical protein | 1080524 | 1079934 | −2 | 591 |
| TM.orf0983 | aroC | chorismate synthase | 1081676 | 1080603 | −2 | 1074 |
| TM.orf0984 | | short-chain dehydrogenase/reductase SDR | 1082535 | 1081723 | −1 | 813 |
| TM.orf0985 | yfkH | YihY family protein | 1083690 | 1082737 | −1 | 954 |
| TM.orf0986 | | curved DNA-binding protein | 1084583 | 1083687 | −2 | 897 |
| TM.orf0987 | omp | 17 kDa surface antigen precursor | 1085187 | 1084711 | −1 | 477 |
| TM.orf0988 | pdxH | pyridoxamine 5′-phosphate oxidase | 1085540 | 1086133 | 3 | 594 |
| TM.orf0989 | fieF | cation efflux protein | 1086130 | 1087056 | 1 | 927 |
| TM.orf0990 | apt | adenine phosphoribosyltransferase | 1087198 | 1087722 | 1 | 525 |
| TM.orf0991 | tag | DNA-3-methyladenine glycosylase I | 1088343 | 1087750 | −1 | 594 |
| TM.orf0992 | | Predicted aminomethyltransferase related to GcvT | 1089265 | 1088336 | −3 | 930 |
| TM.orf0993 | | glycosyl transferase family protein | 1089430 | 1090422 | 1 | 993 |
| TM.orf0994 | ytcC | glycosyl transferase group 1 | 1090419 | 1091657 | 2 | 1239 |
| TM.orf0995 | lpsD | Glycosyltransferase | 1091647 | 1092765 | 1 | 1119 |
| TM.orf0996 | asnB | asparagine synthase | 1092798 | 1094612 | 2 | 1815 |
| TM.orf0997 | ypfG | conserved hypothetical protein | 1095734 | 1094628 | −2 | 1107 |
| TM.orf0998 | pleC | sensory transduction histidine kinase | 1095958 | 1098360 | 1 | 2403 |
| TM.orf0999 | dcd | deoxycytidine triphosphate deaminase | 1099261 | 1099815 | 1 | 555 |
| TM.orf1000 | murA | UDP-N-acetylglucosamine enolpyruvyl transferase | 1099904 | 1101193 | 3 | 1290 |
| TM.orf1001 | hisG | ATP phosphoribosyltransferase catalytic subunit | 1101245 | 1101928 | 3 | 684 |
| TM.orf1002 | hisD | histidinol dehydrogenase | 1101912 | 1103213 | 2 | 1302 |
| TM.orf1003 | | conserved hypothetical protein | 1103327 | 1103848 | 3 | 522 |
| TM.orf1004 | arsC | low molecular weight phosphotyrosine protein phosphatase | 1103908 | 1104330 | 1 | 423 |
| TM.orf1005 | infA | translation initiation factor 1 | 1104528 | 1104746 | 2 | 219 |
| TM.orf1006 | | maf protein | 1104866 | 1105480 | 3 | 615 |
| TM.orf1007 | rng | ribonuclease G | 1105477 | 1107108 | 1 | 1632 |
| TM.orf1008 | | zinc-binding protein | 1107142 | 1107381 | 1 | 240 |
| TM.orf1009 | | hypothetical protein | 1107832 | 1108107 | 1 | 276 |
| TM.orf1010 | | hypothetical protein | 1108278 | 1108138 | −1 | 141 |
| TM.orf1011 | | amidohydrolase family protein | 1108294 | 1108461 | 1 | 168 |
| TM.orf1012 | | conserved hypothetical protein | 1108729 | 1109280 | 1 | 552 |
| TM.orf1013 | metG | Methionyl-tRNA synthetase | 1110472 | 1109360 | −3 | 1113 |
| TM.orf1014 | | conserved hypothetical protein | 1110999 | 1111595 | 2 | 597 |
| TM.orf1015 | metQ | lipoprotein, YaeC family | 1112465 | 1111677 | −2 | 789 |

| Locus | Gene | Product | Start | End | Strand | Length |
|---|---|---|---|---|---|---|
| TM.orf1016 | cysD | O-acetylhomoserine/O-acetylserine sulfhydrylase | 1114130 | 1112832 | −2 | 1299 |
| TM.orf1017 | leuA | pyruvate carboxyltransferase | 1115574 | 1114237 | −1 | 1338 |
| TM.orf1018 | oxyR | transcriptional regulator, LysR family | 1115785 | 1116711 | 1 | 927 |
| TM.orf1019 | nuoE | NADH dehydrogenase (ubiquinone) 24 kDa subunit | 1116819 | 1117316 | 2 | 498 |
| TM.orf1020 | | putative NAD-dependent formate dehydrogenase beta subunit protein | 1117313 | 1118869 | 3 | 1557 |
| TM.orf1021 | yjgC | formate dehydrogenase, alpha subunit | 1118881 | 1121721 | 1 | 2841 |
| TM.orf1022 | fdhD | formate dehydrogenase accessory protein | 1121738 | 1122535 | 3 | 798 |
| TM.orf1023 | | putative NAD-dependent formate dehydrogenase | 1122552 | 1122764 | 2 | 213 |
| TM.orf1024 | nylB | 6-aminohexanoate-dimer hydrolase | 1123952 | 1122780 | −2 | 1173 |
| TM.orf1025 | gsiA | ABC transporter ATP-binding protein | 1125784 | 1123964 | −3 | 1821 |
| TM.orf1026 | puuC | aldehyde dehydrogenase (acceptor) | 1127313 | 1125781 | −1 | 1533 |
| TM.orf1027 | soxB | Sarcosine oxidase subunit beta | 1128720 | 1127365 | −1 | 1356 |
| TM.orf1028 | | acetyltransferase | 1129144 | 1128707 | −3 | 438 |
| TM.orf1029 | | FAD dependent oxidoreductase | 1129418 | 1130563 | 3 | 1146 |
| TM.orf1030 | appA | ABC superfamily ATP binding cassette transporter substrate-binding protein | 1130651 | 1132309 | 3 | 1659 |
| TM.orf1031 | appB | oligopeptide ABC superfamily ATP binding cassette transporter, membrane protein | 1132328 | 1133278 | 3 | 951 |
| TM.orf1032 | appC | ABC transporter permease | 1133284 | 1134153 | 1 | 870 |
| TM.orf1033 | | transcriptional regulatory protein | 1134178 | 1135080 | 1 | 903 |
| TM.orf1034 | gcvA | major facilitator superfamily MFS_1 | 1136380 | 1135142 | −3 | 1239 |
| TM.orf1035 | ywlC | Sua5/YciO/YrdC/YwlC family protein | 1137113 | 1136391 | −2 | 723 |
| TM.orf1036 | | hypothetical protein | 1137943 | 1137362 | −3 | 582 |
| TM.orf1037 | | hypothetical protein | 1138346 | 1138122 | −2 | 225 |
| TM.orf1038 | | conserved hypothetical protein | 1138468 | 1138971 | 1 | 504 |
| TM.orf1039 | | hypothetical protein | 1138968 | 1139462 | 2 | 495 |
| TM.orf1040 | ycfQ | transcriptional regulator, TetR family protein | 1139539 | 1140165 | 1 | 627 |
| TM.orf1041 | fecI | RNA polymerase sigma-70 family protein | 1140504 | 1141028 | 2 | 525 |
| TM.orf1042 | | putative FecR | 1141025 | 1141987 | 3 | 963 |
| TM.orf1043 | norA | oxidoreductase | 1143149 | 1142049 | −2 | 1101 |
| TM.orf1044 | ycaN | transcriptional regulator LysR family | 1143262 | 1144149 | 1 | 888 |
| TM.orf1045 | foxA | TonB-dependent siderophore receptor | 1144309 | 1146759 | 1 | 2451 |
| TM.orf1046 | | PepSY-associated TM helix domain-containing protein | 1146770 | 1147993 | 3 | 1224 |
| TM.orf1047 | ntaB | Flavin reductase like domain protein | 1148069 | 1148584 | 3 | 516 |
| TM.orf1048 | | iron-sulfur cluster repair di-iron protein | 1148678 | 1149136 | 3 | 459 |
| TM.orf1049 | | signal peptide protein | 1149672 | 1149154 | −1 | 519 |
| TM.orf1050 | | phosphoglycerate mutase family protein | 1149860 | 1150432 | 3 | 573 |
| TM.orf1051 | ybfB | major facilitator superfamily MFS_1 | 1150696 | 1151955 | 1 | 1260 |
| TM.orf1052 | | hypothetical protein | 1151979 | 1152560 | 2 | 582 |
| TM.orf1053 | ubiG | 3-demethylubiquinone-9 3-O-methyltransferase | 1153440 | 1152544 | −1 | 897 |
| TM.orf1054 | | peptidase M50 | 1154597 | 1153437 | −2 | 1161 |
| TM.orf1055 | | Lantibiotic dehydratase domain protein | 1157020 | 1154594 | −3 | 2427 |
| TM.orf1056 | | hypothetical protein | 1157871 | 1157017 | −1 | 855 |
| TM.orf1057 | | conserved hypothetical protein | 1158788 | 1157871 | −2 | 918 |
| TM.orf1058 | eamB | Lysine exporter protein (LYSE/YGGA) | 1159483 | 1158854 | −3 | 630 |
| TM.orf1059 | | radical SAM domain-containing protein | 1161690 | 1159567 | −1 | 2124 |
| TM.orf1060 | | hypothetical protein | 1162116 | 1161901 | −1 | 216 |
| TM.orf1061 | | conserved hypothetical protein | 1162425 | 1162712 | 2 | 288 |
| TM.orf1062 | yfkN | alkaline phosphatase | 1162922 | 1167649 | 3 | 4728 |
| TM.orf1063 | prtC | Secreted protease C | 1167664 | 1169685 | 1 | 2022 |
| TM.orf1064 | | TolC family type I secretion outer membrane protein | 1169792 | 1171222 | 3 | 1431 |
| TM.orf1065 | paxB | putative exotoxin translocation ATP-binding protein PaxB | 1171219 | 1173030 | 1 | 1812 |
| TM.orf1066 | cyaD | type I secretion membrane fusion protein, HlyD family | 1173020 | 1174321 | 3 | 1302 |
| TM.orf1067 | | conserved hypothetical protein | 1175412 | 1174330 | −1 | 1083 |
| TM.orf1068 | pleC | Signal transduction histidine kinase | 1175791 | 1177161 | 1 | 1371 |
| TM.orf1069 | acoD | acetaldehyde dehydrogenase | 1177358 | 1178905 | 3 | 1548 |
| TM.orf1070 | | conserved hypothetical protein | 1178941 | 1179459 | 1 | 519 |
| TM.orf1071 | | conserved hypothetical protein | 1179570 | 1180430 | 2 | 861 |
| TM.orf1072 | | pyridoxamine 5′-phosphate oxidase-related FMN-binding protein | 1180529 | 1180996 | 3 | 468 |
| TM.orf1073 | | conserved hypothetical protein | 1181468 | 1180980 | −2 | 489 |
| TM.orf1074 | fliS | flagellar protein FliS | 1182138 | 1181662 | −1 | 477 |
| TM.orf1075 | fliD | flagellar hook-associated protein 2 (FliD, filament cap protein) precursor | 1184293 | 1182170 | −3 | 2124 |
| TM.orf1076 | | flagellar protein FlaG | 1184798 | 1184376 | −2 | 423 |
| TM.orf1077 | | flagellin | 1186200 | 1185037 | −1 | 1164 |
| TM.orf1078 | | flagellin domain protein | 1187778 | 1186615 | −1 | 1164 |
| TM.orf1079 | | alkylhydroperoxidase like protein, AhpD family | 1188104 | 1188586 | 3 | 483 |

-continued

| Locus | Gene | Product | Start | End | Strand | Length |
|---|---|---|---|---|---|---|
| TM.orf1080 | | conserved hypothetical protein | 1189248 | 1188577 | −1 | 672 |
| TM.orf1081 | | conserved hypothetical protein | 1191698 | 1189254 | −2 | 2445 |
| TM.orf1082 | celY | cellulase | 1192993 | 1191689 | −3 | 1305 |
| TM.orf1083 | | cellulose synthase subunit B | 1195779 | 1192990 | −1 | 2790 |
| TM.orf1084 | bcsA | putative cellulose synthase catalytic subunit | 1198133 | 1195797 | −2 | 2337 |
| TM.orf1085 | fliB | Lysine-N-methylase | 1199528 | 1198353 | −2 | 1176 |
| TM.orf1086 | fliW | Flagellar assembly factor fliW | 1200072 | 1199554 | −1 | 519 |
| TM.orf1087 | | flagellar hook-associated protein FlgL | 1201094 | 1200192 | −2 | 903 |
| TM.orf1088 | flgK | flagellar hook-associated protein | 1202984 | 1201173 | −2 | 1812 |
| TM.orf1089 | | hypothetical protein | 1203537 | 1203016 | −1 | 522 |
| TM.orf1090 | | chemotactic signal-response protein CheL | 1203952 | 1203569 | −3 | 384 |
| TM.orf1091 | flgI | flagellar P-ring protein precursor | 1205127 | 1203964 | −1 | 1164 |
| TM.orf1092 | | flagellar assembly regulator FliX | 1205467 | 1205895 | 1 | 429 |
| TM.orf1093 | dksA | DnaK suppressor protein | 1206017 | 1206433 | 3 | 417 |
| TM.orf1094 | pleC | putative sensory box histidine kinase | 1206708 | 1209452 | 2 | 2745 |
| TM.orf1095 | | flagellar basal body L-ring protein | 1210260 | 1209466 | −1 | 795 |
| TM.orf1096 | flgA | flagellar basal body P-ring biosynthesis protein FlgA | 1211316 | 1210324 | −1 | 993 |
| TM.orf1097 | flgG | flagellar basal-body rod protein FlgG | 1212149 | 1211364 | −2 | 786 |
| TM.orf1098 | flgF | flagellar basal-body rod protein | 1212950 | 1212198 | −2 | 753 |
| TM.orf1099 | fliL | flagellar basal body-associated protein | 1213326 | 1213868 | 2 | 543 |
| TM.orf1100 | fliM | flagellar motor switch protein FliM | 1213924 | 1215030 | 1 | 1107 |
| TM.orf1101 | | ATPase involved in DNA repair | 1215027 | 1215620 | 2 | 594 |
| TM.orf1102 | | FlaA locus 229 kDa protein | 1215704 | 1216519 | 3 | 816 |
| TM.orf1103 | cheY | Response regulator receiver | 1216543 | 1216929 | 1 | 387 |
| TM.orf1104 | | chemotaxis protein CheZ | 1216979 | 1217641 | 3 | 663 |
| TM.orf1105 | | PPE-repeat protein (cell mobility) | 1217692 | 1218354 | 1 | 663 |
| TM.orf1106 | ytxE | chemotaxis MotB protein | 1218351 | 1219100 | 2 | 750 |
| TM.orf1107 | | conserved hypothetical protein | 1219097 | 1222261 | 3 | 3165 |
| TM.orf1108 | rlmI | methyltransferase | 1222402 | 1223379 | 1 | 978 |
| TM.orf1109 | ysgA | rRNA methylase | 1223383 | 1224210 | 1 | 828 |
| TM.orf1110 | | hypothetical protein | 1224235 | 1224495 | 1 | 261 |
| TM.orf1111 | dhaR | TetR/AcrR family transcriptional regulator | 1224589 | 1225215 | 1 | 627 |
| TM.orf1112 | | hypothetical protein | 1224617 | 1224492 | −2 | 126 |
| TM.orf1113 | linC | 2,5-dichloro-2,5-cyclohexadiene-1,4-dioldehydrogenase | 1225281 | 1226045 | 2 | 765 |
| TM.orf1114 | | DMT family permease | 1226948 | 1226052 | −2 | 897 |
| TM.orf1115 | lrhA | LysR family transcriptional regulator | 1227106 | 1227975 | 1 | 870 |
| TM.orf1116 | fliP | flagellar biosynthetic protein FliP | 1229494 | 1228724 | −3 | 771 |
| TM.orf1117 | | hypothetical protein | 1229949 | 1229491 | −1 | 459 |
| TM.orf1118 | | hypothetical protein | 1230402 | 1230043 | −1 | 360 |
| TM.orf1119 | ylqH | flagellar biosynthetic protein FlhB | 1230732 | 1230448 | −1 | 285 |
| TM.orf1120 | csrA | carbon storage regulator | 1231119 | 1230856 | −1 | 264 |
| TM.orf1121 | flgB | flagellar basal body rod protein FlgB | 1231481 | 1231903 | 3 | 423 |
| TM.orf1122 | flgC | flagellar basal-body rod protein FlgC | 1231952 | 1232359 | 3 | 408 |
| TM.orf1123 | fliE | flagellar hook-basal body complex protein FliE | 1232420 | 1232734 | 3 | 315 |
| TM.orf1124 | yscS | flagellar biosynthetic protein FNQ | 1232807 | 1233082 | 3 | 276 |
| TM.orf1125 | fliR | flagellar biosynthesis protein FliR | 1233102 | 1233857 | 2 | 756 |
| TM.orf1126 | flhB | flagellar biosynthetic protein FlhB | 1233875 | 1234954 | 3 | 1080 |
| TM.orf1127 | | cell cycle histidine kinase CckA | 1235020 | 1236945 | 1 | 1926 |
| TM.orf1128 | | hypothetical protein | 1237585 | 1237100 | −3 | 486 |
| TM.orf1129 | recA | RecA protein | 1237929 | 1239029 | 2 | 1101 |
| TM.orf1130 | alaS | alanyl-tRNA synthetase | 1239345 | 1241999 | 2 | 2655 |
| TM.orf1131 | | conserved hypothetical protein | 1243214 | 1242069 | −2 | 1146 |
| TM.orf1132 | rhsD | nematicidal protein 2 | 1248254 | 1243263 | −2 | 4992 |
| TM.orf1133 | | putative acetyltransferase | 1249003 | 1248464 | −3 | 540 |
| TM.orf1134 | yjiA | cobalamin synthesis protein CobW | 1250103 | 1249000 | −1 | 1104 |
| TM.orf1135 | | 3-hydroxyacyl-CoA dehydrogenase (hdb-1) | 1250300 | 1251193 | 3 | 894 |
| TM.orf1136 | icd | isocitrate dehydrogenase | 1252543 | 1251296 | −3 | 1248 |
| TM.orf1137 | | hypothetical protein | 1252775 | 1253668 | 3 | 894 |
| TM.orf1138 | ygaU | protein containing LysM domain | 1253779 | 1255026 | 1 | 1248 |
| TM.orf1139 | ywfA | MFS-type transporter ywfA | 1256268 | 1255027 | −1 | 1242 |
| TM.orf1140 | | hypothetical protein | 1259653 | 1259456 | −3 | 198 |
| TM.orf1141 | | hypothetical protein | 1261070 | 1259721 | −2 | 1350 |
| TM.orf1142 | yezE | TetR family transcriptional regulator | 1261874 | 1261266 | −2 | 609 |
| TM.orf1143 | | conserved hypothetical protein | 1261993 | 1262910 | 1 | 918 |
| TM.orf1144 | yfcG | glutathione S-transferase domain-containing protein | 1262966 | 1263670 | 3 | 705 |
| TM.orf1145 | yfcG | Glutathione S-transferase domain protein | 1263679 | 1264389 | 1 | 711 |
| TM.orf1146 | rbsC | methyl-galactoside transport system permease protein | 1265469 | 1264411 | −1 | 1059 |
| TM.orf1147 | | ABC transporter ATP-binding protein | 1266995 | 1265466 | −2 | 1530 |
| TM.orf1148 | torT | ABC transporter substrate-binding protein | 1268159 | 1267098 | −2 | 1062 |
| TM.orf1149 | kipA | urea amidolyase related protein | 1269275 | 1268304 | −2 | 972 |
| TM.orf1150 | | allophanate hydrolase subunit 1 | 1270140 | 1269265 | −1 | 876 |
| TM.orf1151 | accC | biotin carboxylase | 1271514 | 1270150 | −1 | 1365 |

-continued

| Locus | Gene | Product | Start | End | Strand | Length |
|---|---|---|---|---|---|---|
| TM.orf1152 | | acetyl-CoA carboxylase biotin carboxyl carrier protein | 1271758 | 1271522 | −3 | 237 |
| TM.orf1153 | | conserved hypothetical protein | 1272647 | 1271865 | −2 | 783 |
| TM.orf1154 | cynR | transcriptional regulator | 1272913 | 1273836 | 1 | 924 |
| TM.orf1155 | | cupin superfamily protein | 1274097 | 1275260 | 2 | 1164 |
| TM.orf1156 | pfpI | proteinase | 1275836 | 1275285 | −2 | 552 |
| TM.orf1157 | | conserved hypothetical protein | 1276516 | 1275911 | −3 | 606 |
| TM.orf1158 | ynjF | phosphatidylglycerophosphate synthase | 1276707 | 1277315 | 2 | 609 |
| TM.orf1159 | | conserved hypothetical protein | 1277454 | 1278356 | 2 | 903 |
| TM.orf1160 | ydjF | transcriptional regulator, DeoR family | 1278360 | 1279133 | 2 | 774 |
| TM.orf1161 | ytfG | oxidoreductase ytfG | 1280016 | 1279138 | −1 | 879 |
| TM.orf1162 | ytcD | putative HTH-type transcriptional regulator | 1280138 | 1280497 | 3 | 360 |
| TM.orf1163 | mdtC | AcrB | 1283531 | 1280535 | −2 | 2997 |
| TM.orf1164 | | Membrane-fusion protein | 1284902 | 1283676 | −2 | 1227 |
| TM.orf1165 | padR | transcriptional regulator, PadR family protein | 1285456 | 1284899 | −3 | 558 |
| TM.orf1166 | | dtdp-glucose 4,6-dehydratase | 1286620 | 1285598 | −3 | 1023 |
| TM.orf1167 | | NAD-dependent epimerase/dehydratase | 1287306 | 1286620 | −1 | 687 |
| TM.orf1168 | | methyltransferase, UbiE | 1288319 | 1287462 | −2 | 858 |
| TM.orf1169 | glmU | molybdopterin binding domain-containing protein | 1290137 | 1288446 | −2 | 1692 |
| TM.orf1170 | pucA | xanthine dehydrogenase accessory factor | 1290925 | 1290194 | −3 | 732 |
| TM.orf1171 | yqeB | XdhC/CoxI family protein | 1291280 | 1290942 | −2 | 339 |
| TM.orf1172 | | VWA containing CoxE family protein | 1292545 | 1291286 | −3 | 1260 |
| TM.orf1173 | | ATPase associated with various cellular activities | 1293426 | 1292542 | −1 | 885 |
| TM.orf1174 | cutM | carbon-monoxide dehydrogenase (acceptor) | 1294473 | 1293673 | −1 | 801 |
| TM.orf1175 | cutL | carbon monoxide dehydrogenase large chain | 1296922 | 1294535 | −3 | 2388 |
| TM.orf1176 | cutS | carbon monoxide dehydrogenase small chain | 1297463 | 1296993 | −2 | 471 |
| TM.orf1177 | ghrA | D-isomer specific 2-hydroxyacid dehydrogenase, NAD-binding | 1298852 | 1297899 | −2 | 954 |
| TM.orf1178 | | hypothetical protein | 1299190 | 1298951 | −3 | 240 |
| TM.orf1179 | | hypothetical protein | 1299598 | 1299329 | −3 | 270 |
| TM.orf1180 | narP | two-component response regulator | 1299787 | 1300494 | 1 | 708 |
| TM.orf1181 | appC | ABC transporter permease protein | 1301407 | 1300499 | −3 | 909 |
| TM.orf1182 | gsiC | binding-protein-dependent transport systems inner membrane component | 1302342 | 1301404 | −1 | 939 |
| TM.orf1183 | | oligopeptide/dipeptide ABC transporter, ATPase subunit | 1303335 | 1302349 | −1 | 987 |
| TM.orf1184 | | ABC transporter ATP binding protein | 1304318 | 1303389 | −2 | 930 |
| TM.orf1185 | dppA | oligopeptide ABC transpoter oligopeptide-binding protein | 1305889 | 1304315 | −3 | 1575 |
| TM.orf1186 | | conserved hypothetical protein | 1306808 | 1305963 | −2 | 846 |
| TM.orf1187 | | TetR family transcriptional regulator | 1306998 | 1307657 | 2 | 660 |
| TM.orf1188 | | conserved hypothetical protein | 1307758 | 1308891 | 1 | 1134 |
| TM.orf1189 | | allophanate hydrolase | 1309273 | 1308911 | −3 | 363 |
| TM.orf1190 | rutB | isochorismatase family protein | 1309950 | 1309270 | −1 | 681 |
| TM.orf1191 | yufO | putative ABC transporter ATP-binding protein | 1311546 | 1309969 | −1 | 1578 |
| TM.orf1192 | | isochorismatase family protein | 1312235 | 1311543 | −2 | 693 |
| TM.orf1193 | yufQ | ABC transporter permease protein | 1313199 | 1312273 | −1 | 927 |
| TM.orf1194 | | putative simple sugar transport system permease protein | 1314322 | 1313204 | −3 | 1119 |
| TM.orf1195 | med | simple sugar transport system substrate-binding protein | 1315523 | 1314414 | −2 | 1110 |
| TM.orf1196 | ydfH | transcriptional regulator, GntR family | 1315916 | 1316635 | 3 | 720 |
| TM.orf1197 | | Urea amidolyase | 1316648 | 1318471 | 3 | 1824 |
| TM.orf1198 | | anti-sigma-factor antagonist | 1318884 | 1318495 | −1 | 390 |
| TM.orf1199 | mobA | molybdopterin-guanine dinucleotide biosynthesis protein A | 1319614 | 1318931 | −3 | 684 |
| TM.orf1200 | sugE | small multidrug resistance protein | 1319848 | 1320168 | 1 | 321 |
| TM.orf1201 | | cold-shock DNA-binding domain-containing protein | 1320334 | 1320687 | 1 | 354 |
| TM.orf1202 | yiaO | TRAP dicarboxylate transporter- DctP subunit | 1320940 | 1322001 | 1 | 1062 |
| TM.orf1203 | | hypothetical protein | 1322006 | 1322500 | 3 | 495 |
| TM.orf1204 | | TRAP dicarboxylate transporter, DctM subunit | 1322497 | 1323801 | 1 | 1305 |
| TM.orf1205 | | long-chain-fatty-acid--CoA ligase | 1323806 | 1324267 | 3 | 462 |
| TM.orf1206 | lcfB | AMP-dependent synthetase and ligase | 1324240 | 1325400 | 1 | 1161 |
| TM.orf1207 | | hypothetical protein | 1325530 | 1325820 | 1 | 291 |
| TM.orf1208 | ygaZ | AzlC family protein | 1325859 | 1326626 | 2 | 768 |
| TM.orf1209 | | branched-chain amino acid transport | 1326626 | 1326946 | 3 | 321 |
| TM.orf1210 | pepN | membrane alanyl aminopeptidase | 1327064 | 1329727 | 3 | 2664 |
| TM.orf1211 | | 4-chloro-3-hydroxybutyrate hydrolase | 1330982 | 1329804 | −2 | 1179 |
| TM.orf1212 | | transcriptional regulator, AraC family | 1331259 | 1331786 | 2 | 528 |
| TM.orf1213 | thcR | transcriptional regulator, AraC family | 1331747 | 1332259 | 3 | 513 |
| TM.orf1214 | | Methyl-accepting chemotaxis protein | 1333700 | 1332351 | −2 | 1350 |
| TM.orf1215 | ycbC | conserved hypothetical protein | 1333892 | 1334713 | 3 | 822 |
| TM.orf1216 | cph2 | Phytochrome-like protein cph2 | 1334862 | 1337087 | 2 | 2226 |

| Locus | Gene | Product | Start | End | Strand | Length |
|---|---|---|---|---|---|---|
| TM.orf1217 | | YbaK/prolyl-tRNA synthetase associated region | 1337299 | 1337096 | −3 | 204 |
| TM.orf1218 | ppnK | Predicted sugar kinase | 1338173 | 1337343 | −2 | 831 |
| TM.orf1219 | moaA | molybdenum cofactor biosynthesis protein A | 1339224 | 1338181 | −1 | 1044 |
| TM.orf1220 | | conserved hypothetical protein | 1340486 | 1339377 | −2 | 1110 |
| TM.orf1221 | | conserved hypothetical protein | 1341012 | 1340800 | −1 | 213 |
| TM.orf1222 | | hypothetical protein | 1341287 | 1341955 | 3 | 669 |
| TM.orf1223 | cheA | CheA Signal transduction histidine Kinases (STHK) | 1342075 | 1344816 | 1 | 2742 |
| TM.orf1224 | cheW | Chemotaxis signal transduction protein | 1344813 | 1345310 | 2 | 498 |
| TM.orf1225 | cheY | FOG: CheY-like receiver | 1345407 | 1345772 | 2 | 366 |
| TM.orf1226 | cheB | chemotaxis-specific methylesterase | 1345820 | 1347007 | 3 | 1188 |
| TM.orf1227 | | chemotaxis protein methyltransferase CheR | 1347007 | 1347816 | 1 | 810 |
| TM.orf1228 | ctrA | two-component response regulator | 1348673 | 1347942 | −2 | 732 |
| TM.orf1229 | fliI | flagellum-specific ATP synthase | 1348922 | 1350259 | 3 | 1338 |
| TM.orf1230 | | hypothetical protein | 1350266 | 1350706 | 3 | 441 |
| TM.orf1231 | | conserved hypothetical protein | 1351202 | 1352383 | 3 | 1182 |
| TM.orf1232 | yfiL | ABC transporter related protein | 1352388 | 1353380 | 2 | 993 |
| TM.orf1233 | | ABC transporter permease protein | 1353373 | 1354323 | 1 | 951 |
| TM.orf1234 | ybfB | major facilitator superfamily MFS_1 | 1355611 | 1354358 | −3 | 1254 |
| TM.orf1235 | yjdC | transcriptional regulator, TetR family protein | 1356283 | 1355675 | −3 | 609 |
| TM.orf1236 | | conserved hypothetical protein | 1356803 | 1356336 | −2 | 468 |
| TM.orf1237 | | conserved hypothetical protein | 1357954 | 1356872 | −3 | 1083 |
| TM.orf1238 | ylxH | FleN | 1361632 | 1360847 | −3 | 786 |
| TM.orf1239 | | FlhF | 1362951 | 1361629 | −1 | 1323 |
| TM.orf1240 | flhA | flagellar biosynthesis pathway, component FlhA | 1365160 | 1363037 | −3 | 2124 |
| TM.orf1241 | flbD | Response regulator containing CheY-like receiver, AAA-type ATPase, and DNA-binding domains | 1366774 | 1365245 | −3 | 1530 |
| TM.orf1242 | pomA | chemotaxis protein | 1367656 | 1366889 | −3 | 768 |
| TM.orf1243 | fliN | flagellar motor switch protein | 1368111 | 1367758 | −1 | 354 |
| TM.orf1244 | | flagellar assembly protein H | 1368888 | 1368181 | −1 | 708 |
| TM.orf1245 | fliG | flagellar motor switch protein G | 1369955 | 1368933 | −2 | 1023 |
| TM.orf1246 | fliF | flagellar MS-ring protein | 1371668 | 1369962 | −2 | 1707 |
| TM.orf1247 | | conserved hypothetical protein | 1372410 | 1372048 | −1 | 363 |
| TM.orf1248 | flgE | Flagellar hook protein flgE | 1374276 | 1372573 | −1 | 1704 |
| TM.orf1249 | flgD | flagellar basal-body rod modification protein FlgD | 1375223 | 1374444 | −2 | 780 |
| TM.orf1250 | | flagellar hook-length control protein | 1378290 | 1375246 | −1 | 3045 |
| TM.orf1251 | pleC | PAS/PAC sensor signal transduction histidine kinase | 1379682 | 1378405 | −1 | 1278 |
| TM.orf1252 | chaC | ChaC-like protein | 1380628 | 1379810 | −3 | 819 |
| TM.orf1253 | | acetoacetyl-CoA synthetase | 1380890 | 1382917 | 3 | 2028 |
| TM.orf1254 | cph2 | GGDEF family protein | 1383065 | 1384003 | 3 | 939 |
| TM.orf1255 | soxR | LysR family transcriptional regulator | 1384044 | 1384946 | 2 | 903 |
| TM.orf1256 | ccpA | cytochrome c551 peroxidase precursor | 1385079 | 1386113 | 2 | 1035 |
| TM.orf1257 | | conserved hypothetical protein | 1387205 | 1386129 | −2 | 1077 |
| TM.orf1258 | | anthranilate synthase | 1389504 | 1387342 | −1 | 2163 |
| TM.orf1259 | bigR | ArsR family transcriptional regulator | 1389867 | 1390208 | 2 | 342 |
| TM.orf1260 | | YeeE/YedE family protein | 1390205 | 1390642 | 3 | 438 |
| TM.orf1261 | | membrane protein | 1390709 | 1391170 | 3 | 462 |
| TM.orf1262 | | metallo-beta-lactamase family protein | 1391175 | 1392083 | 2 | 909 |
| TM.orf1263 | | conserved hypothetical protein | 1392135 | 1392353 | 2 | 219 |
| TM.orf1264 | | sulfate transporter | 1392393 | 1394147 | 2 | 1755 |
| TM.orf1265 | | conserved hypothetical protein | 1394285 | 1395940 | 3 | 1656 |
| TM.orf1266 | | conserved hypothetical protein | 1396591 | 1395983 | −3 | 609 |
| TM.orf1267 | | conserved hypothetical protein | 1397805 | 1396579 | −1 | 1227 |
| TM.orf1268 | ydeM | Anaerobic sulfatase-maturating enzyme homolog ydeM | 1399284 | 1397824 | −1 | 1461 |
| TM.orf1269 | | hypothetical protein | 1399613 | 1399281 | −2 | 333 |
| TM.orf1270 | bdlA | methyl-accepting chemotaxis protein | 1401211 | 1399727 | −3 | 1485 |
| TM.orf1271 | | conserved hypothetical protein | 1401687 | 1402514 | 2 | 828 |
| TM.orf1272 | dctP | TRAP dicarboxylate transporter- DctP subunit | 1402599 | 1403675 | 2 | 1077 |
| TM.orf1273 | | conserved hypothetical protein | 1403734 | 1404342 | 1 | 609 |
| TM.orf1274 | siaT | TRAP dicarboxylate transporter, DctM subunit | 1404412 | 1405698 | 1 | 1287 |
| TM.orf1275 | | conserved hypothetical protein | 1405788 | 1406468 | 2 | 681 |
| TM.orf1276 | gatA | Glutamyl-tRNA(Gln) amidotransferase subunit A | 1406534 | 1407892 | 3 | 1359 |
| TM.orf1277 | | amidase | 1407916 | 1408734 | 1 | 819 |
| TM.orf1278 | namA | NADH: flavin oxidoreductase/NADH oxidase | 1408859 | 1410016 | 3 | 1158 |
| TM.orf1279 | | hypothetical protein | 1410145 | 1410306 | 1 | 162 |
| TM.orf1280 | mntB | ABC transporter component | 1410303 | 1411064 | 2 | 762 |
| TM.orf1281 | mntC | ABC transporter permease protein | 1411083 | 1411967 | 2 | 885 |
| TM.orf1282 | | periplasmic solute binding protein | 1411964 | 1412929 | 3 | 966 |
| TM.orf1283 | | helix-turn-helix type 11 domain-containing protein | 1413590 | 1412898 | −2 | 693 |
| TM.orf1284 | | conserved hypothetical protein | 1413958 | 1413596 | −3 | 363 |

| Locus | Gene | Product | Start | End | Strand | Length |
|---|---|---|---|---|---|---|
| TM.orf1285 | Peci | enoyl-CoA hydratase/isomerase | 1415250 | 1414009 | −1 | 1242 |
| TM.orf1286 | lcfB | AMP-binding domain protein | 1417269 | 1415335 | −1 | 1935 |
| TM.orf1287 | | Short-chain alcohol dehydrogenase of unknown specificity | 1417502 | 1418254 | 3 | 753 |
| TM.orf1288 | rutR | transcriptional regulator, TetR family protein | 1418422 | 1419123 | 1 | 702 |
| TM.orf1289 | alsB | D-allose-binding periplasmic protein | 1419446 | 1420483 | 3 | 1038 |
| TM.orf1290 | rbsA | ABC transporter related protein | 1420601 | 1422166 | 3 | 1566 |
| TM.orf1291 | rbsC | inner-membrane translocator | 1422163 | 1423200 | 1 | 1038 |
| TM.orf1292 | sorC | transcriptional regulator, DeoR family | 1423261 | 1424268 | 1 | 1008 |
| TM.orf1293 | glpD | Glycerol-3-phosphate dehydrogenase | 1424428 | 1426194 | 1 | 1767 |
| TM.orf1294 | | aldolase protein | 1426249 | 1427091 | 1 | 843 |
| TM.orf1295 | lyx | L-xylulose kinase protein | 1427157 | 1428653 | 2 | 1497 |
| TM.orf1296 | | putative dehydrogenase | 1429452 | 1428658 | −1 | 795 |
| TM.orf1297 | | conserved hypothetical protein | 1430636 | 1429497 | −2 | 1140 |
| TM.orf1298 | | TetR family transcriptional regulator | 1430704 | 1431333 | 1 | 630 |
| TM.orf1299 | | conserved hypothetical protein | 1433151 | 1431346 | −1 | 1806 |
| TM.orf1300 | fecI | ECF subfamily RNA polymerase sigma factor | 1433359 | 1433928 | 1 | 570 |
| TM.orf1301 | | sigma factor regulatory protein FecR/PupR family | 1433928 | 1434968 | 2 | 1041 |
| TM.orf1302 | irgA | TonB-dependent receptor | 1435150 | 1437471 | 1 | 2322 |
| TM.orf1303 | | hypothetical protein | 1437570 | 1437866 | 2 | 297 |
| TM.orf1304 | | conserved hypothetical protein | 1437863 | 1439428 | 3 | 1566 |
| TM.orf1305 | | hypothetical protein | 1439425 | 1439766 | 1 | 342 |
| TM.orf1306 | ywfM | transporter ywfM | 1440649 | 1439717 | −3 | 933 |
| TM.orf1307 | | TetR family transcriptional regulator | 1441344 | 1440688 | −1 | 657 |
| TM.orf1308 | | hypothetical protein | 1442035 | 1442223 | 1 | 189 |
| TM.orf1309 | | conserved hypothetical protein | 1442292 | 1442507 | 2 | 216 |
| TM.orf1310 | | hypothetical protein | 1442531 | 1442734 | 3 | 204 |
| TM.orf1311 | pqqE | Coenzyme PQQ synthesis protein E | 1442877 | 1444391 | 2 | 1515 |
| TM.orf1312 | | TonB-dependent receptor | 1444961 | 1447168 | 3 | 2208 |
| TM.orf1313 | | rhizobiocin/RTX toxin and hemolysin-type calcium binding protein | 1448826 | 1447252 | −1 | 1575 |
| TM.orf1314 | cya | calcium binding hemolysin protein | 1452588 | 1449004 | −1 | 3585 |
| TM.orf1315 | | hemolysin-type calcium-binding repeat family protein | 1454350 | 1452965 | −3 | 1386 |
| TM.orf1316 | cya | proprotein convertase P | 1457577 | 1454641 | −1 | 2937 |
| TM.orf1317 | araQ | ABC superfamily ATP binding cassette transporter, membrane protein | 1458683 | 1457808 | −2 | 876 |
| TM.orf1318 | yurN | inner membrane component of binding-protein-dependent transport system | 1459558 | 1458680 | −3 | 879 |
| TM.orf1319 | ugpB | extracellular solute-binding protein | 1460942 | 1459650 | −2 | 1293 |
| TM.orf1320 | ugpC | ABC superfamily ATP binding cassette transporter, ABC protein | 1462072 | 1460972 | −3 | 1101 |
| TM.orf1321 | glpR | transcriptional regulator, DeoR family | 1462836 | 1462069 | −1 | 768 |
| TM.orf1322 | ypeA | acetyltransferase, GNAT family | 1463231 | 1463707 | 3 | 477 |
| TM.orf1323 | aprE | peptidase S8 and S53, subtilisin, kexin, sedolisin | 1463916 | 1466324 | 2 | 2409 |
| TM.orf1324 | | WD-40 repeat protein | 1467482 | 1466412 | −2 | 1071 |
| TM.orf1325 | | cobalamin synthesis protein, P47K | 1468521 | 1467466 | −1 | 1056 |
| TM.orf1326 | | conserved hypothetical protein | 1468785 | 1469552 | 2 | 768 |
| TM.orf1327 | | hypothetical protein | 1469561 | 1469698 | 3 | 138 |
| TM.orf1328 | | lysine exporter protein LysE/YggA | 1470401 | 1469760 | −2 | 642 |
| TM.orf1329 | | AsnC family transcriptional regulator | 1470889 | 1470398 | −3 | 492 |
| TM.orf1330 | hxuC | TonB-dependent hemoglobin | 1471277 | 1473346 | 3 | 2070 |
| TM.orf1331 | hemP | hemin uptake protein HemP | 1473394 | 1473591 | 1 | 198 |
| TM.orf1332 | hmuS | hemin transport protein | 1473602 | 1474663 | 3 | 1062 |
| TM.orf1333 | hmuT | periplasmic binding protein | 1474663 | 1475559 | 1 | 897 |
| TM.orf1334 | hmuU | putative ABC-type Fe3+-siderophore transport system, permease component | 1475564 | 1476712 | 3 | 1149 |
| TM.orf1335 | hmuV | ABC-type hemin transport system, ATPase component | 1476730 | 1477518 | 1 | 789 |
| TM.orf1336 | bioI | cytochrome P450 hydroxylase | 1478788 | 1477532 | −3 | 1257 |
| TM.orf1337 | mscL | large conductance mechanosensitive channel protein | 1479044 | 1479484 | 3 | 441 |
| TM.orf1338 | | conserved hypothetical protein | 1481042 | 1479507 | −2 | 1536 |
| TM.orf1339 | | outer membrane protein | 1481600 | 1482310 | 3 | 711 |
| TM.orf1340 | | conserved hypothetical protein | 1482576 | 1483103 | 2 | 528 |
| TM.orf1341 | tolQ | MotA/TolQ/ExbB proton channel | 1483635 | 1484510 | 2 | 876 |
| TM.orf1342 | | hypothetical protein | 1484536 | 1484949 | 1 | 414 |
| TM.orf1343 | | hypothetical protein | 1484946 | 1485374 | 2 | 429 |
| TM.orf1344 | tonB | TonB-like protein | 1485371 | 1486483 | 3 | 1113 |
| TM.orf1345 | | glycosyl transferase family 2 | 1489295 | 1486617 | −2 | 2679 |
| TM.orf1346 | | hypothetical protein | 1489715 | 1489996 | 3 | 282 |
| TM.orf1347 | | triacylglycerol lipase | 1491806 | 1490001 | −2 | 1806 |
| TM.orf1348 | glk | glucokinase | 1492005 | 1493099 | 2 | 1095 |
| TM.orf1349 | | agmatine deiminase | 1493144 | 1494274 | 3 | 1131 |
| TM.orf1350 | | pirin | 1495175 | 1494279 | −2 | 897 |

-continued

| Locus | Gene | Product | Start | End | Strand | Length |
|---|---|---|---|---|---|---|
| TM.orf1351 | ykvY | peptidase M24 | 1496516 | 1495320 | −2 | 1197 |
| TM.orf1352 | | major facilitator transporter | 1497829 | 1496525 | −3 | 1305 |
| TM.orf1353 | pchR | AraC family transcriptional regulator | 1498011 | 1499015 | 2 | 1005 |
| TM.orf1354 | | cation efflux protein | 1499913 | 1499005 | −1 | 909 |
| TM.orf1355 | BGL2 | glycoside hydrolase, family 17 | 1501794 | 1500118 | −1 | 1677 |
| TM.orf1356 | cobC | putative threonine-phosphate decarboxylase | 1502952 | 1501879 | −1 | 1074 |
| TM.orf1357 | cobQ | adenosylcobyric acid synthase | 1504421 | 1502949 | −2 | 1473 |
| TM.orf1358 | btuB | TonB-dependent receptor | 1506335 | 1504440 | −2 | 1896 |
| TM.orf1359 | | PRC-barrel domain-containing protein | 1507420 | 1506827 | −3 | 594 |
| TM.orf1360 | | conserved hypothetical protein | 1507743 | 1508477 | 2 | 735 |
| TM.orf1361 | hrpB | HrpA-like helicase | 1508518 | 1511061 | 1 | 2544 |
| TM.orf1362 | | rhodanese-related sulfurtransferase | 1511485 | 1511084 | −3 | 402 |
| TM.orf1363 | gcvA | LysR family transcriptional regulator | 1511592 | 1512470 | 2 | 879 |
| TM.orf1364 | | glutamyl-tRNA(Gln) amidotransferase subunit A | 1512585 | 1513982 | 2 | 1398 |
| TM.orf1365 | | insulin-cleaving metalloproteinase outer membrane protein | 1514113 | 1515390 | 1 | 1278 |
| TM.orf1366 | | conserved hypothetical protein | 1515482 | 1517041 | 3 | 1560 |
| TM.orf1367 | | conserved hypothetical protein | 1517041 | 1518117 | 1 | 1077 |
| TM.orf1368 | | twin-arginine translocation pathway signal | 1518133 | 1519266 | 1 | 1134 |
| TM.orf1369 | ycnE | Putative monooxygenase ycnE | 1519633 | 1519343 | −3 | 291 |
| TM.orf1370 | | Haloacid dehalogenase domain protein hydrolase | 1520433 | 1519759 | −1 | 675 |
| TM.orf1371 | mmsB | 3-hydroxyisobutyrate dehydrogenase | 1521512 | 1520613 | −2 | 900 |
| TM.orf1372 | | acyl-CoA dehydrogenase domain-containing protein | 1522771 | 1521620 | −3 | 1152 |
| TM.orf1373 | mmsA | methylmalonate-semialdehyde dehydrogenase | 1524365 | 1522869 | −2 | 1497 |
| TM.orf1374 | mauR | transcriptional regulator | 1524594 | 1525505 | 2 | 912 |
| TM.orf1375 | | NupC family protein | 1525694 | 1526542 | 3 | 849 |
| TM.orf1376 | yutK | Na+ dependent nucleoside transporter | 1526520 | 1526921 | 2 | 402 |
| TM.orf1377 | | radical SAM/B12 binding domain protein | 1527265 | 1529292 | 1 | 2028 |
| TM.orf1378 | | aminoglycoside phosphotransferase | 1529454 | 1530494 | 2 | 1041 |
| TM.orf1379 | gno | short-chain dehydrogenase/reductase SDR | 1530546 | 1531322 | 2 | 777 |
| TM.orf1380 | Mecr | nuclear receptor binding factor 1 | 1531420 | 1532424 | 1 | 1005 |
| TM.orf1381 | yhfT | fatty-acyl-CoA synthase | 1532466 | 1534115 | 2 | 1650 |
| TM.orf1382 | | TetR family transcriptional regulator | 1534242 | 1534850 | 2 | 609 |
| TM.orf1383 | mdtA | RND family efflux transporter MFP subunit | 1534942 | 1536090 | 1 | 1149 |
| TM.orf1384 | nolG | acriflavin resistance protein | 1536146 | 1539379 | 3 | 3234 |
| TM.orf1385 | znuA | periplasmic solute binding protein | 1540543 | 1539479 | −3 | 1065 |
| TM.orf1386 | zur | ferric uptake regulator, Fur family | 1540644 | 1541201 | 2 | 558 |
| TM.orf1387 | znuC | high-affinity zinc uptake system ATP-binding protein ZnuC | 1541198 | 1542064 | 3 | 867 |
| TM.orf1388 | znuB | permease of ABC zinc transporter ZnuB | 1542083 | 1542883 | 3 | 801 |
| TM.orf1389 | | conserved hypothetical protein | 1543006 | 1544046 | 1 | 1041 |
| TM.orf1390 | potI | binding-protein-dependent transport systems inner membrane component | 1544920 | 1544096 | −3 | 825 |
| TM.orf1391 | potB | binding-protein-dependent transport systems inner membrane component | 1545792 | 1544917 | −1 | 876 |
| TM.orf1392 | potA | spermidine/putrescine transport system ATP-binding protein | 1546891 | 1545794 | −3 | 1098 |
| TM.orf1393 | | twin-arginine translocation pathway signal | 1548148 | 1546973 | −3 | 1176 |
| TM.orf1394 | | UspA domain-containing protein | 1548687 | 1549520 | 2 | 834 |
| TM.orf1395 | | major facilitator family protein | 1550818 | 1549541 | −3 | 1278 |
| TM.orf1396 | | phosphatase | 1551026 | 1551763 | 3 | 738 |
| TM.orf1397 | | hypothetical protein | 1552567 | 1551773 | −3 | 795 |
| TM.orf1398 | | lipoprotein, putative | 1553277 | 1552606 | −1 | 672 |
| TM.orf1399 | | ABC transport system substrate-binding protein | 1554268 | 1553270 | −3 | 999 |
| TM.orf1400 | | ABC transporter related protein | 1555138 | 1554287 | −3 | 852 |
| TM.orf1401 | | ABC transport system permease protein | 1556336 | 1555143 | −2 | 1194 |
| TM.orf1402 | lcfB | malonyl-CoA synthase | 1557997 | 1556462 | −3 | 1536 |
| TM.orf1403 | crt | carnitinyl-CoA dehydratase | 1558856 | 1558041 | −2 | 816 |
| TM.orf1404 | ydfH | GntR family transcriptional regulator | 1559600 | 1558914 | −2 | 687 |
| TM.orf1405 | | Tripartite ATP-independent periplasmic transporter DctQ component | 1559821 | 1560336 | 1 | 516 |
| TM.orf1406 | | TRAP dicarboxylate transporter, DctM subunit | 1560333 | 1561619 | 2 | 1287 |
| TM.orf1407 | yiiZ | TRAP dicarboxylate transporter- DctP subunit | 1561698 | 1562741 | 2 | 1044 |
| TM.orf1408 | | acyl-CoA synthase | 1562725 | 1563960 | 1 | 1236 |
| TM.orf1409 | caiD | enoyl-CoA hydratase | 1564010 | 1564804 | 3 | 795 |
| TM.orf1410 | lip2 | lipolytic enzyme | 1564915 | 1565889 | 1 | 975 |
| TM.orf1411 | | hypothetical protein | 1565897 | 1566424 | 3 | 528 |
| TM.orf1412 | gatA | Glutamyl-tRNA(Gln) amidotransferase subunit A | 1566459 | 1567871 | 2 | 1413 |
| TM.orf1413 | | conserved hypothetical protein | 1568030 | 1568968 | 3 | 939 |
| TM.orf1414 | nahD | 2-hydroxychromene-2-carboxylate isomerase | 1569070 | 1569678 | 1 | 609 |
| TM.orf1415 | dkgB | oxidoreductase | 1569801 | 1570634 | 2 | 834 |
| TM.orf1416 | | nitroreductase | 1571352 | 1570693 | −1 | 660 |
| TM.orf1417 | pleC | two-component sensor histidine kinase | 1571579 | 1573522 | 3 | 1944 |
| TM.orf1418 | ddpA | extracellular solute-binding protein | 1573651 | 1575285 | 1 | 1635 |

-continued

| Locus | Gene | Product | Start | End | Strand | Length |
|---|---|---|---|---|---|---|
| TM.orf1419 | dppB | ABC transporter membrane spanning protein (oligopeptide) | 1575282 | 1576328 | 2 | 1047 |
| TM.orf1420 | ddpC | binding-protein-dependent transport systems inner membrane component | 1576325 | 1577242 | 3 | 918 |
| TM.orf1421 | dppD | ABC transporter related protein | 1577239 | 1578087 | 1 | 849 |
| TM.orf1422 | | molybdopterin oxidoreductase | 1581154 | 1578839 | −3 | 2316 |
| TM.orf1423 | | conserved hypothetical protein | 1582223 | 1581204 | −2 | 1020 |
| TM.orf1424 | | TRAP transporter, 4TM/12TM fusion protein | 1584193 | 1582220 | −3 | 1974 |
| TM.orf1425 | | 31 kDa immunogenic protein | 1585241 | 1584273 | −2 | 969 |
| TM.orf1426 | yagI | Transcriptional regulator, IclR family | 1586146 | 1585379 | −3 | 768 |
| TM.orf1427 | | conserved hypothetical protein | 1586343 | 1587263 | 2 | 921 |
| TM.orf1428 | | acetone carboxylase, gamma subunit | 1587801 | 1587295 | −1 | 507 |
| TM.orf1429 | | acetone carboxylase alpha subunit | 1590220 | 1587902 | −3 | 2319 |
| TM.orf1430 | hyuA | Acetone carboxylase beta subunit; AcxA | 1592448 | 1590271 | −1 | 2178 |
| TM.orf1431 | stc | Fis family GAF modulated sigma54 specific transcriptional regulator | 1592804 | 1594699 | 3 | 1896 |
| TM.orf1432 | | conserved hypothetical protein | 1595182 | 1594706 | −3 | 477 |
| TM.orf1433 | | cation efflux protein precursor | 1595344 | 1596237 | 1 | 894 |
| TM.orf1434 | lcfA | AMP-dependent synthetase and ligase | 1596385 | 1598199 | 1 | 1815 |
| TM.orf1435 | grsT | thioesterase domain protein | 1599028 | 1598234 | −3 | 795 |
| TM.orf1436 | ppx | Exopolyphosphatase | 1599825 | 1600829 | 2 | 1005 |
| TM.orf1437 | rlmE | 23S rRNA methylase | 1600879 | 1601694 | 1 | 816 |
| TM.orf1438 | guaB | inosine-5'-monophosphate dehydrogenase | 1601944 | 1603401 | 1 | 1458 |
| TM.orf1439 | rsmB | tRNA and rRNA cytosine-C5-methylase | 1603530 | 1604882 | 2 | 1353 |
| TM.orf1440 | | hypothetical protein | 1604974 | 1605618 | 1 | 645 |
| TM.orf1441 | yhiD | MgtC/SapB transporter | 1605701 | 1606150 | 3 | 450 |
| TM.orf1442 | cpx | xanthine/uracil/vitamin C permease | 1606354 | 1608045 | 1 | 1692 |
| TM.orf1443 | ydjP | AB hydrolase superfamily protein ydjP | 1608128 | 1608985 | 3 | 858 |
| TM.orf1444 | yetK | transporter yetK | 1609088 | 1610164 | 3 | 1077 |
| TM.orf1445 | guaA | bifunctional GMP synthase/glutamine amidotransferase protein | 1610289 | 1611836 | 2 | 1548 |
| TM.orf1446 | | TetR family transcriptional regulator | 1612122 | 1612697 | 2 | 576 |
| TM.orf1447 | | 3-beta hydroxysteroid dehydrogenase/isomerase | 1612702 | 1613676 | 1 | 975 |
| TM.orf1448 | ydjG | putative oxidoreductase | 1614840 | 1613758 | −1 | 1083 |
| TM.orf1449 | ycaN | LysR family transcriptional regulator | 1615063 | 1615968 | 1 | 906 |
| TM.orf1450 | ndvA | Beta-(1-->2)glucan export ATP-binding/permease protein ndvA | 1619031 | 1616164 | −1 | 2868 |
| TM.orf1451 | | bacteriocin/lantibiotic ABC transporter | 1621187 | 1619037 | −2 | 2151 |
| TM.orf1452 | | membrane-fusion protein | 1622477 | 1621188 | −2 | 1290 |
| TM.orf1453 | | putative secreted protein | 1623100 | 1622522 | −3 | 579 |
| TM.orf1454 | silP | cation transport ATPase | 1625423 | 1623330 | −2 | 2094 |
| TM.orf1455 | | conserved hypothetical protein | 1626219 | 1627070 | 2 | 852 |
| TM.orf1456 | | PEBP family protein | 1627587 | 1627084 | −1 | 504 |
| TM.orf1457 | yeaM | AraC family transcriptional regulator | 1628424 | 1627657 | −1 | 768 |
| TM.orf1458 | | conserved hypothetical protein | 1628546 | 1629337 | 3 | 792 |
| TM.orf1459 | | conserved hypothetical protein | 1629444 | 1630667 | 2 | 1224 |
| TM.orf1460 | | conserved hypothetical protein | 1630670 | 1631500 | 3 | 831 |
| TM.orf1461 | | conserved hypothetical protein | 1631513 | 1632250 | 3 | 738 |
| TM.orf1462 | yuxN | TetR family regulatory protein | 1632939 | 1632262 | −1 | 678 |
| TM.orf1463 | | glycosyl transferase family protein | 1633072 | 1634304 | 1 | 1233 |
| TM.orf1464 | | putative integral membrane protein | 1635052 | 1634318 | −3 | 735 |
| TM.orf1465 | | hypothetical protein | 1635191 | 1635475 | 3 | 285 |
| TM.orf1466 | gdhA | membrane-bound PQQ-dependent dehydrogenase, glucose/quinate/shikimate family | 1635644 | 1636300 | 3 | 657 |
| TM.orf1467 | | sodium/hydrogen exchanger | 1637571 | 1636267 | −1 | 1305 |
| TM.orf1468 | | chaperone protein HtpG | 1637747 | 1638415 | 3 | 669 |
| TM.orf1469 | | molybdopterin oxidoreductase, iron-sulfur binding subunit | 1638399 | 1640249 | 2 | 1851 |
| TM.orf1470 | hmeA | molybdopterin oxidoreductase, iron-sulfur binding subunit | 1640246 | 1641451 | 3 | 1206 |
| TM.orf1471 | | Polysulphide reductase NrfD | 1641448 | 1642797 | 1 | 1350 |
| TM.orf1472 | | transmembrane prediction | 1642790 | 1643350 | 3 | 561 |
| TM.orf1473 | | conserved hypothetical protein | 1643347 | 1643880 | 1 | 534 |
| TM.orf1474 | | conserved hypothetical protein | 1643877 | 1644626 | 2 | 750 |
| TM.orf1475 | | conserved hypothetical protein | 1644598 | 1644987 | 1 | 390 |
| TM.orf1476 | | hypothetical protein | 1644984 | 1645415 | 2 | 432 |
| TM.orf1477 | | electron transport protein SCO1/SenC | 1645412 | 1646215 | 3 | 804 |
| TM.orf1478 | ctaC | cytochrome c oxidase, subunit II | 1646212 | 1647162 | 1 | 951 |
| TM.orf1479 | ctaD | cytochrome c oxidase, subunit I | 1647159 | 1648784 | 2 | 1626 |
| TM.orf1480 | ctaE | cytochrome c oxidase subunit III | 1648777 | 1649412 | 1 | 636 |
| TM.orf1481 | | caa(3)-type oxidase, subunit IV | 1649418 | 1649690 | 2 | 273 |
| TM.orf1482 | | Sulfide: quinone oxidoreductase | 1651323 | 1649695 | −1 | 1629 |
| TM.orf1483 | | transmembrane protein | 1652416 | 1651634 | −3 | 783 |
| TM.orf1484 | bigR | transcriptional regulator, ArsR family | 1652914 | 1652513 | −3 | 402 |
| TM.orf1485 | | peroxiredoxin | 1653579 | 1652911 | −1 | 669 |

-continued

| Locus | Gene | Product | Start | End | Strand | Length |
|---|---|---|---|---|---|---|
| TM.orf1486 | azlB | alanine catabolic operon transcriptional regulator protein | 1654154 | 1653687 | −2 | 468 |
| TM.orf1487 | eamB | amino acid transporter LysE | 1654270 | 1654920 | 1 | 651 |
| TM.orf1488 | | conserved hypothetical protein | 1655033 | 1656364 | 3 | 1332 |
| TM.orf1489 | yfkF | major facilitator superfamily MFS-1 | 1656361 | 1657545 | 1 | 1185 |
| TM.orf1490 | | GATS-like protein 1 | 1657939 | 1657559 | −3 | 381 |
| TM.orf1491 | | peroxidase-related enzyme | 1658554 | 1657970 | −3 | 585 |
| TM.orf1492 | yhdH | zinc-binding alcohol dehydrogenase | 1659600 | 1658608 | −1 | 993 |
| TM.orf1493 | dhaR | TetR family transcriptional regulator | 1660309 | 1659629 | −3 | 681 |
| TM.orf1494 | nahR | LysR family transcriptional regulator | 1661260 | 1660334 | −3 | 927 |
| TM.orf1495 | | conserved hypothetical protein | 1661351 | 1661824 | 3 | 474 |
| TM.orf1496 | | Alcohol dehydrogenase zinc-binding domain protein | 1661821 | 1662735 | 1 | 915 |
| TM.orf1497 | | hypothetical protein | 1662843 | 1663415 | 2 | 573 |
| TM.orf1498 | yozG | XRE family transcriptional regulator | 1663415 | 1663621 | 3 | 207 |
| TM.orf1499 | yfcG | glutathione S-transferase domain-containing protein | 1664340 | 1663633 | −1 | 708 |
| TM.orf1500 | | conserved hypothetical protein | 1665756 | 1664476 | −1 | 1281 |
| TM.orf1501 | ybfL | transposase, is4 family | 1665938 | 1667053 | 3 | 1116 |
| TM.orf1502 | | ATP-dependent metalloprotease FtsH | 1667172 | 1668986 | 2 | 1815 |
| TM.orf1503 | adhA | zinc-binding alcohol dehydrogenase family protein | 1669071 | 1670054 | 2 | 984 |
| TM.orf1504 | | dihydroxy-acid dehydratase | 1670168 | 1671841 | 3 | 1674 |
| TM.orf1505 | xthA | exodeoxyribonuclease III Xth | 1672701 | 1671868 | −1 | 834 |
| TM.orf1506 | erpA | Iron-sulfur cluster insertion protein | 1673106 | 1672717 | −1 | 390 |
| TM.orf1507 | | dGTP triphosphohydrolase | 1673308 | 1674513 | 1 | 1206 |
| TM.orf1508 | argS | arginyl-tRNA synthetase | 1674515 | 1676260 | 3 | 1746 |
| TM.orf1509 | | protein TonB, putative | 1676260 | 1677294 | 1 | 1035 |
| TM.orf1510 | nagZ | Beta-N-acetylhexosaminidase | 1677291 | 1678337 | 2 | 1047 |
| TM.orf1511 | scpA | condensin subunit ScpA | 1678359 | 1679288 | 2 | 930 |
| TM.orf1512 | scpB | transcription regulator | 1679278 | 1679955 | 1 | 678 |
| TM.orf1513 | | membrane-fusion protein | 1680119 | 1681375 | 3 | 1257 |
| TM.orf1514 | lagD | ATP-binding cassette subfamily C | 1681372 | 1683636 | 1 | 2265 |
| TM.orf1515 | hlyB | ATP-binding cassette subfamily B | 1683633 | 1686644 | 2 | 3012 |
| TM.orf1516 | | conserved hypothetical protein | 1687259 | 1686669 | −2 | 591 |
| TM.orf1517 | bepC | type I secretion outer membrane protein, TolC family | 1688680 | 1687286 | −3 | 1395 |
| TM.orf1518 | | hypothetical protein | 1688979 | 1688677 | −1 | 303 |
| TM.orf1519 | | conserved hypothetical protein | 1689357 | 1688986 | −1 | 372 |
| TM.orf1520 | arcA | Response regulators consisting of a CheY-like receiver domain and a winged-helix DNA-binding domain | 1689771 | 1690445 | 2 | 675 |
| TM.orf1521 | | hypothetical protein | 1690822 | 1691073 | 1 | 252 |
| TM.orf1522 | PMP3 | Plasma membrane proteolipid | 1691208 | 1691393 | 2 | 186 |
| TM.orf1523 | | putative proteasome-type protease | 1692190 | 1691471 | −3 | 720 |
| TM.orf1524 | | transglutaminase domain protein | 1693098 | 1692262 | −1 | 837 |
| TM.orf1525 | | conserved hypothetical protein | 1694101 | 1693154 | −3 | 948 |
| TM.orf1526 | | conserved hypothetical protein | 1695737 | 1694187 | −2 | 1551 |
| TM.orf1527 | | putative anti-sigma regulatory factor, serine/threonine protein kinase | 1696399 | 1695950 | −3 | 450 |
| TM.orf1528 | btrV | anti-anti-sigma regulatory factor | 1696803 | 1696468 | −1 | 336 |
| TM.orf1529 | yqeW | Na+/Picotransporter | 1697053 | 1698705 | 1 | 1653 |
| TM.orf1530 | yoaE | terC-like membrane protein | 1698858 | 1699607 | 2 | 750 |
| TM.orf1531 | | hemolysin | 1699604 | 1700917 | 3 | 1314 |
| TM.orf1532 | | hypothetical protein | 1701280 | 1700933 | −3 | 348 |
| TM.orf1533 | | extracellular solute-binding protein, family 1 | 1701653 | 1702708 | 3 | 1056 |
| TM.orf1534 | fbpB | Fe(3+)-transport system permease protein sfuB | 1702922 | 1704649 | 3 | 1728 |
| TM.orf1535 | | ABC transporter related protein | 1704649 | 1705710 | 1 | 1062 |
| TM.orf1536 | tatA | Sec-independent protein translocase protein tatA/E homolog | 1705796 | 1706044 | 3 | 249 |
| TM.orf1537 | tatB | Sec-independent protein translocase protein TatB | 1706101 | 1706607 | 1 | 507 |
| TM.orf1538 | tatC | sec-independent protein translocase protein | 1706614 | 1707447 | 1 | 834 |
| TM.orf1539 | serS | seryl-tRNA synthetase | 1707547 | 1708836 | 1 | 1290 |
| TM.orf1540 | surE | acid phosphatase | 1708986 | 1709741 | 2 | 756 |
| TM.orf1541 | pcm | Protein-L-isoaspartate(D-aspartate) O-methyltransferase | 1709744 | 1710409 | 3 | 666 |
| TM.orf1542 | ygeR | Membrane protein | 1710498 | 1711802 | 2 | 1305 |
| TM.orf1543 | fabF | 3-oxoacyl-(acyl-carrier-protein) synthase II protein | 1713106 | 1711841 | −3 | 1266 |
| TM.orf1544 | | transcriptional regulator, TetR family | 1713711 | 1713118 | −1 | 594 |
| TM.orf1545 | | conserved hypothetical protein | 1714692 | 1713799 | −1 | 894 |
| TM.orf1546 | yajC | preprotein translocase subunit YajC | 1714946 | 1715341 | 3 | 396 |
| TM.orf1547 | secD | Preprotein translocase subunit SecD | 1715451 | 1717019 | 2 | 1569 |
| TM.orf1548 | secF | Preprotein translocase subunit SecF | 1717039 | 1718007 | 1 | 969 |

-continued

| Locus | Gene | Product | Start | End | Strand | Length |
|---|---|---|---|---|---|---|
| TM.orf1549 | | NADH dehydrogenase [ubiquinone] 1 alpha subcomplex assembly factor | 1718056 | 1718439 | 1 | 384 |
| TM.orf1550 | sodB | superoxide dismutase | 1719123 | 1718524 | −1 | 600 |
| TM.orf1551 | | conserved hypothetical protein | 1720699 | 1719497 | −3 | 1203 |
| TM.orf1552 | crtB | fusion protein of y4aC and y4aD | 1722519 | 1720735 | −1 | 1785 |
| TM.orf1553 | | squalene | 1722679 | 1723536 | 1 | 858 |
| TM.orf1554 | | glucose-inhibited division protein A | 1724921 | 1723554 | −2 | 1368 |
| TM.orf1555 | | hypothetical protein | 1725496 | 1725029 | −3 | 468 |
| TM.orf1556 | uvrA | excinuclease ABC subunit A | 1728736 | 1725845 | −3 | 2892 |
| TM.orf1557 | | Methyl-accepting chemotaxis protein signaling domain | 1730575 | 1728926 | −3 | 1650 |
| TM.orf1558 | | conserved hypothetical protein | 1731388 | 1730708 | −3 | 681 |
| TM.orf1559 | yodQ | acetylornithine deacetylase | 1732898 | 1731552 | −2 | 1347 |
| TM.orf1560 | cmpR | LysR family transcriptional regulator | 1733016 | 1733912 | 2 | 897 |
| TM.orf1561 | cysW | sulfate ABC transporter, permease protein CysW | 1734802 | 1733906 | −3 | 897 |
| TM.orf1562 | cysU | sulfate ABC transporter, permease protein CysT | 1735666 | 1734827 | −3 | 840 |
| TM.orf1563 | cysP | sulfate ABC transporter, sulfate-binding protein | 1736684 | 1735674 | −2 | 1011 |
| TM.orf1564 | | hypothetical protein | 1736794 | 1736681 | −3 | 114 |
| TM.orf1565 | | beta-lactamase domain-containing protein | 1738310 | 1736901 | −2 | 1410 |
| TM.orf1566 | ssb | single-strand DNA binding protein | 1738492 | 1739133 | 1 | 642 |
| TM.orf1567 | | aldo/keto reductase | 1740203 | 1739235 | −2 | 969 |
| TM.orf1568 | ohrR | transcriptional regulator, MarR family | 1740407 | 1740874 | 3 | 468 |
| TM.orf1569 | ohr | organic hydroperoxide resistance protein | 1741000 | 1741413 | 1 | 414 |
| TM.orf1570 | gyrA | Type IIA topoisomerase (DNA gyrase/topo II, topoisomerase IV), A subunit | 1741674 | 1744610 | 2 | 2937 |
| TM.orf1571 | coaD | phosphopantetheine adenylyltransferase | 1744632 | 1745171 | 2 | 540 |
| TM.orf1572 | queA | Queuosine biosynthesis protein | 1745280 | 1746341 | 2 | 1062 |
| TM.orf1573 | tgt | Queuine/archaeosinetRNA-ribosyltransferase | 1746338 | 1747522 | 3 | 1185 |
| TM.orf1574 | | AMP-dependent synthetase and ligase | 1749280 | 1747559 | −3 | 1722 |
| TM.orf1575 | mcp2 | methyl-accepting chemotaxis protein | 1750175 | 1751881 | 3 | 1707 |
| TM.orf1576 | | hypothetical protein | 1752014 | 1752364 | 3 | 351 |
| TM.orf1577 | | similar to protein conserved in bacteria with a cystatin-like fold | 1752687 | 1753322 | 2 | 636 |
| TM.orf1578 | | Aldehyde Dehydrogenase | 1754996 | 1753404 | −2 | 1593 |
| TM.orf1579 | | Hydroxypyruvate isomerase | 1755861 | 1755070 | −1 | 792 |
| TM.orf1580 | | SprT protein | 1755977 | 1756609 | 3 | 633 |
| TM.orf1581 | ldc | Orn/DAP/Arg decarboxylase 2 | 1757015 | 1758154 | 3 | 1140 |
| TM.orf1582 | | haloacid dehalogenase, type II | 1758963 | 1758262 | −1 | 702 |
| TM.orf1583 | slt | soluble lytic murein transglycosylase precursor | 1761198 | 1759060 | −1 | 2139 |
| TM.orf1584 | dapA | dihydrodipicolinate synthase | 1761583 | 1762494 | 1 | 912 |
| TM.orf1585 | smpB | SsrA-binding protein | 1762550 | 1763026 | 3 | 477 |
| TM.orf1586 | yuiH | oxidoreductase | 1763031 | 1763738 | 3 | 708 |
| TM.orf1587 | | putative uracil-DNA glycosylase | 1764448 | 1763729 | −3 | 720 |
| TM.orf1588 | | conserved hypothetical protein | 1765409 | 1764588 | −2 | 822 |
| TM.orf1589 | folK | 7,8-Dihydro-6-hydroxymethylpterin-pyrophosphokinase, HPPK | 1765659 | 1766156 | 2 | 498 |
| TM.orf1590 | rpoZ | DNA-directed RNA polymerase, omega subunit | 1766263 | 1766664 | 1 | 402 |
| TM.orf1591 | rsh | Guanosine polyphosphate pyrophosphohydrolases/synthetases | 1766844 | 1769000 | 2 | 2157 |
| TM.orf1592 | pyrE | orotate phosphoribosyltransferase | 1769087 | 1769689 | 3 | 603 |
| TM.orf1593 | pdxJ | Pyridoxal phosphate biosynthesis protein | 1769762 | 1770553 | 3 | 792 |
| TM.orf1594 | acpS | 4'-phosphopantetheinyl transferase | 1770558 | 1770989 | 2 | 432 |
| TM.orf1595 | lepB | signal peptidase I | 1770986 | 1771786 | 3 | 801 |
| TM.orf1596 | rnc | RNAse III | 1771856 | 1772584 | 3 | 729 |
| TM.orf1597 | era | GTP-binding protein Era | 1772581 | 1773660 | 1 | 1080 |
| TM.orf1598 | | hypothetical protein | 1773946 | 1774569 | 1 | 624 |
| TM.orf1599 | | p040 | 1774559 | 1775173 | 3 | 615 |
| TM.orf1600 | | hypothetical protein | 1775189 | 1775713 | 3 | 525 |
| TM.orf1601 | | conserved hypothetical protein | 1776669 | 1775686 | −1 | 984 |
| TM.orf1602 | | transcriptional regulator protein | 1776764 | 1777684 | 3 | 921 |
| TM.orf1603 | recO | DNA repair protein RecO | 1777681 | 1778469 | 1 | 789 |
| TM.orf1604 | parC | Gram negative topoisomerase IV, subunit A | 1778466 | 1780784 | 2 | 2319 |
| TM.orf1605 | | TRAP dicarboxylate transporter, DctM subunit | 1782490 | 1780913 | −3 | 1578 |
| TM.orf1606 | | tripartite ATP-independent periplasmic transporter DctQ | 1782764 | 1782495 | −2 | 270 |
| TM.orf1607 | | tripartite ATP-independent periplasmic transporter DctQ | 1783036 | 1782752 | −3 | 285 |
| TM.orf1608 | | Bacterial extracellular solute-binding protein, family 7 | 1784565 | 1783456 | −1 | 1110 |
| TM.orf1609 | | TRAP-type transports system extracellular solute binding protein | 1786091 | 1784991 | −2 | 1101 |
| TM.orf1610 | | Bacterial extracellular solute-binding protein, family 7 | 1787389 | 1786277 | −3 | 1113 |

-continued

| Locus | Gene | Product | Start | End | Strand | Length |
|---|---|---|---|---|---|---|
| TM.orf1611 | ate | Arginyltransferase | 1788423 | 1787695 | −1 | 729 |
| TM.orf1612 | tdcB | threonine dehydratase | 1789781 | 1788525 | −2 | 1257 |
| TM.orf1613 | quiP | peptidase S45 penicillin amidase | 1792263 | 1789819 | −1 | 2445 |
| TM.orf1614 | Odc1 | lysine | 1792435 | 1793697 | 1 | 1263 |
| TM.orf1615 | mhpD | fumarylacetoacetate (FAA) hydrolase | 1794703 | 1793690 | −3 | 1014 |
| TM.orf1616 | hemB | Delta-aminolevulinic acid dehydratase | 1795758 | 1794754 | −1 | 1005 |
| TM.orf1617 |  | putative 3-hydroxyisobutyryl-Coenzyme A hydrolase | 1796022 | 1797101 | 2 | 1080 |
| TM.orf1618 | expG | transcriptional regulator | 1797343 | 1797798 | 1 | 456 |
| TM.orf1619 | speE | spermidine synthase | 1798767 | 1797889 | −1 | 879 |
| TM.orf1620 | speH | S-adenosylmethioninedecarboxylase proenzyme | 1799218 | 1798817 | −3 | 402 |
| TM.orf1621 |  | Haloacetate dehalogenase H-1 | 1799576 | 1800466 | 3 | 891 |
| TM.orf1622 |  | conserved hypothetical protein | 1800503 | 1801288 | 3 | 786 |
| TM.orf1623 |  | hypothetical protein | 1801610 | 1802128 | 3 | 519 |
| TM.orf1624 | rnk | nucleoside diphosphate kinase regulator | 1802160 | 1802576 | 2 | 417 |
| TM.orf1625 | recG | ATP-dependent DNA helicase | 1804676 | 1802577 | −2 | 2100 |
| TM.orf1626 | EMI5 | Succinate dehydrogenase assembly factor | 1804861 | 1805169 | 1 | 309 |
| TM.orf1627 | mfd | transcription-repair coupling factor superfamily II helicase | 1805326 | 1808889 | 1 | 3564 |
| TM.orf1628 |  | conserved hypothetical protein | 1809061 | 1809393 | 1 | 333 |
| TM.orf1629 |  | hypothetical protein | 1809447 | 1809929 | 2 | 483 |
| TM.orf1630 | pleD | response regulator/GGDEF domain protein | 1811242 | 1809914 | −3 | 1329 |
| TM.orf1631 | ytcI | AMP-dependent synthetase and ligase | 1812810 | 1811293 | −1 | 1518 |
| TM.orf1632 |  | methyl-accepting chemotaxis protein | 1815215 | 1813104 | −2 | 2112 |
| TM.orf1633 |  | tRNA/rRNA methyltransferase (SpoU) | 1815583 | 1816182 | 1 | 600 |
| TM.orf1634 | pilJ | methyl-accepting chemotaxis protein | 1818315 | 1816198 | −1 | 2118 |
| TM.orf1635 |  | Transmembrane protein | 1819276 | 1818431 | −3 | 846 |
| TM.orf1636 |  | Glycosyltransferase | 1820451 | 1819339 | −1 | 1113 |
| TM.orf1637 |  | UDP-2,3-diacylglucosamine hydrolase | 1821447 | 1820455 | −1 | 993 |
| TM.orf1638 |  | cold-shock DNA-binding domain-containing protein | 1821901 | 1821695 | −3 | 207 |
| TM.orf1639 |  | cold-shock DNA-binding domain protein | 1822480 | 1822274 | −3 | 207 |
| TM.orf1640 | kipR | regulatory protein, IclR | 1823933 | 1823052 | −2 | 882 |
| TM.orf1641 | bcpA | 2,3-dimethylmalate lyase | 1824793 | 1823930 | −3 | 864 |
| TM.orf1642 |  | putative branched chain amino acid ABC transporter substrate-binding protein | 1826112 | 1824880 | −1 | 1233 |
| TM.orf1643 | livF | ABC transporter related protein | 1826920 | 1826201 | −3 | 720 |
| TM.orf1644 | braF | High-affinity branched-chain amino acid transport ATP-binding protein braF | 1827752 | 1826913 | −2 | 840 |
| TM.orf1645 | livM | branched chain amino acid ABC transporter inner membrane protein | 1828717 | 1827749 | −3 | 969 |
| TM.orf1646 | livH | putative ABC transporter, permease protein | 1829599 | 1828733 | −3 | 867 |
| TM.orf1647 | leuD | 3-isopropylmalate dehydratase, small subunit | 1830134 | 1829604 | −2 | 531 |
| TM.orf1648 |  | 3-isopropylmalate dehydratase large subunit | 1831449 | 1830193 | −1 | 1257 |
| TM.orf1649 |  | F0F1 ATP synthase subunit beta | 1831718 | 1833145 | 3 | 1428 |
| TM.orf1650 |  | alternate F1F0 ATPase, F1 subunit epsilon | 1833142 | 1833570 | 1 | 429 |
| TM.orf1651 |  | F0F1-ATPase subunit | 1833587 | 1833877 | 3 | 291 |
| TM.orf1652 |  | hypothetical protein | 1833874 | 1834194 | 1 | 321 |
| TM.orf1653 |  | F0F1 ATP synthase subunit A | 1834191 | 1834925 | 2 | 735 |
| TM.orf1654 |  | F0F1 ATP synthase subunit C | 1834922 | 1835170 | 3 | 249 |
| TM.orf1655 |  | H + transporting two-sector ATPase B/B' subunit | 1835184 | 1835927 | 2 | 744 |
| TM.orf1656 |  | F0F1 ATP synthase subunit alpha | 1835914 | 1837476 | 1 | 1563 |
| TM.orf1657 | atpG | H + transporting two-sector ATPase gamma subunit | 1837473 | 1838354 | 2 | 882 |
| TM.orf1658 |  | hypothetical protein | 1838654 | 1838367 | −2 | 288 |
| TM.orf1659 |  | major facilitator superfamily MFS_1 | 1840067 | 1838769 | −2 | 1299 |
| TM.orf1660 |  | TfoX domain-containing protein | 1840283 | 1840675 | 3 | 393 |
| TM.orf1661 |  | conserved hypothetical protein | 1840779 | 1842725 | 2 | 1947 |
| TM.orf1662 | ppdK | Pyruvate, phosphate dikinase | 1842737 | 1844335 | 3 | 1599 |
| TM.orf1663 | yehW | binding-protein-dependent transport systems inner membrane component | 1845088 | 1844321 | −3 | 768 |
| TM.orf1664 | yehX | ABC transporter related protein | 1846020 | 1845085 | −1 | 936 |
| TM.orf1665 | yehY | binding-protein-dependent transport systems inner membrane component | 1847249 | 1846017 | −2 | 1233 |
| TM.orf1666 | osmF | Substrate-binding region of ABC-type glycine betaine transport system | 1848202 | 1847246 | −3 | 957 |
| TM.orf1667 |  | putative membrane protein | 1848844 | 1848488 | −3 | 357 |
| TM.orf1668 |  | response regulator | 1849103 | 1850494 | 3 | 1392 |
| TM.orf1669 |  | lipolytic enzyme | 1851479 | 1850499 | −2 | 981 |
| TM.orf1670 | vapI | XRE family plasmid maintenance system antidote protein | 1851988 | 1852281 | 1 | 294 |
| TM.orf1671 |  | conserved hypothetical protein | 1852615 | 1852304 | −3 | 312 |
| TM.orf1672 |  | transposase, mutator type | 1852717 | 1853367 | 1 | 651 |
| TM.orf1673 |  | transposase, mutator type | 1853497 | 1853646 | 1 | 150 |
| TM.orf1674 | mltB | Lytic murein transglycosylase | 1855361 | 1856512 | 3 | 1152 |

| Locus | Gene | Product | Start | End | Strand | Length |
|---|---|---|---|---|---|---|
| TM.orf1675 | rlpA | Lipoproteins | 1856642 | 1857619 | 3 | 978 |
| TM.orf1676 | dacA | serine-type D-Ala-D-Ala carboxypeptidase | 1857693 | 1858931 | 2 | 1239 |
| TM.orf1677 | tmk | thymidylate kinase | 1858943 | 1859620 | 3 | 678 |
| TM.orf1678 | holB | ATPase involved in DNA replication | 1859617 | 1860744 | 1 | 1128 |
| TM.orf1679 | metG | methionyl-tRNA synthetase | 1860830 | 1862380 | 3 | 1551 |
| TM.orf1680 | ycfH | TatD-related deoxyribonuclease | 1862436 | 1863242 | 2 | 807 |
| TM.orf1681 | lipB | metallo-beta-lactamase superfamily | 1863242 | 1864087 | 3 | 846 |
| TM.orf1682 | | hypothetical protein | 1864096 | 1864536 | 1 | 441 |
| TM.orf1683 | | regulatory protein TetR | 1865132 | 1864539 | −2 | 594 |
| TM.orf1684 | ydgK | drug resistance transporter, Bcr/CflA subfamily | 1866381 | 1865194 | −1 | 1188 |
| TM.orf1685 | | conserved hypothetical protein | 1866575 | 1866916 | 3 | 342 |
| TM.orf1686 | rpoE | RNA polymerase, sigma-24 subunit, ECF subfamily | 1866987 | 1867547 | 2 | 561 |
| TM.orf1687 | | conserved hypothetical protein | 1867531 | 1868301 | 1 | 771 |
| TM.orf1688 | | conserved hypothetical protein | 1868393 | 1869109 | 3 | 717 |
| TM.orf1689 | | conserved hypothetical protein | 1869258 | 1869860 | 2 | 603 |
| TM.orf1690 | | acetyltransferase | 1870904 | 1870125 | −2 | 780 |
| TM.orf1691 | dnaB | replicative DNA helicase | 1871863 | 1871147 | −3 | 717 |
| TM.orf1692 | yvbT | conserved hypothetical protein | 1872145 | 1873167 | 1 | 1023 |
| TM.orf1693 | mazG | MazG family protein | 1873366 | 1874289 | 1 | 924 |
| TM.orf1694 | ydfG | short-chain dehydrogenase/reductase SDR | 1874289 | 1874606 | 2 | 318 |
| TM.orf1695 | ydfG | short-chain dehydrogenase/reductase SDR | 1874603 | 1875043 | 3 | 441 |
| TM.orf1696 | groL | unnamed protein product | 1876885 | 1875239 | −3 | 1647 |
| TM.orf1697 | groS | chaperonin | 1877294 | 1877004 | −2 | 291 |
| TM.orf1698 | hflX | GTP-binding protein HFLX | 1878805 | 1877438 | −3 | 1368 |
| TM.orf1699 | hfq | RNA-binding protein Hfq | 1879268 | 1878990 | −2 | 279 |
| TM.orf1700 | | HAD-superfamily hydrolase, subfamily IA, variant 1 | 1880150 | 1879434 | −2 | 717 |
| TM.orf1701 | trkA | Trk system potassium uptake protein | 1881552 | 1880176 | −1 | 1377 |
| TM.orf1702 | ntrX | response regulator containing CheY-like receiver | 1882971 | 1881586 | −1 | 1386 |
| TM.orf1703 | | Nitrogen regulation protein, NtrY, Signal transduction histidine kinase | 1885423 | 1882976 | −3 | 2448 |
| TM.orf1704 | ntrC | two-component response regulator, nitrogen regulation response | 1886904 | 1885420 | −1 | 1485 |
| TM.orf1705 | | nitrogen regulation protein | 1888063 | 1886921 | −3 | 1143 |
| TM.orf1706 | dus | tRNA-dihydrouridine synthase | 1889211 | 1888213 | −1 | 999 |
| TM.orf1707 | | IspD/ispF bifunctional enzyme | 1889399 | 1890658 | 3 | 1260 |
| TM.orf1708 | pgpA | phosphatidylglycerophosphatase A and related protein | 1890655 | 1891176 | 1 | 522 |
| TM.orf1709 | ygaD | protein (competence- and mitomycin-induced) | 1891199 | 1891690 | 3 | 492 |
| TM.orf1710 | | sigma factor, sigma 70 type, group 4 (ECF) | 1892690 | 1891716 | −2 | 975 |
| TM.orf1711 | | conserved hypothetical protein | 1893151 | 1892687 | −3 | 465 |
| TM.orf1712 | | oligoketide cyclase/lipid transport protein | 1893770 | 1893270 | −2 | 501 |
| TM.orf1713 | lipA | lipoic acid synthetase | 1894835 | 1893879 | −2 | 957 |
| TM.orf1714 | lpd | dihydrolipoamide dehydrogenase | 1896793 | 1894970 | −3 | 1824 |
| TM.orf1715 | | pyruvate dehydrogenase complex dihydrolipoamide acetyltransferase | 1898249 | 1896852 | −2 | 1398 |
| TM.orf1716 | pdhB | Pyruvate dehydrogenase E1 component, beta subunit | 1899277 | 1898291 | −3 | 987 |
| TM.orf1717 | pdhA | 2-dehydro-3-deoxyphosphooctonate aldolase | 1900396 | 1899374 | −3 | 1023 |
| TM.orf1718 | yybE | transcriptional regulator, LysR family | 1901444 | 1900551 | −2 | 894 |
| TM.orf1719 | | putative enoyl-CoA hydratase echA8 | 1901579 | 1902382 | 3 | 804 |
| TM.orf1720 | | Peptidoglycan-binding domain 1 protein | 1903739 | 1902756 | −2 | 984 |
| TM.orf1721 | | septum formation initiator | 1904226 | 1903840 | −1 | 387 |
| TM.orf1722 | amiC | ABC-type branched-chain amino acid transport system, periplasmic component | 1904609 | 1905880 | 3 | 1272 |
| TM.orf1723 | Iiv | High-affinity branched-chain amino acid transport system permease protein IivH | 1906153 | 1907892 | 1 | 1740 |
| TM.orf1724 | IivM | branched chain amino acid ABC transporter permease | 1907897 | 1909099 | 3 | 1203 |
| TM.orf1725 | braF | putative ATP-binding component of ABC transporter | 1909096 | 1909899 | 1 | 804 |
| TM.orf1726 | IivF | ABC transporter, nucleotide binding/ATPase protein (urea/amide) | 1909915 | 1910610 | 1 | 696 |
| TM.orf1727 | ureD | urease accessory protein UreD | 1910629 | 1911585 | 1 | 957 |
| TM.orf1728 | ureA | urease, gamma subunit | 1911653 | 1911955 | 3 | 303 |
| TM.orf1729 | ureB | urease subunit beta | 1911966 | 1912364 | 2 | 399 |
| TM.orf1730 | ureC | Urease alpha subunit | 1912369 | 1914078 | 1 | 1710 |
| TM.orf1731 | ureE | urease accessory protein | 1914190 | 1915035 | 1 | 846 |
| TM.orf1732 | ureF | Urease accessory protein UreF | 1915043 | 1915798 | 3 | 756 |
| TM.orf1733 | ureG | urease accessory protein | 1915852 | 1916511 | 1 | 660 |
| TM.orf1734 | | conserved hypothetical protein | 1917954 | 1916518 | −1 | 1437 |
| TM.orf1735 | | glycosyl transferase WecB/TagA/CpsF | 1918745 | 1917951 | −2 | 795 |
| TM.orf1736 | | polysaccharide export protein | 1919529 | 1918765 | −1 | 765 |
| TM.orf1737 | cpsD | lipopolysaccharide biosynthesis | 1921541 | 1919529 | −2 | 2013 |
| TM.orf1738 | | conserved hypothetical protein | 1922273 | 1923637 | 3 | 1365 |

| Locus | Gene | Product | Start | End | Strand | Length |
| --- | --- | --- | --- | --- | --- | --- |
| TM.orf1739 | wcaJ | sugar transferase | 1923693 | 1925129 | 2 | 1437 |
| TM.orf1740 | | glycoside hydrolase family 18 | 1925129 | 1926148 | 3 | 1020 |
| TM.orf1741 | | FkbM family methyltransferase | 1927010 | 1926171 | −2 | 840 |
| TM.orf1742 | | hypothetical protein | 1927033 | 1927158 | 1 | 126 |
| TM.orf1743 | | conserved hypothetical protein | 1927269 | 1927676 | 2 | 408 |
| TM.orf1744 | dgdR | LysR family transcriptional regulator | 1928536 | 1927688 | −3 | 849 |
| TM.orf1745 | | Membrane protein | 1928691 | 1929641 | 2 | 951 |
| TM.orf1746 | eno | enolase | 1930955 | 1929666 | −2 | 1290 |
| TM.orf1747 | kdsA | 2-dehydro-3-deoxyphosphooctonate aldolase | 1931957 | 1931103 | −2 | 855 |
| TM.orf1748 | pyrG | CTP synthase | 1933636 | 1932002 | −3 | 1635 |
| TM.orf1749 | | hypothetical protein | 1934265 | 1933840 | −1 | 426 |
| TM.orf1750 | tpiA | triose-phosphate isomerase | 1935114 | 1934356 | −1 | 759 |
| TM.orf1751 | ppiD | peptidyl-prolyl cis-trans isomerse | 1935472 | 1937385 | 1 | 1914 |
| TM.orf1752 | trpE | Anthranilate synthase component I | 1937456 | 1938973 | 3 | 1518 |
| TM.orf1753 | guaA | putative GMP synthase [glutamine-hydrolyzing] | 1938970 | 1939551 | 1 | 582 |
| TM.orf1754 | copZ | heavy metal transport/detoxification protein | 1939783 | 1939574 | −3 | 210 |
| TM.orf1755 | yibQ | conserved hypothetical protein | 1941474 | 1939789 | −1 | 1686 |
| TM.orf1756 | hmrR | Cu(I)-responsive transcriptional regulator | 1941993 | 1941529 | −1 | 465 |
| TM.orf1757 | copA | copper-translocating P-type ATPase | 1944254 | 1941990 | −2 | 2265 |
| TM.orf1758 | trpG | anthranilate synthase component II | 1944525 | 1945148 | 2 | 624 |
| TM.orf1759 | trpD | anthranilate phosphoribosyltransferase | 1945145 | 1946185 | 3 | 1041 |
| TM.orf1760 | trpC | indole-3-glycerol phosphate synthase | 1946190 | 1947005 | 2 | 816 |
| TM.orf1761 | moaC | molybdenum cofactor biosynthesis protein MoaC | 1947011 | 1947508 | 3 | 498 |
| TM.orf1762 | moeA | molybdopterin biosynthesis protein | 1947547 | 1948782 | 1 | 1236 |
| TM.orf1763 | lexA | LexA repressor | 1949031 | 1949879 | 2 | 849 |
| TM.orf1764 | | ComEC/Rec2-related protein | 1952111 | 1949964 | −2 | 2148 |
| TM.orf1765 | | Glutamyl-tRNA synthetase, class Ic | 1952232 | 1953629 | 2 | 1398 |
| TM.orf1766 | plpC | NLPA lipoprotein | 1954013 | 1954648 | 3 | 636 |
| TM.orf1767 | | conserved hypothetical protein | 1954721 | 1956109 | 3 | 1389 |
| TM.orf1768 | lpxB | lipid-A-disaccharide synthase | 1957339 | 1956149 | −3 | 1191 |
| TM.orf1769 | | conserved hypothetical protein | 1958160 | 1957336 | −1 | 825 |
| TM.orf1770 | lpxA | UDP-N-acetylglucosamine acyltransferase | 1958996 | 1958157 | −2 | 840 |
| TM.orf1771 | fabZ | beta-hydroxyacyl-(acyl-carrier-protein) dehydratase FabZ | 1959469 | 1958993 | −3 | 477 |
| TM.orf1772 | lpxD | UDP-3-O-[3-hydroxymyristoyl] glucosamine N-acyltransferase | 1960565 | 1959534 | −2 | 1032 |
| TM.orf1773 | | outer membrane protein | 1961264 | 1960677 | −2 | 588 |
| TM.orf1774 | yaeT | outer membrane protein | 1963560 | 1961269 | −1 | 2292 |
| TM.orf1775 | | zinc metalloprotease Atu1380 | 1964840 | 1963683 | −2 | 1158 |
| TM.orf1776 | dxr | 1-deoxy-D-xylulose 5-phosphate reductoisomerase | 1965945 | 1964890 | −1 | 1056 |
| TM.orf1777 | cdsA | CDP-diglyceride synthetase | 1966871 | 1966098 | −2 | 774 |
| TM.orf1778 | uppS | undecaprenyl pyrophosphate synthetase | 1967679 | 1966966 | −1 | 714 |
| TM.orf1779 | frr | ribosome recycling factor | 1968277 | 1967717 | −3 | 561 |
| TM.orf1780 | pyrH | uridylate kinase | 1969009 | 1968281 | −3 | 729 |
| TM.orf1781 | tsf | elongation factor Ts | 1970195 | 1969272 | −2 | 924 |
| TM.orf1782 | rpsB | 30S ribosomal protein S2 | 1971239 | 1970433 | −2 | 807 |
| TM.orf1783 | | DNA polymerase III alpha subunit | 1975030 | 1971530 | −3 | 3501 |
| TM.orf1784 | | conserved hypothetical protein | 1975621 | 1975127 | −3 | 495 |
| TM.orf1785 | | conserved hypothetical protein | 1976125 | 1975841 | −3 | 285 |
| TM.orf1786 | ptxR | LysR family transcriptional regulator | 1977125 | 1976223 | −2 | 903 |
| TM.orf1787 | nylA | 6-aminohexanoate-cyclic-dimer hydrolase | 1978624 | 1977197 | −3 | 1428 |
| TM.orf1788 | nreC | transcriptional regulator, LuxR family | 1979695 | 1978703 | −3 | 993 |
| TM.orf1789 | rpsI | 30S ribosomal protein S9 | 1980333 | 1979839 | −1 | 495 |
| TM.orf1790 | rplM | Ribosomal protein L13 | 1980799 | 1980341 | −3 | 459 |
| TM.orf1791 | | Enoyl-CoA hydratase/carnitine racemase | 1981104 | 1981913 | 2 | 810 |
| TM.orf1792 | yccU | O-acetylhomoserine/O-acetylserine sulfhydrylase | 1981918 | 1982421 | 1 | 504 |
| TM.orf1793 | cysD | O-acetylhomoserine sulfhydrylase | 1982418 | 1983734 | 2 | 1317 |
| TM.orf1794 | phoE | phosphoglycerate mutase family protein | 1983773 | 1984378 | 3 | 606 |
| TM.orf1795 | azoR | FMN-dependent NADH-azoreductase | 1985030 | 1984401 | −2 | 630 |
| TM.orf1796 | | transcriptional regulator, LysR family | 1985165 | 1986124 | 3 | 960 |
| TM.orf1797 | | flavin reductase-like, FMN-binding | 1986115 | 1986681 | 1 | 567 |
| TM.orf1798 | dgdR | transcriptional regulator, LysR family protein | 1987558 | 1986707 | −3 | 852 |
| TM.orf1799 | dgdA | aminotransferase class-III | 1987691 | 1988995 | 3 | 1305 |
| TM.orf1800 | | conserved hypothetical protein | 1989035 | 1989901 | 3 | 867 |
| TM.orf1801 | | glutamine amidotransferase, class II/dipeptidase | 1989950 | 1991113 | 3 | 1164 |
| TM.orf1802 | | conserved hypothetical protein | 1991182 | 1992288 | 1 | 1107 |
| TM.orf1803 | | TRAP-T family transporter, DctQ (4 TMs) subunit | 1992301 | 1992771 | 1 | 471 |
| TM.orf1804 | | TRAP-T family protein transporter, DctM (12 TMs) subunit | 1992768 | 1994075 | 2 | 1308 |
| TM.orf1805 | | conserved hypothetical protein | 1995126 | 1994083 | −1 | 1044 |

-continued

| Locus | Gene | Product | Start | End | Strand | Length |
|---|---|---|---|---|---|---|
| TM.orf1806 | | HD superfamily metal-dependent phosphohydrolase | 1996391 | 1995123 | −2 | 1269 |
| TM.orf1807 | | divalent cation tolerance protein | 1997241 | 1996522 | −1 | 720 |
| TM.orf1808 | | transcriptional regulator, MerR family | 1999060 | 1998188 | −3 | 873 |
| TM.orf1809 | ihfA | integration host factor subunit alpha | 1999445 | 1999101 | −2 | 345 |
| TM.orf1810 | fabH | 3-oxoacyl-[acyl-carrier-protein] synthase III | 2000583 | 1999606 | −1 | 978 |
| TM.orf1811 | plsX | putative glycerol-3-phosphate acyltransferase PlsX | 2001644 | 2000580 | −2 | 1065 |
| TM.orf1812 | rpmF | Ribosomal protein L32 | 2001904 | 2001719 | −3 | 186 |
| TM.orf1813 | | conserved hypothetical protein | 2002635 | 2002018 | −1 | 618 |
| TM.orf1814 | uqcc | ubiquinol-cytochrome C chaperone | 2003360 | 2002755 | −2 | 606 |
| TM.orf1815 | | conserved hypothetical protein | 2003577 | 2004143 | 2 | 567 |
| TM.orf1816 | | hypothetical protein | 2004690 | 2004232 | −1 | 459 |
| TM.orf1817 | | conserved hypothetical protein | 2005305 | 2004736 | −1 | 570 |
| TM.orf1818 | thiL | thiamine-monophosphate kinase | 2006528 | 2005488 | −2 | 1041 |
| TM.orf1819 | nusB | transcription antitermination protein NusB | 2007118 | 2006525 | −3 | 594 |
| TM.orf1820 | | 6,7-dimethyl-8-ribityllumazine synthase | 2007584 | 2007135 | −2 | 450 |
| TM.orf1821 | | GTP cyclohydrolase II | 2008743 | 2007592 | −1 | 1152 |
| TM.orf1822 | ribE | riboflavin synthase, alpha subunit | 2009425 | 2008793 | −3 | 633 |
| TM.orf1823 | ribD | riboflavin biosynthesis protein ribD | 2010538 | 2009504 | −3 | 1035 |
| TM.orf1824 | | Transcriptional repressor nrdR | 2011124 | 2010648 | −2 | 477 |
| TM.orf1825 | glyA | serine hydroxymethyltransferase | 2012503 | 2011205 | −3 | 1299 |
| TM.orf1826 | ywlF | ribose 5-phosphate isomerase RpiB | 2013101 | 2012658 | −2 | 444 |
| TM.orf1827 | | transcriptional regulatory protein MucR | 2013596 | 2014069 | 3 | 474 |
| TM.orf1828 | | hypothetical protein | 2014465 | 2014229 | −3 | 237 |
| TM.orf1829 | | hypothetical protein | 2015327 | 2014479 | −2 | 849 |
| TM.orf1830 | | hypothetical protein | 2016262 | 2015324 | −3 | 939 |
| TM.orf1831 | | hypothetical protein | 2016565 | 2016266 | −3 | 300 |
| TM.orf1832 | | conserved hypothetical protein | 2016880 | 2016608 | −3 | 273 |
| TM.orf1833 | aspS | Aspartyl-tRNA synthetase | 2018935 | 2017109 | −3 | 1827 |
| TM.orf1834 | rnd | Ribonuclease D | 2019195 | 2020463 | 2 | 1269 |
| TM.orf1835 | | putative glyoxalase/bleomycin resistance protein/dioxygenase family protein | 2021259 | 2020492 | −1 | 768 |
| TM.orf1836 | | chromosomal replication initiator | 2021912 | 2021256 | −2 | 657 |
| TM.orf1837 | | permease | 2023120 | 2021981 | −3 | 1140 |
| TM.orf1838 | | CDP-alcohol phosphatidyltransferase | 2023757 | 2023140 | −2 | 618 |
| TM.orf1839 | | conserved hypothetical protein | 2025005 | 2023761 | −2 | 1245 |
| TM.orf1840 | purM | Phosphoribosylformylglycinamidine cyclo-ligase | 2025286 | 2026419 | 1 | 1134 |
| TM.orf1841 | GART | phosphoribosylglycinamide formyltransferase | 2026392 | 2027057 | 2 | 666 |
| TM.orf1842 | ndk | Nucleoside diphosphate kinase | 2027572 | 2027150 | −3 | 423 |
| TM.orf1843 | yheS | ABC transporter, ATP-binding protein | 2027829 | 2029742 | 2 | 1914 |
| TM.orf1844 | walK | PAS/PAC sensor hybrid histidine kinase | 2030545 | 2032674 | 1 | 2130 |
| TM.orf1845 | | DNA polymerase III subunit chi | 2033165 | 2032686 | −2 | 480 |
| TM.orf1846 | pepA | leucyl aminopeptidase | 2034667 | 2033183 | −3 | 1485 |
| TM.orf1847 | | Predicted permeases | 2034999 | 2036126 | 2 | 1128 |
| TM.orf1848 | | putative permease | 2036123 | 2037277 | 3 | 1155 |
| TM.orf1849 | lptD | Organic solvent tolerance protein OstA | 2037280 | 2039472 | 1 | 2193 |
| TM.orf1850 | surA | Parvulin-like peptidyl-prolyl isomerase | 2039504 | 2040784 | 3 | 1281 |
| TM.orf1851 | pdxA | dimethyladenosine transferase | 2040771 | 2041805 | 2 | 1035 |
| TM.orf1852 | rsmA | dimethyladenosine transferase | 2041853 | 2042728 | 3 | 876 |
| TM.orf1853 | yrbG | sodium/calcium exchanger | 2042829 | 2043818 | 2 | 990 |
| TM.orf1854 | gmk | Guanylate kinase (GMP kinase) | 2044522 | 2043848 | −3 | 675 |
| TM.orf1855 | yicC | stress-induced protein | 2045441 | 2044551 | −2 | 891 |
| TM.orf1856 | | Short-chain dehydrogenase/reductase (SDR) superfamily | 2045603 | 2046376 | 3 | 774 |
| TM.orf1857 | btuB | TonB-dependent receptor | 2046799 | 2048769 | 1 | 1971 |
| TM.orf1858 | | periplasmic binding protein | 2048773 | 2049651 | 1 | 879 |
| TM.orf1859 | yvrB | transport system permease protein | 2049648 | 2050643 | 2 | 996 |
| TM.orf1860 | fecE | iron(III) dicitrate transport ATP-binding protein FecE | 2050647 | 2051492 | 2 | 846 |
| TM.orf1861 | | conserved hypothetical protein | 2051447 | 2052490 | 3 | 1044 |
| TM.orf1862 | | periplasmic solute-binding protein | 2053517 | 2052495 | −2 | 1023 |
| TM.orf1863 | fabF | 3-oxoacyl-[acyl-carrier-protein] synthase II | 2054827 | 2053568 | −3 | 1260 |
| TM.orf1864 | acpP | transit peptide-acyl carrier protein fusion protein | 2055348 | 2055112 | −1 | 237 |
| TM.orf1865 | nodG | dehydrogenase | 2056285 | 2055548 | −3 | 738 |
| TM.orf1866 | fabD | S-malonyltransferase | 2057284 | 2056343 | −3 | 942 |
| TM.orf1867 | | hypothetical protein | 2057425 | 2057538 | 1 | 114 |
| TM.orf1868 | rpsF | 30S ribosomal protein S6 | 2057880 | 2058332 | 2 | 453 |
| TM.orf1869 | rpsR | small subunit ribosomal protein S18 | 2058365 | 2058640 | 3 | 276 |
| TM.orf1870 | | conserved hypothetical protein | 2058801 | 2059754 | 2 | 954 |
| TM.orf1871 | rplI | 50S ribosomal protein L9 | 2059777 | 2060346 | 1 | 570 |
| TM.orf1872 | cfa | cyclopropane-fatty-acyl-phospholipid synthase | 2060777 | 2062018 | 3 | 1242 |
| TM.orf1873 | dnaB | replicative DNA helicase | 2062180 | 2063763 | 1 | 1584 |
| TM.orf1874 | alr | alanine racemase | 2063760 | 2064986 | 2 | 1227 |
| TM.orf1875 | | putative ABC transporter permease protein | 2064983 | 2065756 | 3 | 774 |

-continued

| Locus | Gene | Product | Start | End | Strand | Length |
|---|---|---|---|---|---|---|
| TM.orf1876 | | putative ribonucleotide transport ATP-binding protein | 2065791 | 2066570 | 2 | 780 |
| TM.orf1877 | radA | DNA repair protein RadA | 2066607 | 2068079 | 2 | 1473 |
| TM.orf1878 | cvpA | CvpA family protein | 2068136 | 2068903 | 3 | 768 |
| TM.orf1879 | purF | amidophosphoribosyltransferase | 2068966 | 2070456 | 1 | 1491 |
| TM.orf1880 | yciK | short-chain dehydrogenase/reductase SDR | 2070503 | 2071327 | 3 | 825 |
| TM.orf1881 | | regulatory protein TetR | 2072065 | 2071397 | −3 | 669 |
| TM.orf1882 | | hypothetical protein | 2072479 | 2072607 | 1 | 129 |
| TM.orf1883 | SRY1 | amino-acid dehydratase protein | 2073857 | 2072868 | −2 | 990 |
| TM.orf1884 | engA | GTP-binding protein EngA | 2075421 | 2073862 | −1 | 1560 |
| TM.orf1885 | yfgL | PQQ enzyme repeat family protein | 2076972 | 2075596 | −1 | 1377 |
| TM.orf1886 | | conserved hypothetical protein | 2077694 | 2076969 | −2 | 726 |
| TM.orf1887 | | 2'-5' RNA ligase | 2079212 | 2079949 | 3 | 738 |
| TM.orf1888 | | alpha/beta fold family hydrolase | 2079217 | 2077826 | −3 | 1392 |
| TM.orf1889 | | conserved hypothetical protein | 2080076 | 2081422 | 3 | 1347 |
| TM.orf1890 | qor | oxidoreductase, zinc-binding dehydrogenase family | 2082477 | 2081425 | −1 | 1053 |
| TM.orf1891 | virF | transcriptional regulator, AraC family | 2083450 | 2082566 | −3 | 885 |
| TM.orf1892 | pbuA | TonB-dependent siderophore receptor | 2083700 | 2085835 | 3 | 2136 |
| TM.orf1893 | | conserved hypothetical protein | 2085867 | 2086160 | 2 | 294 |
| TM.orf1894 | alkB | alkylated DNA repair protein | 2086811 | 2086161 | −2 | 651 |
| TM.orf1895 | | conserved hypothetical protein | 2087542 | 2086829 | −3 | 714 |
| TM.orf1896 | ttuE | pyruvate kinase | 2089060 | 2087633 | −3 | 1428 |
| TM.orf1897 | | putative helicase/glycosylase | 2090031 | 2089057 | −1 | 975 |
| TM.orf1898 | | conserved hypothetical protein | 2091276 | 2090047 | −1 | 1230 |
| TM.orf1899 | | Zinc transporter | 2092271 | 2091309 | −2 | 963 |
| TM.orf1900 | sldA | glucose dehydrogenase | 2094700 | 2092283 | −3 | 2418 |
| TM.orf1901 | | quinolinate synthetase complex, A subunit | 2094913 | 2095887 | 1 | 975 |
| TM.orf1902 | nadB | L-aspartate oxidase | 2095893 | 2097410 | 2 | 1518 |
| TM.orf1903 | nadC | nicotinate-nucleotide pyrophosphorylase | 2097397 | 2098254 | 1 | 858 |
| TM.orf1904 | | multi-sensor signal transduction histidine kinase | 2098362 | 2099126 | 2 | 765 |
| TM.orf1905 | rpfG | putative PAS/PAC sensor protein | 2099123 | 2099464 | 3 | 342 |
| TM.orf1906 | | SMP-30/Gluconolaconase/LRE domain-containing protein | 2099618 | 2100664 | 3 | 1047 |
| TM.orf1907 | | conserved hypothetical protein | 2101439 | 2100675 | −2 | 765 |
| TM.orf1908 | valS | Valyl-tRNA synthetase | 2104205 | 2101536 | −2 | 2670 |
| TM.orf1909 | | conserved hypothetical protein | 2105076 | 2104375 | −1 | 702 |
| TM.orf1910 | bepC | TolC family type I secretion outer membrane protein | 2106603 | 2105257 | −1 | 1347 |
| TM.orf1911 | pcm2 | protein-L-isoaspartate(D-aspartate) O-methyltransferase | 2107357 | 2106701 | −3 | 657 |
| TM.orf1912 | | hypothetical protein | 2107815 | 2107594 | −1 | 222 |
| TM.orf1913 | alkK | medium-chain-fatty-acid--CoA ligase | 2108418 | 2110052 | 2 | 1635 |
| TM.orf1914 | SCP2 | sterol carrier family protein | 2110578 | 2110285 | −1 | 294 |
| TM.orf1915 | dhkK | multi-sensor hybrid histidine kinase | 2110886 | 2113477 | 3 | 2592 |
| TM.orf1916 | | conserved hypothetical protein | 2114158 | 2113478 | −3 | 681 |
| TM.orf1917 | pulE | general secretion pathway protein E | 2114300 | 2115988 | 3 | 1689 |
| TM.orf1918 | | hypothetical protein | 2115985 | 2117280 | 1 | 1296 |
| TM.orf1919 | | hypothetical protein | 2117277 | 2118068 | 2 | 792 |
| TM.orf1920 | | hypothetical protein | 2118220 | 2118795 | 1 | 576 |
| TM.orf1921 | | hypothetical protein | 2118990 | 2120030 | 2 | 1041 |
| TM.orf1922 | outD | type II and III secretion system protein | 2120027 | 2121799 | 3 | 1773 |
| TM.orf1923 | | conserved hypothetical protein | 2121796 | 2122551 | 1 | 756 |
| TM.orf1924 | pleC | Sensor protein | 2126181 | 2122729 | −1 | 3453 |
| TM.orf1925 | | elongation factor G | 2128635 | 2126509 | −1 | 2127 |
| TM.orf1926 | | hypothetical protein | 2129444 | 2130598 | 3 | 1155 |
| TM.orf1927 | imuB | nucleotidyltransferase/DNA polymerase involved in DNA repair | 2130673 | 2132406 | 1 | 1734 |
| TM.orf1928 | | DNA polymerase III subunit alpha | 2132460 | 2135711 | 2 | 3252 |
| TM.orf1929 | | phospholipid N-methyltransferase | 2135982 | 2136569 | 2 | 588 |
| TM.orf1930 | pdhS | Sensor protein | 2138390 | 2136588 | −2 | 1803 |
| TM.orf1931 | | SpoVR family protein | 2140127 | 2138673 | −2 | 1455 |
| TM.orf1932 | | conserved hypothetical protein | 2141480 | 2140197 | −2 | 1284 |
| TM.orf1933 | prkA | PrkA serine kinase | 2143509 | 2141578 | −1 | 1932 |
| TM.orf1934 | | hypothetical protein | 2144138 | 2143938 | −2 | 201 |
| TM.orf1935 | | hypothetical protein | 2144325 | 2144131 | −1 | 195 |
| TM.orf1936 | | GNAT family acetyltransferase | 2144648 | 2144277 | −2 | 372 |
| TM.orf1937 | | conserved hypothetical protein | 2145649 | 2144921 | −3 | 729 |
| TM.orf1938 | | periplasmic binding protein | 2146284 | 2147204 | 2 | 921 |
| TM.orf1939 | yfiZ | transport system permease protein | 2147201 | 2148211 | 3 | 1011 |
| TM.orf1940 | yclP | ABC transporter related protein | 2148205 | 2148993 | 1 | 789 |
| TM.orf1941 | recJ | single-stranded-DNA-specificexonuclease | 2150814 | 2149024 | −1 | 1791 |
| TM.orf1942 | ywjI | fructose 1,6-bisphosphatase II | 2151844 | 2150867 | −3 | 978 |
| TM.orf1943 | hom | homoserine dehydrogenase | 2153434 | 2152106 | −3 | 1329 |
| TM.orf1944 | aatC | aminotransferase | 2154657 | 2153431 | −1 | 1227 |
| TM.orf1945 | phbC | poly-beta-hydroxybutyrate polymerase | 2155556 | 2157358 | 3 | 1803 |

| Locus | Gene | Product | Start | End | Strand | Length |
|---|---|---|---|---|---|---|
| TM.orf1946 | yeiE | LysR family transcriptional regulator | 2158296 | 2157418 | −1 | 879 |
| TM.orf1947 | ydgK | drug resistance transporter, Bcr/CflA subfamily | 2159519 | 2158293 | −2 | 1227 |
| TM.orf1948 | | membrane protein | 2160635 | 2159586 | −2 | 1050 |
| TM.orf1949 | | hexapaptide repeat-containing transferase | 2161402 | 2160773 | −3 | 630 |
| TM.orf1950 | lolD | ABC transporter related protein | 2162133 | 2161450 | −1 | 684 |
| TM.orf1951 | lolC | lipoprotein-releasing system permease protein | 2163373 | 2162126 | −3 | 1248 |
| TM.orf1952 | pcm | Protein-L-isoaspartate(D-aspartate) O-methyltransferase (PCMT) family | 2163558 | 2164793 | 2 | 1236 |
| TM.orf1953 | | conserved hypothetical protein | 2165229 | 2164807 | −1 | 423 |
| TM.orf1954 | | xanthine/uracil/vitamin C permease | 2165468 | 2166760 | 3 | 1293 |
| TM.orf1955 | yeaM | AraC family transcriptional regulator | 2168105 | 2167317 | −2 | 789 |
| TM.orf1956 | qacA | MFS family transporter | 2168260 | 2169447 | 1 | 1188 |
| TM.orf1957 | CRYZ | Alcohol dehydrogenase zinc-binding domain protein | 2170488 | 2169475 | −1 | 1014 |
| TM.orf1958 | pecT | lysR-like transcriptional regulator | 2170607 | 2171488 | 3 | 882 |
| TM.orf1959 | rhtC | lysine exporter family protein | 2171560 | 2172219 | 1 | 660 |
| TM.orf1960 | | conserved hypothetical protein | 2172465 | 2172226 | −1 | 240 |
| TM.orf1961 | | methylmalonyl-CoA epimerase | 2172974 | 2172570 | −2 | 405 |
| TM.orf1962 | rnjA | beta-lactamase domain-containing protein | 2174803 | 2173139 | −3 | 1665 |
| TM.orf1963 | coaX | pantothenate kinase | 2175615 | 2174836 | −1 | 780 |
| TM.orf1964 | | biotin- | 2176456 | 2175644 | −3 | 813 |
| TM.orf1965 | nuoN | NADH dehydrogenase subunit N | 2177898 | 2176453 | −1 | 1446 |
| TM.orf1966 | nuoM | NADH dehydrogenase subunit M | 2179443 | 2177920 | −1 | 1524 |
| TM.orf1967 | | NADH dehydrogenase subunit L | 2181374 | 2179443 | −2 | 1932 |
| TM.orf1968 | nuoK | NADH dehydrogenase subunit K | 2181690 | 2181382 | −1 | 309 |
| TM.orf1969 | nuoJ | NADH-quinone oxidoreductase chain 10 | 2182304 | 2181690 | −2 | 615 |
| TM.orf1970 | nuoI | NADH dehydrogenase subunit I | 2182900 | 2182412 | −3 | 489 |
| TM.orf1971 | nuoH | NADH dehydrogenase subunit G | 2184067 | 2183054 | −3 | 1014 |
| TM.orf1972 | | NADH-quinone oxidoreductase, chain G | 2186138 | 2184060 | −2 | 2079 |
| TM.orf1973 | | NADH dehydrogenase I subunit F | 2187429 | 2186149 | −1 | 1281 |
| TM.orf1974 | | NADH dehydrogenase I chain E | 2188045 | 2187419 | −3 | 627 |
| TM.orf1975 | nuoD | NADH dehydrogenase I chain D | 2189247 | 2188060 | −1 | 1188 |
| TM.orf1976 | nuoC | NADH (or F420H2) dehydrogenase, subunit C | 2189798 | 2189244 | −2 | 555 |
| TM.orf1977 | nuoB | NADH-quinone oxidoreductase, B subunit | 2190524 | 2189967 | −2 | 558 |
| TM.orf1978 | | NADH-ubiquinone/plastoquinone oxidoreductase, chain 3 | 2190886 | 2190521 | −3 | 366 |
| TM.orf1979 | | putative flavin-binding monooxygenase | 2193069 | 2191516 | −1 | 1554 |
| TM.orf1980 | hup | histone-like DNA-binding protein | 2193901 | 2193626 | −3 | 276 |
| TM.orf1981 | lon | ATP-dependent protease La | 2196599 | 2194116 | −2 | 2484 |
| TM.orf1982 | clpX | ATP-dependent protease ATP-binding subunit | 2198022 | 2196754 | −1 | 1269 |
| TM.orf1983 | clpP | Protease subunit of ATP-dependent Clp proteases | 2199088 | 2198456 | −3 | 633 |
| TM.orf1984 | tig | FKBP-type peptidyl-prolyl cis-trans isomerase (trigger factor) | 2200572 | 2199214 | −1 | 1359 |
| TM.orf1985 | | conserved hypothetical protein | 2202443 | 2200824 | −2 | 1620 |
| TM.orf1986 | exoZ | exopolysaccharide production (acetyltransferase) protein | 2203626 | 2202583 | −1 | 1044 |
| TM.orf1987 | | malonyl-CoA decarboxylase | 2205347 | 2203839 | −2 | 1509 |
| TM.orf1988 | | conserved hypothetical protein | 2207017 | 2205452 | −3 | 1566 |
| TM.orf1989 | | hypothetical protein | 2207192 | 2207560 | 3 | 369 |
| TM.orf1990 | | endonuclease/exonuclease/phosphatase | 2207572 | 2208174 | 1 | 603 |
| TM.orf1991 | ybdL | possible cysteine-S-conjugate beta-lyase | 2209649 | 2208462 | −2 | 1188 |
| TM.orf1992 | glnB | Nitrogen regulatory protein P-II | 2210083 | 2210421 | 1 | 339 |
| TM.orf1993 | glnA | L-glutamine synthetase | 2210677 | 2212086 | 1 | 1410 |
| TM.orf1994 | | conserved hypothetical protein | 2213194 | 2212262 | −3 | 933 |
| TM.orf1995 | lysR | transcriptional regulator, LysR family | 2213332 | 2214294 | 1 | 963 |
| TM.orf1996 | parE | topoisomerase IV subunit B | 2214825 | 2216804 | 2 | 1980 |
| TM.orf1997 | | hypothetical protein | 2216898 | 2217503 | 2 | 606 |
| TM.orf1998 | | hypothetical protein | 2217551 | 2218081 | 3 | 531 |
| TM.orf1999 | | hypothetical protein | 2218105 | 2218752 | 1 | 648 |
| TM.orf2000 | | hypothetical protein | 2218981 | 2218829 | −3 | 153 |
| TM.orf2001 | | chemotaxis sensory transducer | 2219272 | 2220630 | 1 | 1359 |
| TM.orf2002 | | hypothetical protein | 2220928 | 2220659 | −3 | 270 |
| TM.orf2003 | phnM | putative metal-dependent hydrolase involved in phosphonate metabolism; PhnM protein | 2220969 | 2221925 | 2 | 957 |
| TM.orf2004 | bioH | hydrolase, alpha | 2222639 | 2221926 | −2 | 714 |
| TM.orf2005 | | isochorismatase domain-containing protein 2A | 2223264 | 2222671 | −1 | 594 |
| TM.orf2006 | rhlE | DeaD | 2223380 | 2224945 | 3 | 1566 |
| TM.orf2007 | | hydrolase or acyltransferase | 2226033 | 2225167 | −1 | 867 |
| TM.orf2008 | | putative amino acid or sugar ABC transport system, permease protein | 2227092 | 2226037 | −1 | 1056 |
| TM.orf2009 | braD | putative amino acid or sugar ABC transport system, permease protein | 2228115 | 2227108 | −1 | 1008 |
| TM.orf2010 | livF | High-affinity branched-chain amino acid transport ATP-binding protein | 2228837 | 2228112 | −2 | 726 |
| TM.orf2011 | braF | ABC transporter ATPase | 2229627 | 2228830 | −1 | 798 |

-continued

| Locus | Gene | Product | Start | End | Strand | Length |
|---|---|---|---|---|---|---|
| TM.orf2012 | | branched-chain amino acid ABC transporter, periplasmic branched-chain amino acid-binding protein | 2231062 | 2229866 | −3 | 1197 |
| TM.orf2013 | hyfR | PAS modulated sigma54 specific transcriptional regulator, Fis family | 2232828 | 2231296 | −1 | 1533 |
| TM.orf2014 | besA | putative esterase | 2233914 | 2232955 | −1 | 960 |
| TM.orf2015 | mdlC | thiamine pyrophosphate binding domain-containing protein | 2235657 | 2233963 | −1 | 1695 |
| TM.orf2016 | hmp | oxidoreductase FAD/NAD(P)-binding subunit | 2236949 | 2235744 | −2 | 1206 |
| TM.orf2017 | | conserved hypothetical protein | 2237212 | 2238534 | 1 | 1323 |
| TM.orf2018 | wcaL | glucosyltransferase | 2238557 | 2239822 | 3 | 1266 |
| TM.orf2019 | | Glycosyl transferase, group 1 | 2239822 | 2241012 | 1 | 1191 |
| TM.orf2020 | | phosphoglycerate mutase | 2241009 | 2241626 | 2 | 618 |
| TM.orf2021 | | conserved hypothetical protein | 2241641 | 2242849 | 3 | 1209 |
| TM.orf2022 | | conserved hypothetical protein | 2242856 | 2243626 | 3 | 771 |
| TM.orf2023 | | hypothetical protein | 2243807 | 2244343 | 3 | 537 |
| TM.orf2024 | gsiA | putative mureinpeptideoligopeptide ABC transporter ATP-binding protein | 2244340 | 2246259 | 1 | 1920 |
| TM.orf2025 | agpA | oligopeptide ABC transporter, periplasmic oligopeptide-binding protein | 2246256 | 2248238 | 2 | 1983 |
| TM.orf2026 | appB | oligopeptide ABC transporter, permease protein | 2248337 | 2249335 | 3 | 999 |
| TM.orf2027 | appC | putative oligopeptide ABC transporter, permease protein | 2249332 | 2250486 | 1 | 1155 |
| TM.orf2028 | | CRP/FNR family transcriptional regulator | 2251329 | 2250565 | −1 | 765 |
| TM.orf2029 | uppP | undecaprenyl pyrophosphate phosphatase | 2251593 | 2252426 | 2 | 834 |
| TM.orf2030 | paaF | enoyl-CoA hydratase/isomerase | 2252736 | 2253500 | 2 | 765 |
| TM.orf2031 | | creatininase | 2253493 | 2254263 | 1 | 771 |
| TM.orf2032 | | luciferase family protein | 2254407 | 2255546 | 2 | 1140 |
| TM.orf2033 | | enoyl-CoA hydratase/isomerase | 2255575 | 2256363 | 1 | 789 |
| TM.orf2034 | | AMP-dependent synthetase and ligase | 2256491 | 2258272 | 3 | 1782 |
| TM.orf2035 | ribB | 3,4-dihydroxy-2-butanone 4-phosphate synthase | 2258291 | 2259421 | 3 | 1131 |
| TM.orf2036 | ntaB | nitrilotriacetate monooxygenase component B protein | 2259523 | 2260062 | 1 | 540 |
| TM.orf2037 | yjjL | major facilitator family transporter | 2260395 | 2261744 | 2 | 1350 |
| TM.orf2038 | yeaM | putative transcriptional regulator | 2262725 | 2261847 | −2 | 879 |
| TM.orf2039 | | AsnC-family transcriptional regulator | 2262982 | 2263479 | 1 | 498 |
| TM.orf2040 | dusA | tRNA-dihydrouridine synthase A | 2263678 | 2264670 | 1 | 993 |
| TM.orf2041 | | putative membrane protein | 2264816 | 2265505 | 3 | 690 |
| TM.orf2042 | | hypothetical protein | 2265502 | 2265876 | 1 | 375 |
| TM.orf2043 | | conserved hypothetical protein | 2266046 | 2267356 | 3 | 1311 |
| TM.orf2044 | | extracellular ligand-binding receptor | 2268558 | 2267443 | −1 | 1116 |
| TM.orf2045 | | conserved hypothetical protein | 2269045 | 2268692 | −3 | 354 |
| TM.orf2046 | livF | branched-chain amino acid transport system ATP-binding protein | 2269784 | 2269074 | −2 | 711 |
| TM.orf2047 | livG | ABC transporter component | 2270671 | 2269784 | −3 | 888 |
| TM.orf2048 | braE | inner-membrane translocator | 2272016 | 2270691 | −2 | 1326 |
| TM.orf2049 | braD | inner-membrane translocator | 2272930 | 2272016 | −3 | 915 |
| TM.orf2050 | | hypothetical protein | 2273700 | 2273446 | −1 | 255 |
| TM.orf2051 | hemA | 5-aminolevulinate synthase | 2275060 | 2273834 | −3 | 1227 |
| TM.orf2052 | | putative transcriptional regulator protein | 2275884 | 2275354 | −1 | 531 |
| TM.orf2053 | ygaD | Putative multidrug export ATP-binding/permease protein ygaD | 2278615 | 2275931 | −3 | 2685 |
| TM.orf2054 | estA | Esterase estA | 2278937 | 2281075 | 3 | 2139 |
| TM.orf2055 | | conserved hypothetical protein | 2282164 | 2281118 | −3 | 1047 |
| TM.orf2056 | bax | conserved hypothetical protein | 2283102 | 2282185 | −1 | 918 |
| TM.orf2057 | | hypothetical protein | 2283527 | 2283207 | −2 | 321 |
| TM.orf2058 | chvG | sensor histidine kinase | 2285247 | 2283745 | −1 | 1503 |
| TM.orf2059 | chvI | transcriptional regulatory protein ChvI | 2286110 | 2285262 | −2 | 849 |
| TM.orf2060 | | conserved hypothetical protein | 2286552 | 2286094 | −1 | 459 |
| TM.orf2061 | | hypothetical protein | 2287144 | 2287668 | 1 | 525 |
| TM.orf2062 | | conserved hypothetical protein | 2289037 | 2288207 | −3 | 831 |
| TM.orf2063 | | ATP-dependent RNA helicase, DEAD | 2291518 | 2289044 | −3 | 2475 |
| TM.orf2064 | lig | putative mRNA processing factor | 2291671 | 2292774 | 1 | 1104 |
| TM.orf2065 | lig | ATP-dependent DNA ligase | 2292779 | 2294395 | 3 | 1617 |
| TM.orf2066 | | conserved hypothetical protein | 2294475 | 2296736 | 2 | 2262 |
| TM.orf2067 | | conserved hypothetical protein | 2296920 | 2297339 | 2 | 420 |
| TM.orf2068 | | Major facilitator superfamily MFS_1 | 2297336 | 2298787 | 3 | 1452 |
| TM.orf2069 | | lipoprotein | 2298808 | 2299350 | 1 | 543 |
| TM.orf2070 | corA | Mg2 transporter protein CorA family protein | 2299473 | 2300498 | 2 | 1026 |
| TM.orf2071 | | hypothetical protein | 2300625 | 2301026 | 2 | 402 |
| TM.orf2072 | cirA | addiction module killer protein | 2301074 | 2303014 | 3 | 1941 |
| TM.orf2073 | | polyferredoxin | 2303035 | 2304465 | 1 | 1431 |
| TM.orf2074 | | conserved hypothetical protein | 2305361 | 2304483 | −2 | 879 |
| TM.orf2075 | | FAD dependent oxidoreductase | 2305472 | 2306527 | 3 | 1056 |
| TM.orf2076 | | HD domain protein | 2306674 | 2307246 | 1 | 573 |

-continued

| Locus | Gene | Product | Start | End | Strand | Length |
|---|---|---|---|---|---|---|
| TM.orf2077 | | conserved hypothetical protein | 2311926 | 2307280 | −1 | 4647 |
| TM.orf2078 | ytfM | surface antigen | 2313988 | 2311976 | −3 | 2013 |
| TM.orf2079 | | lipolytic protein G-D-S-L family | 2316039 | 2315095 | −1 | 945 |
| TM.orf2080 | | opgC protein, require for succinylation of osmoregulated periplasmic glucans | 2317235 | 2316042 | −2 | 1194 |
| TM.orf2081 | | oxalate/formate antiporter | 2317714 | 2318352 | 1 | 639 |
| TM.orf2082 | ybfB | putative MFS transporter | 2318417 | 2318923 | 3 | 507 |
| TM.orf2083 | | hypothetical protein | 2318977 | 2319186 | 1 | 210 |
| TM.orf2084 | paaJ | DcaF | 2320431 | 2319220 | −1 | 1212 |
| TM.orf2085 | paaH | 3-hydroxybutyryl-CoA dehydrogenase | 2322033 | 2320468 | −1 | 1566 |
| TM.orf2086 | pcaR | transcriptional regulator | 2322284 | 2323099 | 3 | 816 |
| TM.orf2087 | | protein, possibly involved in aromatic compounds catabolism | 2323156 | 2323644 | 1 | 489 |
| TM.orf2088 | | hypothetical protein | 2323701 | 2323865 | 2 | 165 |
| TM.orf2089 | serA | putative phosphoglycerate dehydrogenase (PGDH), serA-like protein | 2324871 | 2323915 | −1 | 957 |
| TM.orf2090 | phnE | phosphonate ABC transporter, inner membrane subunit | 2325775 | 2324969 | −3 | 807 |
| TM.orf2091 | phnD | binding protein component of ABC phosphonate transporter | 2326913 | 2325879 | −2 | 1035 |
| TM.orf2092 | phnC | Phosphonates ABC transporter, ATP-binding protein | 2327834 | 2326980 | −2 | 855 |
| TM.orf2093 | | conserved hypothetical protein | 2328174 | 2328887 | 2 | 714 |
| TM.orf2094 | yhaH | Inner membrane protein yhaH | 2328978 | 2329553 | 2 | 576 |
| TM.orf2095 | | guanylate kinase | 2330170 | 2329577 | −3 | 594 |
| TM.orf2096 | phnM | phosphonate metabolism protein PhnM | 2331288 | 2330143 | −1 | 1146 |
| TM.orf2097 | phnL | Phosphonates transport ATP-binding protein phnL | 2332034 | 2331285 | −2 | 750 |
| TM.orf2098 | phnK | phosphonate C-P lyase system protein PhnK | 2332848 | 2332039 | −1 | 810 |
| TM.orf2099 | phnJ | enzyme of phosphonate metabolism | 2333783 | 2332845 | −2 | 939 |
| TM.orf2100 | phnI | phosphonate metabolism | 2334925 | 2333780 | −3 | 1146 |
| TM.orf2101 | phnH | phosphonate C-P lyase system protein PhnH | 2335559 | 2334930 | −2 | 630 |
| TM.orf2102 | phnG | PhnG protein | 2336074 | 2335565 | −3 | 510 |
| TM.orf2103 | | phosphonate operon transcriptional regulator | 2336204 | 2337016 | 3 | 813 |
| TM.orf2104 | ppi | peptidyl-prolyl cis-trans isomerase, cyclophilin type | 2337191 | 2337766 | 3 | 576 |
| TM.orf2105 | | conserved hypothetical protein | 2337886 | 2338764 | 1 | 879 |
| TM.orf2106 | | transcription regulator | 2340272 | 2340514 | 3 | 243 |
| TM.orf2107 | | plasmid stabilization system protein | 2340523 | 2340837 | 1 | 315 |
| TM.orf2108 | ppi | peptidyl-prolyl cis-trans isomerase cyclophilin type | 2341092 | 2341571 | 2 | 480 |
| TM.orf2109 | recQ | ATP-dependent DNA helicase | 2341831 | 2343489 | 1 | 1659 |
| TM.orf2110 | ylaB | putative signaling membrane protein | 2345029 | 2343524 | −3 | 1506 |
| TM.orf2111 | | conserved hypothetical protein | 2346179 | 2345247 | −2 | 933 |
| TM.orf2112 | | patatin | 2346754 | 2347893 | 1 | 1140 |
| TM.orf2113 | erfK | conserved hypothetical protein | 2347890 | 2349365 | 2 | 1476 |
| TM.orf2114 | | hypothetical protein | 2349865 | 2349590 | −3 | 276 |
| TM.orf2115 | | phenazine biosynthesis protein PhzF family | 2351013 | 2350081 | −1 | 933 |
| TM.orf2116 | ybfL | transposase, is4 family | 2352240 | 2351125 | −1 | 1116 |
| TM.orf2117 | yhfA | redox protein | 2352467 | 2352916 | 3 | 450 |
| TM.orf2118 | ydhC | drug resistance transporter, Bcr/CflA subfamily protein | 2352999 | 2354153 | 2 | 1155 |
| TM.orf2119 | | conserved hypothetical protein | 2354473 | 2356797 | 1 | 2325 |
| TM.orf2120 | | conserved hypothetical protein | 2356794 | 2357492 | 2 | 699 |
| TM.orf2121 | cbpA | curved DNA-binding protein | 2357752 | 2358750 | 1 | 999 |
| TM.orf2122 | | glutathione S-transferase | 2359462 | 2358761 | −3 | 702 |
| TM.orf2123 | | TrkA domain-containing protein | 2361260 | 2359479 | −2 | 1782 |
| TM.orf2124 | yfcG | glutathione S-transferase-like protein | 2361410 | 2362114 | 3 | 705 |
| TM.orf2125 | quiP | peptidase S45 penicillin amidase | 2362290 | 2364647 | 2 | 2358 |
| TM.orf2126 | siaT | TRAP transporter, DctM-like membrane protein | 2365995 | 2364673 | −1 | 1323 |
| TM.orf2127 | | conserved hypothetical protein | 2366552 | 2365992 | −2 | 561 |
| TM.orf2128 | dctP | C4-dicarboxylate-binding periplasmic protein | 2367655 | 2366552 | −3 | 1104 |
| TM.orf2129 | ygaE | transcriptional regulator | 2368507 | 2367776 | −3 | 732 |
| TM.orf2130 | | cyclase family protein | 2368754 | 2369530 | 3 | 777 |
| TM.orf2131 | | possible isomerase/decarboxylase | 2369581 | 2370600 | 1 | 1020 |
| TM.orf2132 | braF | ABC transporter related protein | 2370912 | 2371667 | 2 | 756 |
| TM.orf2133 | livF | ABC-type branched-chain amino acid transport systems, ATPase component | 2371681 | 2372397 | 1 | 717 |
| TM.orf2134 | | Extracellular ligand-binding receptor | 2372698 | 2373918 | 1 | 1221 |
| TM.orf2135 | | branched chain amino acid ABC transporter permease | 2373979 | 2374866 | 1 | 888 |
| TM.orf2136 | livM | ABC-type branched-chain amino acid transport system, permease component | 2374871 | 2375854 | 3 | 984 |
| TM.orf2137 | mcp4 | Methyl-accepting chemotaxis protein | 2376055 | 2377737 | 1 | 1683 |
| TM.orf2138 | | putative ABC branched-chain amino transporter, periplasmic binding protein | 2378066 | 2379283 | 3 | 1218 |

-continued

| Locus | Gene | Product | Start | End | Strand | Length |
|---|---|---|---|---|---|---|
| TM.orf2139 | | linocin_M18 bacteriocin protein | 2380217 | 2379390 | −2 | 828 |
| TM.orf2140 | | conserved hypothetical protein | 2380648 | 2380265 | −3 | 384 |
| TM.orf2141 | | Zinc transporter | 2381604 | 2380786 | −1 | 819 |
| TM.orf2142 | | Permeases of the major facilitator superfamily | 2382992 | 2381766 | −2 | 1227 |
| TM.orf2143 | ydcO | benzoate transporter subfamily | 2384329 | 2383154 | −3 | 1176 |
| TM.orf2144 | mobB | molybdopterin-guanine dinucleotide biosynthesis MobB region | 2385012 | 2384446 | −1 | 567 |
| TM.orf2145 | nrtC | nitrate transporter | 2385344 | 2386798 | 3 | 1455 |
| TM.orf2146 | nrtB | nitrate ABC transporter, inner membrane subunit | 2386816 | 2387637 | 1 | 822 |
| TM.orf2147 | nasD | nitrate ABC transporter, ATPase subunits C and D | 2387665 | 2388492 | 1 | 828 |
| TM.orf2148 | nasD | F283498_4 assimilatory nitrite reductase large subunit | 2388507 | 2390984 | 2 | 2478 |
| TM.orf2149 | nasE | Nitrite reductase (NAD(P)H) large subunit, NirD | 2390999 | 2391406 | 3 | 408 |
| TM.orf2150 | nasA | Anaerobic dehydrogenases, typically selenocysteine-containing | 2391403 | 2393925 | 1 | 2523 |
| TM.orf2151 | | hypothetical protein | 2393951 | 2394112 | 3 | 162 |
| TM.orf2152 | cysG | siroheme synthase protein | 2394162 | 2395475 | 2 | 1314 |
| TM.orf2153 | trpD | Glycosyl transferase, family 3 | 2395490 | 2396497 | 3 | 1008 |
| TM.orf2154 | evgS | two-component sensor histidine kinase | 2396494 | 2398014 | 1 | 1521 |
| TM.orf2155 | coxL | carbon monoxide dehydrogenase large chain | 2398195 | 2400567 | 1 | 2373 |
| TM.orf2156 | gltS | sodium/glutamate symporter | 2401753 | 2400554 | −3 | 1200 |
| TM.orf2157 | yhhJ | ABC-2 type transporter | 2402862 | 2401750 | −1 | 1113 |
| TM.orf2158 | yhiH | ABC transporter permease ATP-binding protein | 2405599 | 2402870 | −3 | 2730 |
| TM.orf2159 | yhiI | HlyD family secretion protein | 2406633 | 2405602 | −1 | 1032 |
| TM.orf2160 | envR | TetR family transcriptional regulator | 2406898 | 2407506 | 1 | 609 |
| TM.orf2161 | | conserved hypothetical protein | 2407616 | 2407921 | 3 | 306 |
| TM.orf2162 | | conserved hypothetical protein | 2408835 | 2407939 | −1 | 897 |
| TM.orf2163 | yxnA | short chain dehydrogenase | 2409110 | 2410153 | 3 | 1044 |
| TM.orf2164 | | conserved hypothetical protein | 2410172 | 2410669 | 3 | 498 |
| TM.orf2165 | | conserved hypothetical protein | 2411430 | 2410681 | −1 | 750 |
| TM.orf2166 | | molybdopterin binding domain protein | 2412483 | 2411680 | −1 | 804 |
| TM.orf2167 | | putative NAD-dependent epimerase/dehydratase | 2413505 | 2412480 | −2 | 1026 |
| TM.orf2168 | | sugar fermentation stimulation protein A | 2413667 | 2414458 | 3 | 792 |
| TM.orf2169 | map | methionine aminopeptidase, type I | 2414609 | 2415403 | 3 | 795 |
| TM.orf2170 | | DNA repair proteins | 2415435 | 2416274 | 2 | 840 |
| TM.orf2171 | intA | integrase family protein | 2416608 | 2417708 | 2 | 1101 |
| TM.orf2172 | | conserved hypothetical protein | 2418398 | 2418892 | 3 | 495 |
| TM.orf2173 | | conserved hypothetical protein | 2419006 | 2419677 | 1 | 672 |
| TM.orf2174 | | superfamily I DNA/RNA helicase | 2419788 | 2423363 | 2 | 3576 |
| TM.orf2175 | | phosphatidylserine/phosphatidylglycerophosphate/cardiolipin synthase-like protein | 2423360 | 2425150 | 3 | 1791 |
| TM.orf2176 | | conserved hypothetical protein | 2425981 | 2425283 | −3 | 699 |
| TM.orf2177 | | conserved hypothetical protein | 2426516 | 2425986 | −2 | 531 |
| TM.orf2178 | | glutaredoxin | 2427986 | 2427276 | −2 | 711 |
| TM.orf2179 | | Dps family DNA-binding stress response protein | 2428909 | 2429463 | 1 | 555 |
| TM.orf2180 | rhaS | transcriptional regulator, AraC family | 2430213 | 2429470 | −1 | 744 |
| TM.orf2181 | yxaF | transcriptional regulator, TetR family | 2430962 | 2430372 | −2 | 591 |
| TM.orf2182 | ydeP | HxlR family transcriptional regulator | 2431847 | 2431473 | −2 | 375 |
| TM.orf2183 | ywbO | DSBA oxidoreductase | 2431963 | 2432751 | 1 | 789 |
| TM.orf2184 | | conserved hypothetical protein | 2432738 | 2433883 | 3 | 1146 |
| TM.orf2185 | | FAD-dependent pyridine nucleotide-disulphide oxidoreductase | 2433896 | 2435191 | 3 | 1296 |
| TM.orf2186 | | conserved hypothetical protein | 2436402 | 2436115 | −1 | 288 |
| TM.orf2187 | trbI | conjugation TrbI family protein | 2437524 | 2436406 | −1 | 1119 |
| TM.orf2188 | trbG | P-type conjugative transfer protein TrbG | 2438321 | 2437593 | −2 | 729 |
| TM.orf2189 | trbF | conjugal transfer protein | 2439253 | 2438570 | −3 | 684 |
| TM.orf2190 | trbL | P-type conjugative transfer protein TrbL | 2440554 | 2439256 | −1 | 1299 |
| TM.orf2191 | | P-type conjugative transfer protein TrbJ | 2441724 | 2440960 | −1 | 765 |
| TM.orf2192 | trbE | conjugal transfer ATPase TrbE | 2444159 | 2441721 | −2 | 2439 |
| TM.orf2193 | | type IV secretory pathway VirB3 family protein | 2444436 | 2444164 | −1 | 273 |
| TM.orf2194 | | conjugal transfer protein TrbC | 2444756 | 2444436 | −2 | 321 |
| TM.orf2195 | trbB | conjugal transfer protein trbB | 2445673 | 2444753 | −3 | 921 |
| TM.orf2196 | | conserved hypothetical protein | 2446792 | 2446364 | −3 | 429 |
| TM.orf2197 | traG | TRAG protein | 2448802 | 2446802 | −3 | 2001 |
| TM.orf2198 | | conserved hypothetical protein | 2450722 | 2448923 | −3 | 1800 |
| TM.orf2199 | yjbJ | lytic transglycosylase, catalytic | 2451818 | 2450907 | −2 | 912 |
| TM.orf2200 | traF | Peptidase S26, conserved region | 2452339 | 2451821 | −3 | 519 |
| TM.orf2201 | | conserved hypothetical protein | 2452800 | 2452336 | −1 | 465 |
| TM.orf2202 | | conserved hypothetical protein | 2453042 | 2452797 | −2 | 246 |
| TM.orf2203 | | putative partition protein | 2453677 | 2453039 | −3 | 639 |
| TM.orf2204 | | replication protein A | 2454747 | 2453674 | −1 | 1074 |

-continued

| Locus | Gene | Product | Start | End | Strand | Length |
|---|---|---|---|---|---|---|
| TM.orf2205 | | conserved hypothetical protein | 2455050 | 2454763 | −1 | 288 |
| TM.orf2206 | | conserved hypothetical protein | 2455516 | 2455157 | −3 | 360 |
| TM.orf2207 | | conserved hypothetical protein | 2456500 | 2456216 | −3 | 285 |
| TM.orf2208 | | XRE family transcriptional regulator | 2456842 | 2456994 | 1 | 153 |
| TM.orf2209 | | SAM-dependent methyltransferase | 2457058 | 2457891 | 1 | 834 |
| TM.orf2210 | | conserved hypothetical protein | 2458289 | 2457966 | −2 | 324 |
| TM.orf2211 | | DNA polymerase III alpha subunit | 2462233 | 2458967 | −3 | 3267 |
| TM.orf2212 | imuB | conserved hypothetical protein | 2463621 | 2462233 | −1 | 1389 |
| TM.orf2213 | imuA | conserved hypothetical protein | 2464411 | 2463659 | −3 | 753 |
| TM.orf2214 | | hypothetical protein | 2464755 | 2464922 | 2 | 168 |
| TM.orf2215 | | conserved hypothetical protein | 2465463 | 2464963 | −1 | 501 |
| TM.orf2216 | | conserved hypothetical protein | 2465757 | 2465584 | −1 | 174 |
| TM.orf2217 | yoaM | conserved hypothetical protein | 2466560 | 2465973 | −2 | 588 |
| TM.orf2218 | | Gene 61 protein | 2468052 | 2467114 | −1 | 939 |
| TM.orf2219 | | conserved hypothetical protein | 2469420 | 2468281 | −1 | 1140 |
| TM.orf2220 | | putative methylase/helicase | 2473774 | 2469431 | −3 | 4344 |
| TM.orf2221 | | RC187 | 2474539 | 2473940 | −3 | 600 |
| TM.orf2222 | | conserved hypothetical protein | 2474999 | 2474625 | −2 | 375 |
| TM.orf2223 | | conserved hypothetical protein | 2475501 | 2475010 | −1 | 492 |
| TM.orf2224 | | conserved hypothetical protein | 2476137 | 2475571 | −1 | 567 |
| TM.orf2225 | yubM | ParB domain protein nuclease | 2478356 | 2476200 | −2 | 2157 |
| TM.orf2226 | | conserved hypothetical protein | 2479337 | 2478537 | −2 | 801 |
| TM.orf2227 | | putative ardC antirestriction protein | 2480466 | 2479507 | −1 | 960 |
| TM.orf2228 | | conserved hypothetical protein | 2480783 | 2481640 | 3 | 858 |
| TM.orf2229 | | conserved hypothetical protein | 2483151 | 2481637 | −1 | 1515 |
| TM.orf2230 | | Domain of unknown function DUF1863 | 2483227 | 2483682 | 1 | 456 |
| TM.orf2231 | | conserved hypothetical protein | 2483721 | 2484341 | 2 | 621 |
| TM.orf2232 | | conserved hypothetical protein | 2484829 | 2484362 | −3 | 468 |
| TM.orf2233 | | conserved hypothetical protein | 2485356 | 2484841 | −1 | 516 |
| TM.orf2234 | copB | copper resistance B precursor | 2486148 | 2485456 | −1 | 693 |
| TM.orf2235 | pcoA | copper-resistance protein, CopA family | 2488406 | 2486616 | −2 | 1791 |
| TM.orf2236 | | conserved hypothetical protein | 2489421 | 2488522 | −1 | 900 |
| TM.orf2237 | | Heavy metal transport/detoxification protein | 2489652 | 2489437 | −1 | 216 |
| TM.orf2238 | | heavy metal translocating P-type ATPase | 2489815 | 2492364 | 1 | 2550 |
| TM.orf2239 | nrdH | glutaredoxin | 2492427 | 2492693 | 2 | 267 |
| TM.orf2240 | ndoR | oxidoreductase FAD-binding subunit | 2492708 | 2493742 | 3 | 1035 |
| TM.orf2241 | | transcriptional regulator, MerR family | 2493769 | 2494266 | 1 | 498 |
| TM.orf2242 | ydeG | riboflavin synthase subunit alpha | 2494328 | 2495533 | 3 | 1206 |
| TM.orf2243 | | hypothetical protein | 2495807 | 2495577 | −2 | 231 |
| TM.orf2244 | | conserved hypothetical protein | 2496107 | 2495841 | −2 | 267 |
| TM.orf2245 | | cation diffusion facilitator family transporter | 2497148 | 2496210 | −2 | 939 |
| TM.orf2246 | bepE | hydrophobe/amphiphile efflux-1 (HAE1) family protein | 2500339 | 2497169 | −3 | 3171 |
| TM.orf2247 | acrA | secretion protein HlyD | 2501574 | 2500336 | −1 | 1239 |
| TM.orf2248 | ynfL | LysR family transcriptional regulator | 2501812 | 2502717 | 1 | 906 |
| TM.orf2249 | | conserved hypothetical protein | 2503076 | 2503306 | 3 | 231 |
| TM.orf2250 | | DNA repair protein RadC | 2503412 | 2503576 | 3 | 165 |
| TM.orf2251 | cya2 | adenylate cyclase protein | 2504733 | 2503585 | −1 | 1149 |
| TM.orf2252 | purB | adenylosuccinate lyase | 2505040 | 2506338 | 1 | 1299 |
| TM.orf2253 | | hypothetical protein | 2506873 | 2506412 | −3 | 462 |
| TM.orf2254 | | Metallophosphoesterase | 2507048 | 2507887 | 3 | 840 |
| TM.orf2255 | | conserved hypothetical protein | 2508288 | 2507971 | −1 | 318 |
| TM.orf2256 | | enoyl-[acyl-carrier-protein] reductase (NADH) | 2509244 | 2508462 | −2 | 783 |
| TM.orf2257 | purC | phosphoribosylaminoimidazole-succinocarboxamide synthase | 2509598 | 2510368 | 3 | 771 |
| TM.orf2258 | yexA | phosphoribosylformylglycinamidine synthase protein | 2510365 | 2510610 | 1 | 246 |
| TM.orf2259 | purQ | phosphoribosylformylglycinamidine synthase I | 2510648 | 2511385 | 3 | 738 |
| TM.orf2260 | purL | Phosphoribosylformylglycinamidine (FGAM) synthase, synthetase domain | 2511463 | 2513316 | 1 | 1854 |
| TM.orf2261 | purL | phosphoribosylformylglycinamidine synthase II | 2513280 | 2513669 | 2 | 390 |
| TM.orf2262 | | BolA family protein | 2513749 | 2513985 | 1 | 237 |
| TM.orf2263 | | glutaredoxin-like protein | 2514053 | 2514406 | 3 | 354 |
| TM.orf2264 | | conserved hypothetical protein | 2514838 | 2514488 | −3 | 351 |
| TM.orf2265 | | PepSY-associated TM helix domain protein | 2516373 | 2514835 | −1 | 1539 |
| TM.orf2266 | | hypothetical protein | 2516633 | 2516370 | −2 | 264 |
| TM.orf2267 | fhuA | TonB-dependent siderophore receptor | 2519107 | 2516627 | −3 | 2481 |
| TM.orf2268 | fecR | two component sensor kinase | 2520175 | 2519261 | −3 | 915 |
| TM.orf2269 | | sigma factor | 2520741 | 2520217 | −1 | 525 |
| TM.orf2270 | | short chain dehydrogenase | 2521530 | 2520787 | −1 | 744 |
| TM.orf2271 | mtaD | 5-methylthioadenosine/S-adenosylhomocysteine deaminase | 2521714 | 2523126 | 1 | 1413 |
| TM.orf2272 | metC | cystathionine beta-lyase | 2524377 | 2523199 | −1 | 1179 |
| TM.orf2273 | glpE | rhodanese-like protein | 2526621 | 2524378 | −1 | 2244 |
| TM.orf2274 | pecT | transcriptional regulator, LysR family protein | 2526749 | 2527594 | 3 | 846 |
| TM.orf2275 | | conserved hypothetical protein | 2529128 | 2527611 | −2 | 1518 |
| TM.orf2276 | | hypothetical protein | 2529581 | 2529147 | −2 | 435 |

-continued

| Locus | Gene | Product | Start | End | Strand | Length |
|---|---|---|---|---|---|---|
| TM.orf2277 | | conserved hypothetical protein | 2530717 | 2529758 | −3 | 960 |
| TM.orf2278 | | conserved hypothetical protein | 2531797 | 2531267 | −3 | 531 |
| TM.orf2279 | fixN | cbb3-type cytochrome c oxidase subunit I | 2532412 | 2533872 | 1 | 1461 |
| TM.orf2280 | | FixO1 cytochrome C oxidase subunit | 2533890 | 2534651 | 2 | 762 |
| TM.orf2281 | | hypothetical protein | 2534648 | 2534815 | 3 | 168 |
| TM.orf2282 | petJ | cytochrome-c oxidase fixP chain | 2534802 | 2535671 | 2 | 870 |
| TM.orf2283 | fixG | cytochrome c oxidase accessory protein CcoG | 2535668 | 2537248 | 3 | 1581 |
| TM.orf2284 | | nitrogen fixation protein fixH | 2537335 | 2537778 | 1 | 444 |
| TM.orf2285 | | hypothetical protein | 2537883 | 2538539 | 2 | 657 |
| TM.orf2286 | | conserved hypothetical protein | 2538569 | 2539285 | 3 | 717 |
| TM.orf2287 | rpsD | 30S ribosomal protein S4 | 2540006 | 2539392 | −2 | 615 |
| TM.orf2288 | hmuV | ABC transporter related protein | 2540874 | 2540083 | −1 | 792 |
| TM.orf2289 | | transport system permease protein | 2541866 | 2540871 | −2 | 996 |
| TM.orf2290 | yvrC | Fe3+-hydroxamate ABC superfamily ATP binding cassette transporter periplasmic family protein | 2542804 | 2541863 | −3 | 942 |
| TM.orf2291 | btuB | TonB-dependent receptor | 2544963 | 2542804 | −1 | 2160 |
| TM.orf2292 | | Methyltransferase type 11 | 2545817 | 2545011 | −2 | 807 |
| TM.orf2293 | pncA | isochorismatase hydrolase | 2547811 | 2546240 | −3 | 1572 |
| TM.orf2294 | | alpha-isopropylmalate/homocitrate synthase family transferase | 2549502 | 2547865 | −1 | 1638 |
| TM.orf2295 | | hypothetical protein | 2549747 | 2549610 | −2 | 138 |
| TM.orf2296 | | conserved hypothetical protein | 2551506 | 2550802 | −1 | 705 |
| TM.orf2297 | cysS | Cysteinyl-tRNA synthetase | 2553762 | 2552371 | −1 | 1392 |
| TM.orf2298 | | glutamyl-tRNA synthetase | 2555212 | 2553857 | −3 | 1356 |
| TM.orf2299 | nadE | Glutamine-dependent NAD(+) synthetase | 2556984 | 2555293 | −1 | 1692 |
| TM.orf2300 | | nicotinate phosphoribosyltransferase | 2558129 | 2556999 | −2 | 1131 |
| TM.orf2301 | | phospho-2-dehydro-3-deoxyheptonate aldolase 1 | 2559694 | 2558300 | −3 | 1395 |
| TM.orf2302 | gor | glutathione-disulfide reductase | 2561396 | 2560047 | −2 | 1350 |
| TM.orf2303 | gabD | succinic semialdehyde dehydrogenase | 2562979 | 2561489 | −3 | 1491 |
| TM.orf2304 | | hypothetical protein | 2563165 | 2563524 | 1 | 360 |
| TM.orf2305 | | hypothetical protein | 2564350 | 2564532 | 1 | 183 |
| TM.orf2306 | FAH | fumarylacetoacetase | 2565929 | 2564673 | −2 | 1257 |
| TM.orf2307 | ybiH | transcriptional regulator | 2566637 | 2565945 | −2 | 693 |
| TM.orf2308 | mtaD | amidohydrolase | 2568043 | 2566637 | −3 | 1407 |
| TM.orf2309 | yiiZ | DctP | 2568248 | 2569267 | 3 | 1020 |
| TM.orf2310 | | tripartite ATP-independent periplasmic transporter DctQ | 2569304 | 2569834 | 3 | 531 |
| TM.orf2311 | | TRAP dicarboxylate transporter, DctM subunit | 2569834 | 2571129 | 1 | 1296 |
| TM.orf2312 | | cupin 2 domain-containing protein | 2571163 | 2571690 | 1 | 528 |
| TM.orf2313 | glmS | glucosamine-fructose-6-phosphate aminotransferase | 2573607 | 2571781 | −1 | 1827 |
| TM.orf2314 | | conserved hypothetical protein | 2575484 | 2574030 | −2 | 1455 |
| TM.orf2315 | | protein, phage-related | 2578821 | 2575528 | −1 | 3294 |
| TM.orf2316 | | conserved hypothetical protein | 2579651 | 2578818 | −2 | 834 |
| TM.orf2317 | | conserved hypothetical protein | 2580302 | 2579667 | −2 | 636 |
| TM.orf2318 | | hypothetical protein | 2580467 | 2580315 | −2 | 153 |
| TM.orf2319 | | hypothetical protein | 2581272 | 2580481 | −1 | 792 |
| TM.orf2320 | | hypothetical protein | 2581716 | 2581288 | −1 | 429 |
| TM.orf2321 | | hypothetical protein | 2582105 | 2581716 | −2 | 390 |
| TM.orf2322 | | conserved hypothetical protein | 2582563 | 2582102 | −3 | 462 |
| TM.orf2323 | | conserved hypothetical protein | 2583563 | 2582586 | −2 | 978 |
| TM.orf2324 | | hypothetical protein | 2584181 | 2583597 | −2 | 585 |
| TM.orf2325 | | conserved hypothetical protein | 2585579 | 2584194 | −2 | 1386 |
| TM.orf2326 | | putative phage terminase-like protein | 2587024 | 2585618 | −3 | 1407 |
| TM.orf2327 | dinB | conserved hypothetical protein | 2587742 | 2587221 | −2 | 522 |
| TM.orf2328 | | conserved hypothetical protein | 2587970 | 2588917 | 3 | 948 |
| TM.orf2329 | SRY1 | threonine dehydratase | 2590188 | 2588929 | −1 | 1260 |
| TM.orf2330 | cvrA | sodium/hydrogen exchanger | 2590380 | 2592305 | 2 | 1926 |
| TM.orf2331 | | conserved hypothetical protein | 2592646 | 2592320 | −3 | 327 |
| TM.orf2332 | | prevent-host-death protein | 2593009 | 2592758 | −3 | 252 |
| TM.orf2333 | | fumarylacetoacetat hydroxylase | 2593778 | 2593083 | −2 | 696 |
| TM.orf2334 | | glycolate reductase | 2594922 | 2593930 | −1 | 993 |
| TM.orf2335 | cysG | siroheme synthase | 2595157 | 2595816 | 1 | 660 |
| TM.orf2336 | cysH | phosphoadenosine phosphosulfate reductase | 2595894 | 2596604 | 2 | 711 |
| TM.orf2337 | cysQ | 3'(2'),5'-bisphosphate nucleotidase | 2596698 | 2597522 | 2 | 825 |
| TM.orf2338 | | hypothetical protein | 2597519 | 2598121 | 3 | 603 |
| TM.orf2339 | soj | cobyrinic acid a,c-diamide synthase | 2598752 | 2598126 | −2 | 627 |
| TM.orf2340 | | hypothetical protein | 2598950 | 2599210 | 3 | 261 |
| TM.orf2341 | ywlC | putative translation factor | 2599222 | 2600265 | 1 | 1044 |
| TM.orf2342 | pleC | Signal transduction histidine kinase | 2600307 | 2601653 | 2 | 1347 |
| TM.orf2343 | | conserved hypothetical protein | 2602071 | 2601631 | −1 | 441 |
| TM.orf2344 | | FAD/FMN-containing dehydrogenases | 2602148 | 2603581 | 3 | 1434 |
| TM.orf2345 | | formiminoglutamase | 2604410 | 2603598 | −2 | 813 |
| TM.orf2346 | hutH | histidine ammonia-lyase | 2605963 | 2604407 | −3 | 1557 |
| TM.orf2347 | mtaD | N-formimino-L-glutamate deiminase | 2607327 | 2605960 | −1 | 1368 |

-continued

| Locus | Gene | Product | Start | End | Strand | Length |
|---|---|---|---|---|---|---|
| TM.orf2348 | hutI | imidazolonepropionase | 2607424 | 2608689 | 1 | 1266 |
| TM.orf2349 | hutC | transcriptional regulator | 2608686 | 2609420 | 2 | 735 |
| TM.orf2350 | | type IV pilus assembly PilZ | 2610874 | 2609423 | −3 | 1452 |
| TM.orf2351 | cysM | cysteine synthase | 2611161 | 2612144 | 2 | 984 |
| TM.orf2352 | ocd | putative ornithine cyclodeaminase | 2612141 | 2613178 | 3 | 1038 |
| TM.orf2353 | | type IV pilus assembly PilZ | 2614643 | 2613186 | −2 | 1458 |
| TM.orf2354 | yrhP | Lysine exporter protein (LYSE/YGGA) | 2614803 | 2615441 | 2 | 639 |
| TM.orf2355 | | acetoacetyl-CoA synthetase | 2615485 | 2616360 | 1 | 876 |
| TM.orf2356 | mcpA | methyl-accepting chemotaxis protein | 2618629 | 2616383 | −3 | 2247 |
| TM.orf2357 | cpxA | Sensor protein cpxA | 2620146 | 2618797 | −1 | 1350 |
| TM.orf2358 | mtrA | Two-component system response regulator | 2620832 | 2620143 | −2 | 690 |
| TM.orf2359 | macA | macrolide efflux protein MacA | 2621091 | 2622275 | 2 | 1185 |
| TM.orf2360 | macB | ABC transporter related protein | 2622280 | 2624235 | 1 | 1956 |
| TM.orf2361 | | multidrug efflux outer membrane lipoprotein | 2624232 | 2625647 | 2 | 1416 |
| TM.orf2362 | prtA | hemolysin-type calcium-binding region | 2625880 | 2627820 | 1 | 1941 |
| TM.orf2363 | | glyoxalase/bleomycin resistance protein/dioxygenase | 2628245 | 2627829 | −2 | 417 |
| TM.orf2364 | acnR | transcriptional regulator, TetR family | 2628388 | 2628990 | 1 | 603 |
| TM.orf2365 | | conserved hypothetical protein | 2629744 | 2628974 | −3 | 771 |
| TM.orf2366 | fadA | acetyl-CoA acetyltransferase | 2629890 | 2630273 | 2 | 384 |
| TM.orf2367 | | conserved hypothetical protein | 2630783 | 2630322 | −2 | 462 |
| TM.orf2368 | | conserved hypothetical protein | 2631894 | 2630842 | −1 | 1053 |
| TM.orf2369 | | conserved hypothetical protein | 2632694 | 2631894 | −2 | 801 |
| TM.orf2370 | | conserved hypothetical protein | 2636857 | 2632691 | −3 | 4167 |
| TM.orf2371 | | phage tape measure protein | 2643896 | 2637249 | −2 | 6648 |
| TM.orf2372 | | conserved hypothetical protein | 2644634 | 2644269 | −2 | 366 |
| TM.orf2373 | | conserved hypothetical protein | 2645607 | 2644651 | −1 | 957 |
| TM.orf2374 | | hypothetical protein | 2646244 | 2645810 | −3 | 435 |
| TM.orf2375 | | conserved hypothetical protein | 2646657 | 2646241 | −1 | 417 |
| TM.orf2376 | | hypothetical protein | 2646902 | 2646669 | −2 | 234 |
| TM.orf2377 | | phage capsid protein | 2647846 | 2646902 | −3 | 945 |
| TM.orf2378 | | hypothetical protein | 2648255 | 2647863 | −2 | 393 |
| TM.orf2379 | | conserved hypothetical protein | 2649469 | 2648255 | −3 | 1215 |
| TM.orf2380 | | phage virion morphogenesis protein | 2650168 | 2649653 | −3 | 516 |
| TM.orf2381 | | putative head morphogenesis protein SPP1 gp7 | 2651240 | 2650296 | −2 | 945 |
| TM.orf2382 | | F, portal protein | 2652801 | 2651527 | −1 | 1275 |
| TM.orf2383 | | putative phage-related protein | 2654573 | 2653014 | −2 | 1560 |
| TM.orf2384 | | terminase small subunit | 2655147 | 2654620 | −1 | 528 |
| TM.orf2385 | | hypothetical protein | 2655493 | 2655170 | −3 | 324 |
| TM.orf2386 | | conserved hypothetical protein | 2655909 | 2655490 | −1 | 420 |
| TM.orf2387 | | hypothetical protein | 2656112 | 2655894 | −2 | 219 |
| TM.orf2388 | | hypothetical protein | 2656566 | 2656105 | −1 | 462 |
| TM.orf2389 | | conserved hypothetical protein | 2657171 | 2656569 | −2 | 603 |
| TM.orf2390 | | conserved hypothetical protein | 2657702 | 2657205 | −2 | 498 |
| TM.orf2391 | | hypothetical protein | 2657922 | 2657707 | −1 | 216 |
| TM.orf2392 | | Mu-like prophage protein GP16 | 2658512 | 2657919 | −2 | 594 |
| TM.orf2393 | | hypothetical protein | 2658720 | 2658505 | −1 | 216 |
| TM.orf2394 | | hypothetical protein | 2658943 | 2658713 | −3 | 231 |
| TM.orf2395 | | hypothetical protein | 2659374 | 2658940 | −1 | 435 |
| TM.orf2396 | | conserved hypothetical protein | 2659622 | 2659371 | −2 | 252 |
| TM.orf2397 | | hypothetical protein | 2659759 | 2659619 | −3 | 141 |
| TM.orf2398 | | hypothetical protein | 2660297 | 2660073 | −2 | 225 |
| TM.orf2399 | | hypothetical protein | 2660522 | 2660313 | −2 | 210 |
| TM.orf2400 | | putative transcriptional regulator | 2660929 | 2660519 | −3 | 411 |
| TM.orf2401 | | phage-related conserved putative protein | 2661563 | 2660922 | −2 | 642 |
| TM.orf2402 | | phage transposition protein B | 2662065 | 2661565 | −1 | 501 |
| TM.orf2403 | | hypothetical protein | 2662663 | 2662379 | −3 | 285 |
| TM.orf2404 | | Transposase-like Mu | 2664791 | 2662674 | −2 | 2118 |
| TM.orf2405 | | putative cytosolic protein | 2665269 | 2664838 | −1 | 432 |
| TM.orf2406 | | hypothetical protein | 2665798 | 2665917 | 1 | 120 |
| TM.orf2407 | | XRE family DNA-binding protein | 2666075 | 2666419 | 3 | 345 |
| TM.orf2408 | fadA | acetyl-CoA acetyltransferase | 2666886 | 2667605 | 2 | 720 |
| TM.orf2409 | | ribonucleotide-diphosphate reductase subunit beta | 2668675 | 2667572 | −3 | 1104 |
| TM.orf2410 | | ribonucleotide-diphosphate reductase subunit alpha | 2670135 | 2668681 | −1 | 1455 |
| TM.orf2411 | | NrdA protein | 2670595 | 2670113 | −3 | 483 |
| TM.orf2412 | | XRE family transcriptional regulator | 2672385 | 2670961 | −1 | 1425 |
| TM.orf2413 | | 2-methylcitrate dehydratase | 2672553 | 2674067 | 2 | 1515 |
| TM.orf2414 | prpC | 2-methylcitrate synthase/citrate synthase II | 2674090 | 2675289 | 1 | 1200 |
| TM.orf2415 | prpB | methylisocitrate lyase | 2675307 | 2676224 | 2 | 918 |
| TM.orf2416 | metE | 5-methyltetrahydropteroyltriglutamate--homocysteine S-methyltransferase | 2676226 | 2678535 | 1 | 2310 |
| TM.orf2417 | oatA | acyltransferase 3 | 2678614 | 2679765 | 1 | 1152 |
| TM.orf2418 | asnO | asparagine synthase | 2681725 | 2679773 | −3 | 1953 |
| TM.orf2419 | | conserved hypothetical protein | 2681971 | 2681738 | −3 | 234 |

-continued

| Locus | Gene | Product | Start | End | Strand | Length |
|---|---|---|---|---|---|---|
| TM.orf2420 | | hypothetical protein | 2682220 | 2682065 | −3 | 156 |
| TM.orf2421 | menE | long-chain-fatty-acid-CoA ligase | 2684066 | 2682306 | −2 | 1761 |
| TM.orf2422 | | enoyl-CoA hydratase | 2685023 | 2684121 | −2 | 903 |
| TM.orf2423 | | TetR family transcriptional regulator | 2685200 | 2685826 | 3 | 627 |
| TM.orf2424 | osmC | OsmC-like protein | 2686269 | 2685838 | −1 | 432 |
| TM.orf2425 | | conserved hypothetical protein | 2686422 | 2686754 | 2 | 333 |
| TM.orf2426 | | membrane protein | 2686744 | 2687520 | 1 | 777 |
| TM.orf2427 | ydfF | transcriptional regulator, ArsR family protein | 2687572 | 2688282 | 1 | 711 |
| TM.orf2428 | | putative lantibiotic modifying enzyme | 2688293 | 2691013 | 3 | 2721 |
| TM.orf2429 | | conserved hypothetical protein | 2691119 | 2691400 | 3 | 282 |
| TM.orf2430 | yjcE | Na+/H+ antiporter | 2693071 | 2691434 | −3 | 1638 |
| TM.orf2431 | pobA | 4-hydroxybenzoate 3-monooxygenase | 2694396 | 2693212 | −1 | 1185 |
| TM.orf2432 | | putative 3-carboxy-cis,cis-muconate cycloisomerase (3-carboxymuconate lactonizing enzyme) | 2695588 | 2694389 | −3 | 1200 |
| TM.orf2433 | pcaG | Protocatechuate 3,4-dioxygenase, alpha subunit(PcaG) | 2696165 | 2695581 | −2 | 585 |
| TM.orf2434 | pcaH | protocatechuate 3,4-dioxygenase, beta subunit | 2696874 | 2696170 | −1 | 705 |
| TM.orf2435 | pcaC | 4-carboxymuconolactone decarboxylase | 2697284 | 2696871 | −2 | 414 |
| TM.orf2436 | pcaQ | LysR family transcriptional regulator | 2697367 | 2698353 | 1 | 987 |
| TM.orf2437 | siaT | TRAP transporter, DctM subunit subfamily | 2699656 | 2698319 | −3 | 1338 |
| TM.orf2438 | | conserved hypothetical protein | 2700131 | 2699661 | −2 | 471 |
| TM.orf2439 | siaP | Bacterial extracellular solute-binding protein, family 7 | 2701242 | 2700211 | −1 | 1032 |
| TM.orf2440 | | conserved hypothetical protein | 2701520 | 2702683 | 3 | 1164 |
| TM.orf2441 | | conserved hypothetical protein | 2702696 | 2703175 | 3 | 480 |
| TM.orf2442 | | conserved hypothetical protein | 2709283 | 2709717 | 1 | 435 |
| TM.orf2443 | | putative acetyltransferase protein | 2710251 | 2709745 | −1 | 507 |
| TM.orf2444 | ygeX | diaminopropionate ammonia-lyase | 2711459 | 2710248 | −2 | 1212 |
| TM.orf2445 | | transcriptional regulator, AsnC family | 2711571 | 2712083 | 2 | 513 |
| TM.orf2446 | | conserved hypothetical protein | 2713314 | 2712058 | −1 | 1257 |
| TM.orf2447 | | YciI family protein | 2713649 | 2713362 | −2 | 288 |
| TM.orf2448 | thyX | thymidylate synthase (FAD) | 2714649 | 2713711 | −1 | 939 |
| TM.orf2449 | | conserved hypothetical protein | 2715206 | 2715721 | 3 | 516 |
| TM.orf2450 | ywhH | YbaK/prolyl-tRNA synthetase associated region | 2715728 | 2716246 | 3 | 519 |
| TM.orf2451 | | conserved hypothetical protein | 2716311 | 2716613 | 2 | 303 |
| TM.orf2452 | | ETC complex I subunit region | 2716907 | 2717200 | 3 | 294 |
| TM.orf2453 | | conserved hypothetical protein | 2717483 | 2718088 | 3 | 606 |
| TM.orf2454 | visC | conserved hypothetical protein | 2719289 | 2718096 | −2 | 1194 |
| TM.orf2455 | | putative transmembrane protein | 2720401 | 2719370 | −3 | 1032 |
| TM.orf2456 | pecT | LysR family transcriptional regulator | 2720510 | 2721382 | 3 | 873 |
| TM.orf2457 | | conserved hypothetical protein | 2721745 | 2721386 | −3 | 360 |
| TM.orf2458 | | conserved hypothetical protein | 2722102 | 2721809 | −3 | 294 |
| TM.orf2459 | nahR | transcriptional regulator, LysR family | 2723159 | 2722215 | −2 | 945 |
| TM.orf2460 | yebQ | major facilitator superfamily MFS_1 | 2723305 | 2724750 | 1 | 1446 |
| TM.orf2461 | | conserved hypothetical protein | 2725624 | 2724725 | −3 | 900 |
| TM.orf2462 | ycaN | transcriptional regulator, LysR family | 2726568 | 2725621 | −1 | 948 |
| TM.orf2463 | yajO | aldo/keto reductase | 2726686 | 2727714 | 1 | 1029 |
| TM.orf2464 | | conserved hypothetical protein | 2728262 | 2727711 | −2 | 552 |
| TM.orf2465 | | gluconolactonase precursor | 2728368 | 2729294 | 2 | 927 |
| TM.orf2466 | | conserved hypothetical protein | 2729352 | 2729954 | 2 | 603 |
| TM.orf2467 | yhcX | hydrolase, carbon-nitrogen family protein | 2729951 | 2730880 | 3 | 930 |
| TM.orf2468 | | hypothetical protein | 2731163 | 2730882 | −2 | 282 |
| TM.orf2469 | | hypothetical protein | 2731683 | 2731336 | −1 | 348 |
| TM.orf2470 | | conserved hypothetical protein | 2732253 | 2731702 | −1 | 552 |
| TM.orf2471 | | putative ABC transporter | 2732676 | 2733464 | 2 | 789 |
| TM.orf2472 | | ABC transporter permease protein | 2733461 | 2734240 | 3 | 780 |
| TM.orf2473 | | putative sulfonate/nitrate transport system substrate-binding protein | 2734283 | 2735254 | 3 | 972 |
| TM.orf2474 | | cation antiporter | 2735608 | 2736081 | 1 | 474 |
| TM.orf2475 | | multiple resistance and pH regulation protein F | 2736081 | 2736404 | 2 | 324 |
| TM.orf2476 | | monovalent cation/proton antiporter, MnhG/PhaG subunit | 2736451 | 2736756 | 1 | 306 |
| TM.orf2477 | | Na+/H+ antiporter MnhB subunit-related protein | 2736753 | 2737361 | 2 | 609 |
| TM.orf2478 | | putative monovalent cation/H+ antiporter subunit B | 2737351 | 2737776 | 1 | 426 |
| TM.orf2479 | phaC | NADH-ubiquinone oxidoreductase chain 4L | 2737778 | 2738347 | 3 | 570 |
| TM.orf2480 | nuoN | NADH dehydrogenase (quinone) | 2738344 | 2739831 | 1 | 1488 |
| TM.orf2481 | nuoN | NADH dehydrogenase (quinone) | 2739836 | 2741353 | 3 | 1518 |
| TM.orf2482 | | hypothetical protein | 2741350 | 2741589 | 1 | 240 |
| TM.orf2483 | nuoN | putative monovalent cation/H+ antiporter subunit D | 2741582 | 2743303 | 3 | 1722 |
| TM.orf2484 | yjaB | acetyltransferase | 2743501 | 2744055 | 1 | 555 |
| TM.orf2485 | | conserved hypothetical protein | 2744124 | 2745497 | 2 | 1374 |

-continued

| Locus | Gene | Product | Start | End | Strand | Length |
|---|---|---|---|---|---|---|
| TM.orf2486 | | transmembrane protein | 2745879 | 2745511 | −1 | 369 |
| TM.orf2487 | | iron-regulated protein | 2746035 | 2746958 | 2 | 924 |
| TM.orf2488 | ykvO | short chain dehydrogenase | 2747854 | 2747102 | −3 | 753 |
| TM.orf2489 | | glutathione S-transferase domain-containing protein | 2748690 | 2748100 | −1 | 591 |
| TM.orf2490 | yqhC | transcriptional regulator protein | 2748951 | 2749880 | 2 | 930 |
| TM.orf2491 | | TetR family transcriptional regulator | 2750587 | 2749901 | −3 | 687 |
| TM.orf2492 | | hypothetical protein | 2750599 | 2750718 | 1 | 120 |
| TM.orf2493 | | class I peptide chain release factor | 2751175 | 2750732 | −3 | 444 |
| TM.orf2494 | mcp4 | Methyl-accepting chemotaxis protein | 2753444 | 2751255 | −2 | 2190 |
| TM.orf2495 | dcrA | methyl-accepting chemotaxis protein | 2753759 | 2755423 | 3 | 1665 |
| TM.orf2496 | htpX | peptidase M48 Ste24p | 2756252 | 2755389 | −2 | 864 |
| TM.orf2497 | | hypothetical protein | 2757400 | 2756330 | −3 | 1071 |
| TM.orf2498 | ahpC | alkylhydroperoxide reductase C | 2757718 | 2758257 | 1 | 540 |
| TM.orf2499 | ahpD | AhpD, alkyl hydroperoxide reductase D | 2758548 | 2759081 | 2 | 534 |
| TM.orf2500 | asnB | asparagine synthase (glutamine-hydrolyzing) | 2759614 | 2761425 | 1 | 1812 |
| TM.orf2501 | cphA | GNAT-family acetyltransferase TIGR03103 | 2761433 | 2763292 | 3 | 1860 |
| TM.orf2502 | yhfE | peptidase M42 family hydrolase | 2763289 | 2764512 | 1 | 1224 |
| TM.orf2503 | cysB | cysteine synthase | 2764722 | 2765726 | 2 | 1005 |
| TM.orf2504 | | Alanyl-tRNA editing protein alaX-M | 2765778 | 2766548 | 2 | 771 |
| TM.orf2505 | | alkyl hydroperoxide reductase/Thiol specific antioxidant/Mal allergen | 2767763 | 2766549 | −2 | 1215 |
| TM.orf2506 | MPST | rhodanese-related sulfurtransferase | 2768043 | 2768897 | 2 | 855 |
| TM.orf2507 | | putative acetyltransferase | 2769196 | 2769819 | 1 | 624 |
| TM.orf2508 | ooxA | BFD/(2Fe—2S)-binding domain-containing protein | 2769816 | 2771240 | 2 | 1425 |
| TM.orf2509 | | hypothetical protein | 2771237 | 2772184 | 3 | 948 |
| TM.orf2510 | | alpha/beta hydrolase fold | 2773161 | 2772196 | −1 | 966 |
| TM.orf2511 | aapP | ABC transporter component | 2774099 | 2773287 | −2 | 813 |
| TM.orf2512 | aapM | general L-amino acid transport system permease protein | 2775219 | 2774116 | −1 | 1104 |
| TM.orf2513 | yhdX | putative amino acid ABC transporter permease protein | 2776429 | 2775224 | −3 | 1206 |
| TM.orf2514 | aapJ | general L-amino acid transport system substrate-binding protein | 2777638 | 2776607 | −3 | 1032 |
| TM.orf2515 | metC | cystathionine beta-lyase | 2777991 | 2779223 | 2 | 1233 |
| TM.orf2516 | | L-sorbosone dehydrogenase | 2779267 | 2780544 | 1 | 1278 |
| TM.orf2517 | | hypothetical protein | 2780657 | 2782402 | 3 | 1746 |
| TM.orf2518 | luxO | two-component system response regulator LuxO | 2783883 | 2782414 | −1 | 1470 |
| TM.orf2519 | | FOG: TPR repeat, SEL1 subfamily | 2784735 | 2784028 | −1 | 708 |
| TM.orf2520 | | O-antigen polymerase | 2786030 | 2784870 | −2 | 1161 |
| TM.orf2521 | | hypothetical protein | 2787184 | 2786264 | −3 | 921 |
| TM.orf2522 | | putative DNA helicase related protein | 2790071 | 2787465 | −2 | 2607 |
| TM.orf2523 | | putative DNA helicase related protein | 2793105 | 2790073 | −1 | 3033 |
| TM.orf2524 | oxyR | transcriptional regulator, LysR family | 2793327 | 2794232 | 2 | 906 |
| TM.orf2525 | yagI | putative transcriptional regulator | 2795001 | 2794255 | −1 | 747 |
| TM.orf2526 | | TRAP dicarboxylate transporter, DctM subunit | 2796343 | 2795048 | −3 | 1296 |
| TM.orf2527 | | Tripartite ATP-independent periplasmic transporter DctQ component | 2796936 | 2796388 | −1 | 549 |
| TM.orf2528 | yiiZ | TRAP dicarboxylate transporter- DctP subunit | 2797997 | 2796951 | −2 | 1047 |
| TM.orf2529 | | Enoyl-CoA hydratase/isomerase | 2798877 | 2798095 | −1 | 783 |
| TM.orf2530 | paaG | enoyl-CoA hydratase/isomerase | 2799231 | 2800055 | 2 | 825 |
| TM.orf2531 | | L-carnitine dehydratase | 2800069 | 2800272 | 1 | 204 |
| TM.orf2532 | yfdE | L-carnitine dehydratase/bile acid-inducible protein F | 2800269 | 2801213 | 2 | 945 |
| TM.orf2533 | ydcS | extracellular solute-binding protein family 1 | 2801396 | 2802571 | 3 | 1176 |
| TM.orf2534 | ydcT | ABC transporter related protein | 2802653 | 2803717 | 3 | 1065 |
| TM.orf2535 | ydcU | binding-protein-dependent transport systems inner membrane component | 2803714 | 2804667 | 1 | 954 |
| TM.orf2536 | ydcV | binding-protein-dependent transport systems inner membrane component | 2804657 | 2805469 | 3 | 813 |
| TM.orf2537 | | Aminobutyraldehyde dehydrogenase | 2805481 | 2806926 | 1 | 1446 |
| TM.orf2538 | | short chain dehydrogenase | 2807565 | 2806969 | −1 | 597 |
| TM.orf2539 | yusZ | short chain dehydrogenase | 2807641 | 2808489 | 1 | 849 |
| TM.orf2540 | tuaC | glycosyl transferase, group 1 family protein | 2809650 | 2808493 | −1 | 1158 |
| TM.orf2541 | glmU | UDP-N-acetylglucosamine pyrophosphorylase | 2809869 | 2811233 | 2 | 1365 |
| TM.orf2542 | | amino acid carrier protein | 2812699 | 2811248 | −3 | 1452 |
| TM.orf2543 | | auxin efflux carrier | 2812835 | 2813761 | 3 | 927 |
| TM.orf2544 | yvfR | ABC transporter ATP-binding protein | 2813832 | 2814833 | 2 | 1002 |
| TM.orf2545 | | ABC-2 type transporter | 2814833 | 2815645 | 3 | 813 |
| TM.orf2546 | pyrB | Aspartate carbamoyltransferase | 2815807 | 2816742 | 1 | 936 |
| TM.orf2547 | pyrC | dihydroorotase-like protein | 2816827 | 2818170 | 1 | 1344 |
| TM.orf2548 | plsY | Glycerol-3-phosphate acyltransferase | 2818222 | 2818857 | 1 | 636 |
| TM.orf2549 | ppsD | AMP-dependent synthetase and ligase | 2821610 | 2818842 | −2 | 2769 |
| TM.orf2550 | | conserved hypothetical protein | 2822581 | 2821583 | −3 | 999 |

-continued

| Locus | Gene | Product | Start | End | Strand | Length |
|---|---|---|---|---|---|---|
| TM.orf2551 | smf | Predicted Rossmann fold nucleotide-binding protein involved in DNA uptake | 2822778 | 2823923 | 2 | 1146 |
| TM.orf2552 | topA | DNA topoisomerase I | 2824023 | 2826851 | 2 | 2829 |
| TM.orf2553 | rnr | RNAse R | 2827044 | 2829389 | 2 | 2346 |
| TM.orf2554 | garL | putative HpcH/HpaI aldolase family protein | 2829389 | 2830159 | 3 | 771 |
| TM.orf2555 | bcr | Bcr/CflA subfamily drug resistance transporter | 2830184 | 2831434 | 3 | 1251 |
| TM.orf2556 | fpr | Oxidoreductase FAD-binding domain protein | 2831561 | 2832334 | 3 | 774 |
| TM.orf2557 |  | hypothetical protein | 2832962 | 2832366 | −2 | 597 |
| TM.orf2558 | rpmG | Ribosomal protein L33 | 2833278 | 2833445 | 2 | 168 |
| TM.orf2559 | pleD | response regulator With diguanylate cyclase (GGDEF) domain | 2834972 | 2833596 | −2 | 1377 |
| TM.orf2560 | divK | response regulator receiver protein | 2835344 | 2834979 | −2 | 366 |
| TM.orf2561 | mak | putative kinase (mak-like)/transcriptional regulator, actin-like ATPase domain (NagC/XylR (ROK) familiy) | 2835614 | 2836603 | 3 | 990 |
| TM.orf2562 |  | ImpB/MucB/SamB family | 2836817 | 2837962 | 3 | 1146 |
| TM.orf2563 |  | Putative esterase | 2838395 | 2837967 | −2 | 429 |
| TM.orf2564 |  | conserved hypothetical protein | 2839379 | 2838450 | −2 | 930 |
| TM.orf2565 | CPA | hydrolase, carbon-nitrogen family | 2840387 | 2839506 | −2 | 882 |
| TM.orf2566 |  | membrane protein involved in aromatic hydrocarbon degradation | 2840714 | 2842075 | 3 | 1362 |
| TM.orf2567 | aguA | agmatine deiminase | 2843195 | 2842119 | −2 | 1077 |
| TM.orf2568 | ackA | acetate kinase | 2844673 | 2843495 | −3 | 1179 |
| TM.orf2569 | pta | bifunctional enoyl-CoA hydratase/phosphate acetyltransferase | 2846073 | 2844670 | −1 | 1404 |
| TM.orf2570 | ldh | leucine dehydrogenase | 2847277 | 2846210 | −3 | 1068 |
| TM.orf2571 | yybA | transcriptional regulator | 2848082 | 2847513 | −2 | 570 |
| TM.orf2572 |  | sodium/sulphate symporter | 2849593 | 2848193 | −3 | 1401 |
| TM.orf2573 |  | 3-methylcrotonoyl-CoA carboxylase subunit alpha | 2852581 | 2849621 | −3 | 2961 |
| TM.orf2574 | paaF | enoyl-CoA hydratase/isomerase | 2853442 | 2852645 | −3 | 798 |
| TM.orf2575 |  | carboxyltransferase subunit of acetyl-CoA carboxylase | 2855110 | 2853503 | −3 | 1608 |
| TM.orf2576 | doxJ | DSBA oxidoreductase | 2855841 | 2855239 | −1 | 603 |
| TM.orf2577 | mmgC | acyl-CoA dehydrogenase | 2857054 | 2855921 | −3 | 1134 |
| TM.orf2578 |  | acetyl-CoA acetyltransferase | 2858438 | 2857245 | −2 | 1194 |
| TM.orf2579 | IVD2 | isovaleryl-CoA dehydrogenase | 2859703 | 2858534 | −3 | 1170 |
| TM.orf2580 |  | thioesterase superfamily protein | 2860250 | 2859762 | −2 | 489 |
| TM.orf2581 | oxyR | LysR family transcriptional regulator | 2860607 | 2861512 | 3 | 906 |
| TM.orf2582 |  | conserved hypothetical protein | 2861863 | 2861534 | −3 | 330 |
| TM.orf2583 |  | AraC family transcriptional regulator | 2862942 | 2861932 | −1 | 1011 |
| TM.orf2584 |  | ThiJ/PfpI domain protein | 2863077 | 2863775 | 2 | 699 |
| TM.orf2585 |  | transporter | 2863873 | 2865057 | 1 | 1185 |
| TM.orf2586 | fecI | sigma-24 (FecI) | 2865141 | 2865656 | 2 | 516 |
| TM.orf2587 | fecR | two component sensor histidine kinase FecR/PupR | 2865745 | 2866692 | 1 | 948 |
| TM.orf2588 | bhuA | TonB-dependent receptor | 2866810 | 2869065 | 1 | 2256 |
| TM.orf2589 |  | conserved hypothetical protein | 2869604 | 2869125 | −2 | 480 |
| TM.orf2590 | exoZ | acyltransferase 3 | 2869734 | 2870780 | 2 | 1047 |
| TM.orf2591 |  | divalent cation transporter | 2872171 | 2870762 | −3 | 1410 |
| TM.orf2592 | maeB | malic enzyme | 2874567 | 2872258 | −1 | 2310 |
| TM.orf2593 | NpB | lipoate-protein ligase B | 2874843 | 2875538 | 2 | 696 |
| TM.orf2594 | bioY | putative biotin transporter bioY | 2876104 | 2875556 | −3 | 549 |
| TM.orf2595 |  | conserved hypothetical protein | 2876700 | 2876224 | −1 | 477 |
| TM.orf2596 | acyP | acylphosphatase | 2877104 | 2876739 | −2 | 366 |
| TM.orf2597 | DLD2 | FAD linked oxidase domain protein | 2878610 | 2877171 | −2 | 1440 |
| TM.orf2598 | Pcca | propionyl-CoA carboxylase alpha chain | 2880804 | 2878822 | −1 | 1983 |
| TM.orf2599 |  | hypothetical protein | 2881093 | 2880827 | −3 | 267 |
| TM.orf2600 | PCCB | propionyl-CoA carboxylase beta chain | 2882666 | 2881134 | −2 | 1533 |
| TM.orf2601 |  | ATP synthase mitochondrial F1 complex assembly factor 2 | 2883679 | 2882942 | −3 | 738 |
| TM.orf2602 |  | hydrolase, haloacid dehalogenase-like family protein | 2884392 | 2883676 | −1 | 717 |
| TM.orf2603 | rluC | ribosomal large subunit pseudouridine synthase C | 2885369 | 2884389 | −2 | 981 |
| TM.orf2604 | crcB | crcB protein | 2885761 | 2885366 | −3 | 396 |
| TM.orf2605 | rarA | recombination factor protein RarA | 2887095 | 2885758 | −1 | 1338 |
| TM.orf2606 | degP | periplasmic serine protease, Do | 2888628 | 2887156 | −1 | 1473 |
| TM.orf2607 | rplQ | 50S ribosomal protein L17 | 2889227 | 2888808 | −2 | 420 |
| TM.orf2608 | rpoA | DNA-directed RNA polymerase subunit alpha | 2890401 | 2889385 | −1 | 1017 |
| TM.orf2609 | rpsK | ribosomal protein S11 | 2890992 | 2890600 | −1 | 393 |
| TM.orf2610 | rpsM | ribosomal protein S13 | 2891370 | 2891002 | −1 | 369 |
| TM.orf2611 | adk | adenylate kinase | 2892128 | 2891475 | −2 | 654 |
| TM.orf2612 | secY | preprotein translocase, SecY subunit | 2893468 | 2892125 | −3 | 1344 |
| TM.orf2613 | rplO | ribosomal protein L15 | 2894180 | 2893698 | −2 | 483 |
| TM.orf2614 | rpmD | 50S ribosomal protein L30 | 2894431 | 2894237 | −3 | 195 |
| TM.orf2615 | rpsE | small subunit ribosomal protein S5 | 2895000 | 2894437 | −1 | 564 |

-continued

| Locus | Gene | Product | Start | End | Strand | Length |
|---|---|---|---|---|---|---|
| TM.orf2616 | rplR | ribosomal protein L18 | 2895373 | 2895014 | −3 | 360 |
| TM.orf2617 | rplF | large subunit ribosomal protein L6 | 2895921 | 2895388 | −1 | 534 |
| TM.orf2618 | rpsH | 30S ribosomal protein S8 | 2896331 | 2895933 | −2 | 399 |
| TM.orf2619 | rpsN | small subunit ribosomal protein S14 | 2896653 | 2896348 | −1 | 306 |
| TM.orf2620 | rplE | 50S ribosomal protein L5 | 2897214 | 2896675 | −1 | 540 |
| TM.orf2621 | rplX | ribosomal protein L24 | 2897549 | 2897232 | −2 | 318 |
| TM.orf2622 | rplN | large subunit ribosomal protein L14 | 2897917 | 2897549 | −3 | 369 |
| TM.orf2623 | rpsQ | ribosomal protein S17 | 2898186 | 2897950 | −1 | 237 |
| TM.orf2624 | rpmC | 50S ribosomal protein L29 | 2898394 | 2898191 | −3 | 204 |
| TM.orf2625 | rplP | 50S ribosomal protein L16 | 2898818 | 2898399 | −2 | 420 |
| TM.orf2626 | rpsC | 30S ribosomal protein S3 | 2899534 | 2898857 | −3 | 678 |
| TM.orf2627 | rplV | ribosomal protein L22 | 2899914 | 2899534 | −1 | 381 |
| TM.orf2628 | rpsS | small subunit ribosomal protein S19 | 2900195 | 2899917 | −2 | 279 |
| TM.orf2629 | rplB | Ribosomal protein L2 | 2901038 | 2900214 | −2 | 825 |
| TM.orf2630 | rplW | Ribosomal protein L23 | 2901336 | 2901043 | −1 | 294 |
| TM.orf2631 | rplD | 50S ribosomal protein L4P | 2901956 | 2901333 | −2 | 624 |
| TM.orf2632 | rplC | ribosomal protein L3 | 2902644 | 2901967 | −1 | 678 |
| TM.orf2633 | rpsJ | Ribosomal protein S10 | 2903003 | 2902692 | −2 | 312 |
| TM.orf2634 | tuf1 | Translation elongation factor Tu | 2904382 | 2903192 | −3 | 1191 |
| TM.orf2635 | fusA | elongation factor Tu | 2906518 | 2904437 | −3 | 2082 |
| TM.orf2636 | rpsG | 30S ribosomal protein S7 | 2907033 | 2906563 | −1 | 471 |
| TM.orf2637 | rpsL | 30S ribosomal protein S12 | 2907431 | 2907060 | −2 | 372 |
| TM.orf2638 | rpoC | DNA-directed RNA polymerase subunit beta' | 2912179 | 2907944 | −3 | 4236 |
| TM.orf2639 | rpoB | DNA-directed RNA polymerase subunit beta | 2916387 | 2912299 | −1 | 4089 |
| TM.orf2640 | | hypothetical protein | 2916691 | 2916506 | −3 | 186 |
| TM.orf2641 | rplL | large subunit ribosomal protein L7/L12 | 2917501 | 2917124 | −3 | 378 |
| TM.orf2642 | rplJ | 50S ribosomal protein L10 | 2918161 | 2917643 | −3 | 519 |
| TM.orf2643 | rplA | ribosomal protein L1 | 2919219 | 2918500 | −1 | 720 |
| TM.orf2644 | rplK | 50S ribosomal protein L11 | 2919652 | 2919224 | −3 | 429 |
| TM.orf2645 | nusG | transcription antitermination protein NusG | 2920374 | 2919841 | −1 | 534 |
| TM.orf2646 | | preprotein translocase subunit SecE | 2920593 | 2920396 | −1 | 198 |
| TM.orf2647 | tuf1 | Translation elongation factor Tu | 2922459 | 2921305 | −1 | 1155 |
| TM.orf2648 | rlmB | 23S rRNA (guanosine-2'-O-)-methyltransferase | 2923055 | 2923909 | 3 | 855 |
| TM.orf2649 | mtrB | two-component sensor histidine kinase | 2925366 | 2923870 | −1 | 1497 |
| TM.orf2650 | cusR | Response regulator consisting of a CheY-like receiver domain and a winged-helix DNA-binding domain | 2926069 | 2925353 | −3 | 717 |
| TM.orf2651 | degP | putative serine protease do-like | 2927881 | 2926325 | −3 | 1557 |
| TM.orf2652 | | biotin sulfoxide reductase | 2928767 | 2931172 | 3 | 2406 |
| TM.orf2653 | atm1 | Iron-sulfur clusters transporter | 2931181 | 2933037 | 1 | 1857 |
| TM.orf2654 | | hypothetical protein | 2933034 | 2933621 | 2 | 588 |
| TM.orf2655 | | hypothetical protein | 2933808 | 2933984 | 2 | 177 |
| TM.orf2656 | yyaM | transporter yyaM | 2934182 | 2935126 | 3 | 945 |
| TM.orf2657 | CRY2 | Deoxyribodipyrimidine photolyase | 2935239 | 2936708 | 2 | 1470 |
| TM.orf2658 | | amine oxidase | 2936714 | 2938120 | 3 | 1407 |
| TM.orf2659 | | DUF1365 domain containing protein | 2938216 | 2938983 | 1 | 768 |
| TM.orf2660 | | Cyclopropane-fatty-acyl-phospholipid synthase | 2938980 | 2940230 | 2 | 1251 |
| TM.orf2661 | | Short-chain dehydrogenase/reductase SDR | 2940220 | 2941020 | 1 | 801 |
| TM.orf2662 | | conserved hypothetical protein | 2941480 | 2941040 | −3 | 441 |
| TM.orf2663 | | deoxyribodipyrimidine photolyase-related protein | 2943093 | 2941477 | −1 | 1617 |
| TM.orf2664 | | Dehydrogenases with different specificities (related to short-chain alcohol dehydrogenases) | 2943321 | 2943100 | −1 | 222 |
| TM.orf2665 | silC | RND efflux system outer membrane lipoprotein | 2945018 | 2943492 | −2 | 1527 |
| TM.orf2666 | bepE | hydrophobe/amphiphile efflux-1 (HAE1) family protein | 2948190 | 2945038 | −1 | 3153 |
| TM.orf2667 | bepD | multidrug-efflux system secretion protein | 2949383 | 2948187 | −2 | 1197 |
| TM.orf2668 | bepR | transcription regulator protein | 2949681 | 2950376 | 2 | 696 |
| TM.orf2669 | | mutator insertion sequence transposase protein | 2950603 | 2950968 | 1 | 366 |
| TM.orf2670 | | conserved hypothetical protein | 2951085 | 2952566 | 2 | 1482 |
| TM.orf2671 | | conserved hypothetical protein | 2952556 | 2954118 | 1 | 1563 |
| TM.orf2672 | | Dehydrogenase | 2956176 | 2954548 | −1 | 1629 |
| TM.orf2673 | | DNA polymerase bacteriophage-type | 2956396 | 2957304 | 1 | 909 |
| TM.orf2674 | slt | Soluble lytic murein transglycosylase and related regulatory protein | 2957490 | 2959313 | 2 | 1824 |
| TM.orf2675 | exbB | tonB-system energizer ExbB | 2959543 | 2960499 | 1 | 957 |
| TM.orf2676 | exbD | biopolymer transport protein | 2960504 | 2960962 | 3 | 459 |
| TM.orf2677 | tonB | TonB family protein | 2960959 | 2961804 | 1 | 846 |
| TM.orf2678 | moaB | molybdenum cofactor biosynthesis protein B | 2961881 | 2962420 | 3 | 540 |
| TM.orf2679 | | radical SAM domain protein | 2962496 | 2963704 | 3 | 1209 |
| TM.orf2680 | arnT | Undecaprenyl phosphate-alpha-4-amino-4-deoxy-L-arabinose arabinosyl transferase | 2965367 | 2963712 | −2 | 1656 |
| TM.orf2681 | lpxB | Lipid-A-disaccharide synthase | 2965708 | 2965364 | −3 | 345 |

-continued

| Locus | Gene | Product | Start | End | Strand | Length |
|---|---|---|---|---|---|---|
| TM.orf2682 | arnC | glycosyl transferase family 2 | 2966607 | 2965705 | −1 | 903 |
| TM.orf2683 | qseC | periplasmic sensor signal transduction histidine kinase | 2968219 | 2966765 | −3 | 1455 |
| TM.orf2684 | mprA | response regulator | 2968910 | 2968206 | −2 | 705 |
| TM.orf2685 | nudC | MutT/NUDIX family protein | 2969908 | 2968943 | −3 | 966 |
| TM.orf2686 | dnaX | DNA polymerase III subunit gamma/tau | 2970289 | 2972370 | 1 | 2082 |
| TM.orf2687 | | transcriptional regulator | 2972469 | 2972792 | 2 | 324 |
| TM.orf2688 | | AraC family transcriptional regulator | 2972809 | 2973615 | 1 | 807 |
| TM.orf2689 | | glyoxalase/bleomycin resistance protein/dioxygenase | 2973643 | 2974044 | 1 | 402 |
| TM.orf2690 | cca | polyA polymerase related protein | 2974125 | 2975264 | 2 | 1140 |
| TM.orf2691 | | Ferritin, Dps family protein | 2975445 | 2975948 | 2 | 504 |
| TM.orf2692 | | HIT family protein | 2976492 | 2975956 | −1 | 537 |
| TM.orf2693 | recR | Recombinational DNA repair protein (RecF pathway) | 2976645 | 2977244 | 2 | 600 |
| TM.orf2694 | | UDP-glucose: sterol glucosyltransferase | 2977261 | 2978571 | 1 | 1311 |
| TM.orf2695 | | putative signal peptide | 2979704 | 2978574 | −2 | 1131 |
| TM.orf2696 | | hypothetical protein | 2981781 | 2980027 | −1 | 1755 |
| TM.orf2697 | rmuC | DNA recombination protein rmuC homolog | 2983064 | 2981907 | −2 | 1158 |
| TM.orf2698 | def | N-formylmethionyl-tRNA deformylase | 2983264 | 2983818 | 1 | 555 |
| TM.orf2699 | fmt | methionyl-tRNA formyltransferase fmt | 2983861 | 2984829 | 1 | 969 |
| TM.orf2700 | | PepSY-associated TM helix | 2987044 | 2985575 | −3 | 1470 |
| TM.orf2701 | fhuA | ferrichrome-iron receptor | 2989523 | 2987049 | −2 | 2475 |
| TM.orf2702 | fecR | putative FecR | 2990587 | 2989607 | −3 | 981 |
| TM.orf2703 | fecI | sigma factor | 2991125 | 2990580 | −2 | 546 |
| TM.orf2704 | | hypothetical protein | 2991823 | 2991218 | −3 | 606 |
| TM.orf2705 | dapE | succinyl-diaminopimelate desuccinylase | 2993001 | 2991820 | −1 | 1182 |
| TM.orf2706 | dapD | Tetrahydrodipicolinate N-succinyltransferase | 2993918 | 2993052 | −2 | 867 |
| TM.orf2707 | | putative hydrolase | 2994760 | 2993993 | −3 | 768 |
| TM.orf2708 | yhjK | signal transduction protein | 2994917 | 2996593 | 3 | 1677 |
| TM.orf2709 | dcrA | chemotaxis sensory transducer | 2996892 | 2998247 | 2 | 1356 |
| TM.orf2710 | argB | acetylglutamate kinase | 2999261 | 2998344 | −2 | 918 |
| TM.orf2711 | engB | ribosome biogenesis GTP-binding protein YsxC | 3000104 | 2999439 | −2 | 666 |
| TM.orf2712 | oxaA | 60 kDa inner membrane insertion protein | 3001983 | 3000277 | −1 | 1707 |
| TM.orf2713 | | conserved hypothetical protein | 3002392 | 3001976 | −3 | 417 |
| TM.orf2714 | rnpA | Bacterial ribonuclease P protein | 3002886 | 3002389 | −1 | 498 |
| TM.orf2715 | rpmH | 50S ribosomal protein L34 | 3003070 | 3002936 | −3 | 135 |
| TM.orf2716 | | hypothetical protein | 3003765 | 3003271 | −1 | 495 |
| TM.orf2717 | ctpF | ATPase, E1-E2 type | 3003941 | 3006679 | 3 | 2739 |
| TM.orf2718 | ydjX | mercuric reductase | 3006788 | 3007558 | 3 | 771 |
| TM.orf2719 | merA | pyridine nucleotide-disulphide oxidoreductase dimerisation region | 3007555 | 3009015 | 1 | 1461 |
| TM.orf2720 | yycG | periplasmic sensor signal transduction histidine kinase | 3009034 | 3010491 | 1 | 1458 |
| TM.orf2721 | mdmC | O-methyltransferase mdmC | 3011203 | 3010514 | −3 | 690 |
| TM.orf2722 | ygiF | conserved hypothetical protein | 3012925 | 3011234 | −3 | 1692 |
| TM.orf2723 | gsiA | ABC transporter, nucleotide binding/ATPase protein | 3013258 | 3015117 | 1 | 1860 |
| TM.orf2724 | gsiB | extracellular solute-binding protein | 3015235 | 3016773 | 1 | 1539 |
| TM.orf2725 | gsiC | binding-protein-dependent transport systems inner membrane component | 3017180 | 3018103 | 3 | 924 |
| TM.orf2726 | appC | ABC transporter, membrane spanning protein (oligopeptide) | 3018116 | 3018961 | 3 | 846 |
| TM.orf2727 | | conserved hypothetical protein | 3018999 | 3020756 | 2 | 1758 |
| TM.orf2728 | | ABC transporter related protein | 3021633 | 3020782 | −1 | 852 |
| TM.orf2729 | cmpB | sulfate ester transporter permease protein | 3022382 | 3021633 | −2 | 750 |
| TM.orf2730 | ssuC | sulfate ester transport system permease protein | 3023287 | 3022439 | −3 | 849 |
| TM.orf2731 | ssuA | sulfate ester transport system substrate-binding protein | 3024407 | 3023304 | −2 | 1104 |
| TM.orf2732 | | conserved hypothetical protein | 3025963 | 3024413 | −3 | 1551 |
| TM.orf2733 | gcvA | LysR family transcriptional regulator | 3026142 | 3027077 | 2 | 936 |
| TM.orf2734 | | iron ABC transporter substrate binding protein | 3027174 | 3028073 | 2 | 900 |
| TM.orf2735 | yfeB | ABC transporter related protein | 3028094 | 3029008 | 3 | 915 |
| TM.orf2736 | yfeC | Chelated iron transport system membrane protein yfeC | 3029005 | 3029865 | 1 | 861 |
| TM.orf2737 | yfeD | Chelated iron transport system membrane protein yfeD | 3029862 | 3030698 | 2 | 837 |
| TM.orf2738 | narP | DNA-binding response regulator | 3030785 | 3031390 | 3 | 606 |
| TM.orf2739 | envZ | signal transduction histidine kinase | 3031393 | 3033165 | 1 | 1773 |
| TM.orf2740 | | hypothetical protein | 3033317 | 3034462 | 3 | 1146 |
| TM.orf2741 | | conserved hypothetical protein | 3034706 | 3034455 | −2 | 252 |
| TM.orf2742 | | conserved hypothetical protein | 3035290 | 3034970 | −3 | 321 |
| TM.orf2743 | lysS | lysyl-tRNA synthetase, class I | 3037119 | 3035458 | −1 | 1662 |
| TM.orf2744 | yoaA | ATP-dependent DNA helicase | 3037259 | 3040222 | 3 | 2964 |
| TM.orf2745 | | conserved hypothetical protein | 3040305 | 3040676 | 2 | 372 |

| Locus | Gene | Product | Start | End | Strand | Length |
|---|---|---|---|---|---|---|
| TM.orf2746 | rnhB | Ribonuclease HII | 3040806 | 3041465 | 2 | 660 |
| TM.orf2747 | ccrM | modification methylase | 3041462 | 3042709 | 3 | 1248 |
| TM.orf2748 | | Tetratricopeptide repeat protein | 3044104 | 3042713 | −3 | 1392 |
| TM.orf2749 | yfhQ | A/G-specific adenine glycosylase | 3045424 | 3044249 | −3 | 1176 |
| TM.orf2750 | gcvA | LysR family transcriptional regulator | 3046455 | 3045505 | −1 | 951 |
| TM.orf2751 | | hypothetical protein | 3046612 | 3046824 | 1 | 213 |
| TM.orf2752 | yddQ | isochorismatase family protein | 3046859 | 3047482 | 3 | 624 |
| TM.orf2753 | | YCII-related | 3047586 | 3048008 | 2 | 423 |
| TM.orf2754 | | RNA polymerase sigma-70 factor, ECF family protein | 3047989 | 3049269 | 1 | 1281 |
| TM.orf2755 | | Zn-ribbon-containing, possibly RNA-binding protein and truncated derivatives | 3049341 | 3049919 | 2 | 579 |
| TM.orf2756 | | DsbA oxidoreductase | 3050099 | 3050797 | 3 | 699 |
| TM.orf2757 | smc | chromosome segregation ATPase | 3050825 | 3055081 | 3 | 4257 |
| TM.orf2758 | cobO | cob(I)alamin adenosyltransferase | 3056281 | 3055619 | −3 | 663 |
| TM.orf2759 | cobN | cobaltochelatase | 3060072 | 3056278 | −1 | 3795 |
| TM.orf2760 | cobW | cobalamin synthesis protein cobW | 3061138 | 3060086 | −3 | 1053 |
| TM.orf2761 | btuB | receptor | 3061646 | 3063613 | 3 | 1968 |
| TM.orf2762 | fdx4 | Ferredoxin, 2Fe—2S | 3063597 | 3064358 | 2 | 762 |
| TM.orf2763 | | periplasmic binding protein | 3064355 | 3065317 | 3 | 963 |
| TM.orf2764 | yjbI | protozoan/cyanobacterial globin family protein | 3065328 | 3065810 | 2 | 483 |
| TM.orf2765 | | putative transcriptional regulator | 3066493 | 3065927 | −3 | 567 |
| TM.orf2766 | rhtA | Inner membrane transporter rhtA | 3066596 | 3067492 | 3 | 897 |
| TM.orf2767 | cobB | Cobyrinic acid a,c-diamide synthase CbiA | 3068814 | 3067474 | −1 | 1341 |
| TM.orf2768 | cobA | putative uroporphyrin-III C-methyltransferase protein | 3069710 | 3068811 | −2 | 900 |
| TM.orf2769 | cbiD | cobalt-precorrin-6A synthase | 3069779 | 3070960 | 3 | 1182 |
| TM.orf2770 | cobK | precorrin-6x reductase | 3070965 | 3071759 | 2 | 795 |
| TM.orf2771 | hupE | HupE/UreJ protein | 3072327 | 3071746 | −1 | 582 |
| TM.orf2772 | cobM | precorrin-4 C11-methyltransferase | 3073264 | 3072419 | −3 | 846 |
| TM.orf2773 | cobJ | precorrin-3B C17-methyltransferase (cobJ) | 3075147 | 3073261 | −1 | 1887 |
| TM.orf2774 | cobI | precorrin 2 methylase | 3075887 | 3075144 | −2 | 744 |
| TM.orf2775 | cobL | Uroporphyrin-III C/tetrapyrrole (Corrin/Porphyrin) methyltransferase | 3077104 | 3075866 | −3 | 1239 |
| TM.orf2776 | cobH | Precorrin-8X methylmutase | 3077739 | 3077101 | −1 | 639 |
| TM.orf2777 | cbiX | Sirohydrochlorin cobaltochelatase | 3078893 | 3077736 | −2 | 1158 |
| TM.orf2778 | atpI | ATP synthase protein I | 3079616 | 3080020 | 3 | 405 |
| TM.orf2779 | atpB | F0F1-type ATP synthase, subunit a | 3080135 | 3080866 | 3 | 732 |
| TM.orf2780 | atpE | ATP synthase C chain | 3080986 | 3081213 | 1 | 228 |
| TM.orf2781 | | H + transporting two-sector ATPase B/B' subunit | 3081431 | 3081934 | 3 | 504 |
| TM.orf2782 | atpF | ATP synthase B chain precursor | 3081940 | 3082422 | 1 | 483 |
| TM.orf2783 | icfG | protein serine/threonine phosphatase | 3082791 | 3084833 | 2 | 2043 |
| TM.orf2784 | | ABC-type transport system, periplasmic component | 3084830 | 3086056 | 3 | 1227 |
| TM.orf2785 | | conserved hypothetical protein | 3087609 | 3086035 | −1 | 1575 |
| TM.orf2786 | | putative inner membrane transport protein | 3089987 | 3087606 | −2 | 2382 |
| TM.orf2787 | | glycine dehydrogenase subunit 2 | 3091764 | 3090199 | −1 | 1566 |
| TM.orf2788 | | glycine dehydrogenase subunit 1 | 3093125 | 3091761 | −2 | 1365 |
| TM.orf2789 | gcvH | glycine cleavage system H protein | 3093510 | 3093133 | −1 | 378 |
| TM.orf2790 | gcvT | glycine cleavage system T protein | 3094692 | 3093553 | −1 | 1140 |
| TM.orf2791 | | conserved hypothetical protein | 3095752 | 3095186 | −3 | 567 |
| TM.orf2792 | | CDGSH iron sulfur domain-containing protein 3 | 3096209 | 3095940 | −2 | 270 |
| TM.orf2793 | ispH | 4-hydroxy-3-methylbut-2-enyl diphosphate reductase | 3096503 | 3097483 | 3 | 981 |
| TM.orf2794 | thrB | Homoserine kinase ThrB | 3097567 | 3098532 | 1 | 966 |
| TM.orf2795 | rnhA | ribonuclease H | 3098519 | 3098974 | 3 | 456 |
| TM.orf2796 | upp | uracil phosphoribosyltransferase | 3099673 | 3098999 | −3 | 675 |
| TM.orf2797 | | Redoxin domain protein | 3100282 | 3099800 | −3 | 483 |
| TM.orf2798 | dsbD | Thiol: disulfide interchange protein | 3102643 | 3100418 | −3 | 2226 |
| TM.orf2799 | | transcriptional regulator | 3102915 | 3103508 | 2 | 594 |
| TM.orf2800 | | conserved hypothetical protein | 3104602 | 3103775 | −3 | 828 |
| TM.orf2801 | rimJ | GCN5-related N-acetyltransferase | 3105314 | 3104664 | −2 | 651 |
| TM.orf2802 | tusA | SirA-like protein | 3105687 | 3105343 | −1 | 345 |
| TM.orf2803 | | M16 family peptidase | 3107003 | 3105726 | −2 | 1278 |
| TM.orf2804 | thrC | threonine synthase | 3108468 | 3107065 | −1 | 1404 |
| TM.orf2805 | | Thermostable carboxypeptidase 1 | 3110179 | 3108641 | −3 | 1539 |
| TM.orf2806 | ctaA | cytochrome C oxidase assembly protein, AA3 subunit-controlling protein | 3111219 | 3110215 | −1 | 1005 |
| TM.orf2807 | | SURF1 family protein | 3111981 | 3111298 | −1 | 684 |
| TM.orf2808 | | conserved hypothetical protein | 3112341 | 3112093 | −1 | 249 |
| TM.orf2809 | | putative cytochrome c oxidase polypeptide III (cytochrome aa3 subunit 3) | 3113309 | 3112500 | −2 | 810 |
| TM.orf2810 | ctaG | cytochrome-c oxidase assembly protein | 3114153 | 3113482 | −1 | 672 |
| TM.orf2811 | | hypothetical protein | 3114413 | 3114198 | −2 | 216 |
| TM.orf2812 | ctaB | putative protoheme IX farnesyltransferase (heme o synthase) | 3115450 | 3114410 | −3 | 1041 |

-continued

| Locus | Gene | Product | Start | End | Strand | Length |
|---|---|---|---|---|---|---|
| TM.orf2813 | ctaD | cytochrome c oxidase, subunit I | 3117072 | 3115573 | −1 | 1500 |
| TM.orf2814 | ctaC | cytochrome C oxidase subunit II | 3118046 | 3117207 | −2 | 840 |
| TM.orf2815 | | peptidase U62 modulator of DNA gyrase | 3118594 | 3120039 | 1 | 1446 |
| TM.orf2816 | | TRAP transporter, 4TM/12TM fusion protein | 3122292 | 3120118 | −1 | 2175 |
| TM.orf2817 | | TRAP transporter solute receptor, TAXI family | 3123381 | 3122419 | −1 | 963 |
| TM.orf2818 | | conserved hypothetical protein | 3124273 | 3123434 | −3 | 840 |
| TM.orf2819 | yfhH | RpiR family transcriptional regulator | 3125326 | 3124340 | −3 | 987 |
| TM.orf2820 | | aminotransferase class-III | 3126719 | 3125340 | −2 | 1380 |
| TM.orf2821 | | putative glutamatecysteine ligase | 3128133 | 3126892 | −1 | 1242 |
| TM.orf2822 | rsmE | ribosomal RNA small subunit methyltransferase | 3129106 | 3128333 | −3 | 774 |
| TM.orf2823 | Coq2 | 4-hydroxybenzoate polyprenyltransferase and related prenyltransferases | 3129254 | 3130210 | 3 | 957 |
| TM.orf2824 | | hypothetical protein | 3130457 | 3130176 | −2 | 282 |
| TM.orf2825 | ubiD | 3-octaprenyl-4-hydroxybenzoate carboxy-lyase | 3130544 | 3132064 | 3 | 1521 |
| TM.orf2826 | | conserved hypothetical protein | 3132143 | 3133906 | 3 | 1764 |
| TM.orf2827 | | hypothetical protein | 3133963 | 3134148 | 1 | 186 |
| TM.orf2828 | | metallophosphoesterase | 3134264 | 3135094 | 3 | 831 |
| TM.orf2829 | pmbA | Peptidase U62, modulator of DNA gyrase | 3135206 | 3136573 | 3 | 1368 |
| TM.orf2830 | suhB | inositol-phosphate phosphatase | 3136627 | 3137493 | 1 | 867 |
| TM.orf2831 | msbA | ABC-type multidrug transport system, ATPase and permease components | 3137447 | 3139429 | 3 | 1983 |
| TM.orf2832 | | conserved hypothetical protein | 3139435 | 3140166 | 1 | 732 |
| TM.orf2833 | waaA | three-deoxy-D-manno-octulosonic-acid transferase | 3140163 | 3141497 | 2 | 1335 |
| TM.orf2834 | lpxK | Tetraacyldisaccharide 4'-kinase | 3141494 | 3142582 | 3 | 1089 |
| TM.orf2835 | | Lauroyl/myristoyl acyltransferase | 3142579 | 3143499 | 1 | 921 |
| TM.orf2836 | | hypothetical protein | 3144007 | 3143807 | −3 | 201 |
| TM.orf2837 | | hypothetical protein | 3144272 | 3144619 | 3 | 348 |
| TM.orf2838 | | Putative amidase | 3146122 | 3144731 | −3 | 1392 |
| TM.orf2877 | | cytidine/deoxycytidylate deaminase, zinc-binding region | 3185617 | 3185183 | −3 | 435 |
| TM.orf2878 | | possible gamma-glutamyl-gamma-aminobutyrate hydrolase | 3185753 | 3186490 | 3 | 738 |
| TM.orf2879 | | pseudouridine synthase, Rsu | 3186487 | 3188253 | 1 | 1767 |
| TM.orf2880 | | N6-adenine-specific methylase | 3188260 | 3188895 | 1 | 636 |
| TM.orf2881 | | conserved hypothetical protein | 3188997 | 3189890 | 2 | 894 |
| TM.orf2882 | metC | cystathionine beta-lyase | 3191071 | 3189935 | −3 | 1137 |
| TM.orf2883 | | Biotin synthase 1 | 3192783 | 3191149 | −1 | 1635 |
| TM.orf2884 | | conserved hypothetical protein | 3194217 | 3193033 | −1 | 1185 |
| TM.orf2885 | mutL | DNA mismatch repair protein MutL | 3196145 | 3194217 | −2 | 1929 |
| TM.orf2886 | pgi | Glucose-6-phosphate isomerase | 3197443 | 3196160 | −3 | 1284 |
| TM.orf2887 | | protease | 3198930 | 3197473 | −1 | 1458 |
| TM.orf2888 | | peptidase, M16 family | 3200453 | 3198927 | −2 | 1527 |
| TM.orf2889 | | conserved hypothetical protein | 3201124 | 3200570 | −3 | 555 |
| TM.orf2890 | lspA | signal peptidase II | 3201750 | 3201214 | −1 | 537 |
| TM.orf2891 | ileS | isoleucyl-tRNA synthetase | 3204559 | 3201743 | −3 | 2817 |
| TM.orf2892 | ribF | FAD synthase | 3205664 | 3204687 | −2 | 978 |
| TM.orf2893 | | MaoC-like dehydratase | 3206193 | 3205744 | −1 | 450 |
| TM.orf2894 | | epoxide hydrolase | 3207378 | 3206482 | −1 | 897 |
| TM.orf2895 | | hypothetical protein | 3207569 | 3207859 | 3 | 291 |
| TM.orf2896 | ybjE | conserved hypothetical protein | 3207856 | 3208455 | 1 | 600 |
| TM.orf2897 | | Alcohol dehydrogenase zinc-binding domain protein | 3209452 | 3208460 | −3 | 993 |
| TM.orf2898 | ydeS | TetR family transcriptional regulator | 3210229 | 3209510 | −3 | 720 |
| TM.orf2899 | emrB | major facilitator superfamily permease | 3211827 | 3210226 | −1 | 1602 |
| TM.orf2900 | emrA | secretion protein HlyD | 3212940 | 3211843 | −1 | 1098 |
| TM.orf2901 | | hypothetical protein | 3213113 | 3212973 | −2 | 141 |
| TM.orf2902 | sigK | RNA polymerase sigma factor | 3214108 | 3214683 | 1 | 576 |
| TM.orf2903 | | conserved hypothetical protein | 3214680 | 3215468 | 2 | 789 |
| TM.orf2904 | | extracellular solute-binding protein | 3215562 | 3216545 | 2 | 984 |
| TM.orf2905 | | iron(III) transport system permease protein | 3216650 | 3218272 | 3 | 1623 |
| TM.orf2906 | ugpC | ABC transporter component | 3218269 | 3219384 | 1 | 1116 |
| TM.orf2907 | | FAD dependent oxidoreductase | 3220579 | 3219395 | −3 | 1185 |
| TM.orf2908 | | TetR family transcriptional regulator | 3220742 | 3221344 | 3 | 603 |
| TM.orf2909 | map | methionine aminopeptidase, type I, Map putative | 3221341 | 3222165 | 1 | 825 |
| TM.orf2910 | | conserved hypothetical protein | 3222268 | 3223383 | 1 | 1116 |
| TM.orf2911 | tsr | putative methyl-accepting chemotaxis protein | 3223543 | 3225231 | 1 | 1689 |
| TM.orf2912 | | putative methyl-accepting chemotaxis protein | 3225458 | 3227146 | 3 | 1689 |
| TM.orf2913 | | conserved hypothetical protein | 3227181 | 3227645 | 2 | 465 |
| TM.orf2914 | | conserved hypothetical protein | 3228498 | 3227650 | −1 | 849 |
| TM.orf2915 | eutB | ethanolamine ammonia-lyase heavy chain | 3228683 | 3230098 | 3 | 1416 |
| TM.orf2916 | eutC | Ethanolamine ammonia-lyase | 3230095 | 3230928 | 1 | 834 |
| TM.orf2917 | ycaQ | conserved hypothetical protein | 3232153 | 3230915 | −3 | 1239 |
| TM.orf2918 | | putative lactonase precursor | 3232435 | 3233472 | 1 | 1038 |

-continued

| Locus | Gene | Product | Start | End | Strand | Length |
|---|---|---|---|---|---|---|
| TM.orf2919 | rimJ | GCN5-related N-acetyltransferase | 3233568 | 3234098 | 2 | 531 |
| TM.orf2920 | hmuV | ABC transporter related protein | 3235006 | 3234191 | −3 | 816 |
| TM.orf2921 | | transport system permease protein | 3236055 | 3235006 | −1 | 1050 |
| TM.orf2922 | | periplasmic binding protein | 3237179 | 3236052 | −2 | 1128 |
| TM.orf2923 | | conserved hypothetical protein | 3237469 | 3237176 | −3 | 294 |
| TM.orf2924 | cirA | TonB-dependent receptor | 3239539 | 3237536 | −3 | 2004 |
| TM.orf2925 | nahR | Transcriptional regulator, LysR family | 3240606 | 3239626 | −1 | 981 |
| TM.orf2926 | degU | response regulator | 3240884 | 3241528 | 3 | 645 |
| TM.orf2927 | yxjM | putative signal transduction histidine kinase | 3241525 | 3243357 | 1 | 1833 |
| TM.orf2928 | | truncated FmtB | 3243493 | 3244641 | 1 | 1149 |
| TM.orf2929 | | hypothetical protein | 3244953 | 3246122 | 2 | 1170 |
| TM.orf2930 | | conserved hypothetical protein | 3246119 | 3247663 | 3 | 1545 |
| TM.orf2931 | adhA | alcohol dehydrogenase | 3248702 | 3247671 | −2 | 1032 |
| TM.orf2932 | | hypothetical protein | 3248839 | 3248681 | −3 | 159 |
| TM.orf2933 | acoR | Fis family GAF modulated sigma54 specific transcriptional regulator | 3249372 | 3251333 | 2 | 1962 |
| TM.orf2934 | | Cobalt transport protein ATP-binding subunit | 3252222 | 3251398 | −1 | 825 |
| TM.orf2935 | | cobalt transport integral membrane protein | 3252524 | 3252222 | −2 | 303 |
| TM.orf2936 | | cobalt ABC transporter, inner membrane subunit CbiQ | 3252979 | 3252521 | −3 | 459 |
| TM.orf2937 | cbiN | cobalt transport protein | 3253308 | 3252979 | −1 | 330 |
| TM.orf2938 | cbiM | cobalamin biosynthesis protein cbim | 3253979 | 3253305 | −2 | 675 |
| TM.orf2939 | | conserved hypothetical protein | 3254522 | 3254896 | 3 | 375 |
| TM.orf2940 | | putative RNA polymerase, sigma-24 subunit, ECF subfamily | 3254893 | 3256143 | 1 | 1251 |
| TM.orf2941 | | hypothetical protein | 3256528 | 3256127 | −3 | 402 |
| TM.orf2942 | slmA | transcriptional regulatory protein | 3256620 | 3257273 | 2 | 654 |
| TM.orf2943 | | Oxidoreductase FAD/NAD(P)-binding | 3258577 | 3257249 | −3 | 1329 |
| TM.orf2944 | slyA | MarR family transcriptional regulator | 3259153 | 3258638 | −3 | 516 |
| TM.orf2945 | | membrane protein of unknown function | 3260016 | 3259150 | −1 | 867 |
| TM.orf2946 | yecE | conserved hypothetical protein | 3261081 | 3261875 | 2 | 795 |
| TM.orf2947 | yhaZ | conserved hypothetical protein | 3262984 | 3261872 | −3 | 1113 |
| TM.orf2948 | | conserved hypothetical protein | 3263683 | 3263087 | −3 | 597 |
| TM.orf2949 | hutU | urocanate hydratase | 3265396 | 3263723 | −3 | 1674 |
| TM.orf2950 | hutH | phenylalanine/histidine ammonia-lyase | 3267021 | 3265471 | −1 | 1551 |
| TM.orf2951 | | putative glycine betaine/L-proline transport ATP binding subunit | 3267847 | 3267026 | −3 | 822 |
| TM.orf2952 | proW | histidine transport system permease ABC transporter protein | 3268697 | 3267840 | −2 | 858 |
| TM.orf2953 | proX | Glycine betaine-binding periplasmic protein | 3269858 | 3268815 | −2 | 1044 |
| TM.orf2954 | hutC | GntR family transcriptional regulator | 3270101 | 3270859 | 3 | 759 |
| TM.orf2955 | mdeA | methionine gamma-lyase | 3272131 | 3270926 | −3 | 1206 |
| TM.orf2956 | lrp | transcriptional regulator, AsnC family | 3272249 | 3272707 | 3 | 459 |
| TM.orf2957 | | transglutaminase domain protein | 3272807 | 3273718 | 3 | 912 |
| TM.orf2958 | | 2-hydroxy-3-oxopropionate reductase | 3273870 | 3274793 | 2 | 924 |
| TM.orf2959 | ybfI | transcriptional regulator, AraC family | 3275542 | 3274745 | −3 | 798 |
| TM.orf2960 | | conserved hypothetical protein | 3275668 | 3276291 | 1 | 624 |
| TM.orf2961 | | plasmid stabilization system | 3276601 | 3276302 | −3 | 300 |
| TM.orf2962 | | addiction module antidote protein, CC2985 family | 3276854 | 3276591 | −2 | 264 |
| TM.orf2963 | yddQ | putative hydrolase | 3277476 | 3276931 | −1 | 546 |
| TM.orf2964 | glxA | AraC family transcriptional regulator | 3277598 | 3278584 | 3 | 987 |
| TM.orf2965 | rplU | 50S ribosomal protein L21P | 3279122 | 3279430 | 3 | 309 |
| TM.orf2966 | rpmA | 50S ribosomal protein L27 | 3279545 | 3279805 | 3 | 261 |
| TM.orf2967 | obg | GTP-binding protein Obg/CgtA | 3280029 | 3281519 | 2 | 1491 |
| TM.orf2968 | proB | gamma-glutamyl kinase | 3281516 | 3282721 | 3 | 1206 |
| TM.orf2969 | proA | gamma-glutamyl phosphate reductase | 3282718 | 3284061 | 1 | 1344 |
| TM.orf2970 | nadD | nicotinate (nicotinamide) nucleotide adenylyltransferase | 3284126 | 3284737 | 3 | 612 |
| TM.orf2971 | ybeB | lojap-related protein | 3284865 | 3285269 | 2 | 405 |
| TM.orf2972 | rlmH | Ribosomal RNA large subunit methyltransferase H | 3285397 | 3285870 | 1 | 474 |
| TM.orf2973 | | conserved hypothetical protein | 3285905 | 3286588 | 3 | 684 |
| TM.orf2974 | gpmI | phosphoglycerate mutase | 3286725 | 3288329 | 2 | 1605 |
| TM.orf2975 | yibP | Peptidase M23B | 3288334 | 3289740 | 1 | 1407 |
| TM.orf2976 | ctpA | carboxyl-terminal processing protease | 3289834 | 3291231 | 1 | 1398 |
| TM.orf2977 | | conserved hypothetical protein | 3291269 | 3292579 | 3 | 1311 |
| TM.orf2978 | rppH | nudix family hydrolase | 3292662 | 3293138 | 2 | 477 |
| TM.orf2979 | modA | molybdate ABC transporter, periplasmic molybdate-binding protein | 3293246 | 3294043 | 3 | 798 |
| TM.orf2980 | modB | molybdate ABC transporter, permease protein | 3294078 | 3294839 | 2 | 762 |
| TM.orf2981 | modC | molybdate transporter ATP-binding protein | 3294836 | 3295957 | 3 | 1122 |
| TM.orf2982 | mopB | putative molybdenum-binding transcriptional regulator ModE family protein | 3296390 | 3295932 | −2 | 459 |
| TM.orf2983 | | conserved hypothetical protein | 3297205 | 3296390 | −3 | 816 |
| TM.orf2984 | atpC | F-type H+-transporting ATPase epsilon chain | 3297891 | 3297490 | −1 | 402 |
| TM.orf2985 | atpD | F1-ATP Synthase Beta Chain | 3299373 | 3297949 | −1 | 1425 |

-continued

| Locus | Gene | Product | Start | End | Strand | Length |
|---|---|---|---|---|---|---|
| TM.orf2986 | atpG | F-type H+-transporting ATPase gamma chain | 3300342 | 3299449 | −1 | 894 |
| TM.orf2987 | atpA | primosome assembly protein PriA | 3302050 | 3300515 | −3 | 1536 |
| TM.orf2988 | atpH | F0F1 ATP synthase subunit delta | 3302607 | 3302047 | −1 | 561 |
| TM.orf2989 | | primosome assembly protein PriA | 3305120 | 3302916 | −2 | 2205 |
| TM.orf2990 | tal | transaldolase | 3305466 | 3306122 | 2 | 657 |
| TM.orf2991 | | conserved hypothetical protein | 3306180 | 3306977 | 2 | 798 |
| TM.orf2992 | xerC | Tyrosine recombinase xerC | 3306962 | 3307984 | 3 | 1023 |
| TM.orf2993 | pcoA | multicopper oxidase | 3309420 | 3307975 | −1 | 1446 |
| TM.orf2994 | | hypothetical protein | 3309811 | 3309482 | −3 | 330 |
| TM.orf2995 | crp | transcriptional regulator, Crp | 3310559 | 3309834 | −2 | 726 |
| TM.orf2996 | | hypothetical protein | 3312135 | 3310825 | −1 | 1311 |
| TM.orf2997 | lolD | ABC transporter, ATP-binding protein | 3312949 | 3312218 | −3 | 732 |
| TM.orf2998 | | efflux ABC transporter, permease protein | 3314076 | 3312949 | −1 | 1128 |
| TM.orf2999 | | auxiliary transport protein, MFP family | 3315350 | 3314073 | −2 | 1278 |
| TM.orf3000 | | hypothetical protein | 3315558 | 3315881 | 2 | 324 |
| TM.orf3001 | rpoE | RNA polymerase sigma-70 factor, ECF subfamily | 3315994 | 3316557 | 1 | 564 |
| TM.orf3002 | | conserved hypothetical protein | 3316554 | 3317003 | 2 | 450 |
| TM.orf3003 | | conserved hypothetical protein | 3317000 | 3317461 | 3 | 462 |
| TM.orf3004 | LPD1 | dihydrolipoamide dehydrogenase | 3318981 | 3317569 | −1 | 1413 |
| TM.orf3005 | sucB | 2-oxoglutarate dehydrogenase, E2 component, dihydrolipoamide succinyltransferase | 3320307 | 3319057 | −1 | 1251 |
| TM.orf3006 | sucA | 2-oxoglutarate dehydrogenase E1 component | 3323323 | 3320432 | −3 | 2892 |
| TM.orf3007 | sucD | Succinyl-CoA synthetase alpha chain | 3324264 | 3323389 | −1 | 876 |
| TM.orf3008 | sucC | succinyl-CoA synthetase, beta subunit | 3325436 | 3324267 | −2 | 1170 |
| TM.orf3009 | mdh | malate dehydrogenase | 3326560 | 3325616 | −3 | 945 |
| TM.orf3010 | | AFG1 family ATPase | 3328140 | 3326962 | −1 | 1179 |
| TM.orf3011 | ywrD | gamma-glutamyltranspeptidase | 3328425 | 3329972 | 2 | 1548 |
| TM.orf3012 | asd | aspartate-semialdehyde dehydrogenase | 3330149 | 3331141 | 3 | 993 |
| TM.orf3013 | paiB | Protease synthase and sporulation protein PAI | 3331307 | 3331975 | 3 | 669 |
| TM.orf3014 | | hypothetical protein | 3332533 | 3331976 | −3 | 558 |
| TM.orf3015 | dppF | DppF | 3333765 | 3332776 | −1 | 990 |
| TM.orf3016 | dppD | dipeptide ABC superfamily ATP binding cassette transporter, ABC protein | 3334762 | 3333758 | −3 | 1005 |
| TM.orf3017 | dppC | peptide/nickel transport system permease protein | 3335658 | 3334762 | −1 | 897 |
| TM.orf3018 | dppB | nickel-transporting ATPase | 3336750 | 3335740 | −1 | 1011 |
| TM.orf3019 | dppA | dipeptide-binding ABC transporter substrate-binding component | 3338498 | 3336903 | −2 | 1596 |
| TM.orf3020 | yqjG | putative glutathione S-transferase | 3339743 | 3338727 | −2 | 1017 |
| TM.orf3021 | | Flavoprotein WrbA | 3340444 | 3339830 | −3 | 615 |
| TM.orf3022 | | transcriptional regulator | 3340592 | 3341506 | 3 | 915 |
| TM.orf3023 | | conserved hypothetical protein | 3341543 | 3341980 | 3 | 438 |
| TM.orf3024 | | putative hydrolase | 3342081 | 3342911 | 2 | 831 |
| TM.orf3025 | yerD | glutamate synthase | 3344576 | 3342924 | −2 | 1653 |
| TM.orf3026 | dapB | Dihydrodipicolinate reductase, bacterial | 3345433 | 3344573 | −3 | 861 |
| TM.orf3027 | | two-component hybrid sensor and regulator | 3347128 | 3345491 | −3 | 1638 |
| TM.orf3028 | gitA | citrate synthase I | 3348662 | 3347349 | −2 | 1314 |
| TM.orf3029 | | conserved hypothetical protein | 3349785 | 3348889 | −1 | 897 |
| TM.orf3030 | | cytochrome c, class I | 3350426 | 3349782 | −2 | 645 |
| TM.orf3031 | | hypothetical protein | 3351351 | 3350485 | −1 | 867 |
| TM.orf3032 | | phenylacetic acid degradation-like protein | 3351529 | 3351951 | 1 | 423 |
| TM.orf3033 | | histidine triad protein | 3352065 | 3352511 | 2 | 447 |
| TM.orf3034 | cya | adenylate/guanylate cyclase | 3352516 | 3353817 | 1 | 1302 |
| TM.orf3035 | | ribosomal large subunit pseudouridine synthase D | 3354697 | 3353828 | −3 | 870 |
| TM.orf3036 | | endoribonuclease L-PSP | 3354836 | 3355204 | 3 | 369 |
| TM.orf3037 | nudI | putative NUDIX hydrolase | 3355213 | 3355674 | 1 | 462 |
| TM.orf3038 | CMO | dioxygenase | 3356860 | 3355649 | −3 | 1212 |
| TM.orf3039 | | putative lactone-dependent transcriptional regulator (tetr-family), mmfr | 3357527 | 3356826 | −2 | 702 |
| TM.orf3040 | ytcB | NAD-dependent epimerase/dehydratase | 3357911 | 3358969 | 3 | 1059 |
| TM.orf3041 | | dTDP-4-dehydrorhamnose 3,5-epimerase | 3358977 | 3359543 | 2 | 567 |
| TM.orf3042 | | NAD dependent epimerase/dehydratase family | 3359540 | 3360484 | 3 | 945 |
| TM.orf3043 | | oxidoreductase | 3360565 | 3361692 | 1 | 1128 |
| TM.orf3044 | crt | enoyl-CoA hydratase/isomerase | 3361740 | 3362543 | 2 | 804 |
| TM.orf3045 | | conserved hypothetical protein | 3362634 | 3363560 | 2 | 927 |
| TM.orf3046 | | LmbE-like protein | 3364894 | 3364127 | −3 | 768 |
| TM.orf3047 | | Acyl-CoA dehydrogenase | 3366072 | 3364888 | −1 | 1185 |
| TM.orf3048 | | glycosyl transferase family 2 | 3367241 | 3366069 | −2 | 1173 |
| TM.orf3049 | PIP | proline iminopeptidase | 3368566 | 3367547 | −3 | 1020 |
| TM.orf3050 | yfgC | peptidase M48 Ste24p | 3368909 | 3370357 | 3 | 1449 |
| TM.orf3051 | | thioesterase superfamily protein | 3370850 | 3370371 | −2 | 480 |
| TM.orf3052 | | thioesterase superfamily protein | 3371302 | 3370868 | −3 | 435 |
| TM.orf3053 | rpoH | RNA polymerase sigma-32 factor | 3372489 | 3371590 | −1 | 900 |

-continued

| Locus | Gene | Product | Start | End | Strand | Length |
|---|---|---|---|---|---|---|
| TM.orf3054 | ydeB | Transcriptional regulators, similar to M. xanthus CarD | 3373223 | 3372726 | −2 | 498 |
| TM.orf3055 | fdxA | 4Fe—4S ferredoxin iron-sulfur binding domain-containing protein | 3374015 | 3373677 | −2 | 339 |
| TM.orf3056 | hslR | heat shock protein | 3374698 | 3374264 | −3 | 435 |
| TM.orf3057 | | Helicase-like protein | 3377337 | 3374695 | −1 | 2643 |
| TM.orf3058 | htpG | TPG_MAGMM RecName: Full = Chaperone protein htpG; AltName: Full = Heat shock protein htpG; AltName: Full = High temperature protein G | 3377583 | 3379529 | 2 | 1947 |
| TM.orf3059 | ycaD | major facilitator transporter | 3381061 | 3379517 | −3 | 1545 |
| TM.orf3060 | acnA | aconitate hydratase | 3381716 | 3381291 | −2 | 426 |
| TM.orf3061 | acn | aconitate hydratase | 3383994 | 3381724 | −1 | 2271 |
| TM.orf3062 | braF | high-affinity branched-chain amino acid transport ATP-binding protein | 3384871 | 3385668 | 1 | 798 |
| TM.orf3063 | | Long-chain acyl-CoA synthetases (AMP-forming) | 3385665 | 3387596 | 2 | 1932 |
| TM.orf3064 | braD | inner-membrane translocator | 3387696 | 3388589 | 2 | 894 |
| TM.orf3065 | livM | branched-chain amino acid transport system permease protein | 3388609 | 3389670 | 1 | 1062 |
| TM.orf3066 | | branched-chain amino acid transport system substrate-binding protein | 3389828 | 3391060 | 3 | 1233 |
| TM.orf3067 | livF | ABC transporter related protein | 3391149 | 3392006 | 2 | 858 |
| TM.orf3068 | paaK | phenylacetate--CoA ligase | 3392075 | 3393316 | 3 | 1242 |
| TM.orf3069 | hpsA | 3-hexulose-6-phosphate synthase | 3394166 | 3393423 | −2 | 744 |
| TM.orf3070 | | dihydroxy-acid dehydratase | 3395893 | 3394163 | −3 | 1731 |
| TM.orf3071 | | hypothetical protein | 3396063 | 3395899 | −1 | 165 |
| TM.orf3072 | | trap dicarboxylate transporter- dctm subunit | 3397390 | 3396074 | −3 | 1317 |
| TM.orf3073 | | TRAP-type mannitol/chloroaromatic compound transport system, small permease component | 3397901 | 3397380 | −2 | 522 |
| TM.orf3074 | yiiZ | TRAP dicarboxylate family transporter, DctP subunit | 3398998 | 3397976 | −3 | 1023 |
| TM.orf3075 | | transcriptional regulatory protein | 3399123 | 3399842 | 2 | 720 |
| TM.orf3076 | | hypothetical protein | 3400517 | 3399870 | −2 | 648 |
| TM.orf3077 | ccmA | heme ABC exporter, ATP-binding protein CcmA | 3400672 | 3401334 | 1 | 663 |
| TM.orf3078 | helB | heme exporter protein CcmB | 3401331 | 3402005 | 2 | 675 |
| TM.orf3079 | cycZ | heme exporter protein CcmC | 3402323 | 3402895 | 3 | 573 |
| TM.orf3080 | | hypothetical protein | 3403067 | 3403330 | 3 | 264 |
| TM.orf3081 | ccmE | CcmE/CycJ protein | 3403314 | 3403874 | 2 | 561 |
| TM.orf3082 | cycK | cytochrome c biogenesis factor | 3403874 | 3405889 | 3 | 2016 |
| TM.orf3083 | helX | cytochrome c biogenesis protein | 3405902 | 3406438 | 3 | 537 |
| TM.orf3084 | ccmH | protein involved in biosynthesis of c-type cytochromes | 3406435 | 3407139 | 1 | 705 |
| TM.orf3085 | cycH | cytochrome c-type biogenesis protein CycH | 3407136 | 3408560 | 2 | 1425 |
| TM.orf3086 | aotP | Arginine/ornithine transport ATP-binding protein aotP | 3408690 | 3409466 | 2 | 777 |
| TM.orf3087 | petP | MarR family transcriptional regulator | 3409604 | 3410125 | 3 | 522 |
| TM.orf3088 | occT | extracellular solute-binding protein family 3 | 3410322 | 3411095 | 2 | 774 |
| TM.orf3089 | hisQ | polar amino acid ABC transporter, inner membrane subunit | 3411236 | 3411958 | 3 | 723 |
| TM.orf3090 | occM | polar amino acid transport system permease protein | 3411962 | 3412648 | 3 | 687 |
| TM.orf3091 | yisB | conserved hypothetical protein | 3412717 | 3412950 | 1 | 234 |
| TM.orf3092 | livH | branched-chain amino acid ABC transporter (permease) | 3413234 | 3414094 | 3 | 861 |
| TM.orf3093 | braE | inner-membrane translocator | 3414099 | 3415142 | 2 | 1044 |
| TM.orf3094 | braF | branched-chain amino acid ABC transporter ATP-binding protein | 3415139 | 3415915 | 3 | 777 |
| TM.orf3095 | livF | branched-chain amino acid ABC transporter ATP-binding protein | 3415902 | 3416609 | 2 | 708 |
| TM.orf3096 | | extracellular ligand-binding receptor | 3416695 | 3417903 | 1 | 1209 |
| TM.orf3097 | queF | GTP cyclohydrolase family protein | 3418466 | 3417993 | −2 | 474 |
| TM.orf3098 | | conserved hypothetical protein | 3418835 | 3419149 | 3 | 315 |
| TM.orf3099 | | conserved hypothetical protein | 3419154 | 3419504 | 2 | 351 |
| TM.orf3100 | folD | FolD bifunctional protein | 3419570 | 3420466 | 3 | 897 |
| TM.orf3101 | | conserved hypothetical protein | 3420498 | 3421088 | 2 | 591 |
| TM.orf3102 | | conserved hypothetical protein | 3421639 | 3421070 | −3 | 570 |
| TM.orf3103 | | conserved hypothetical protein | 3421938 | 3421645 | −1 | 294 |
| TM.orf3104 | hss | homospermidine synthase | 3423511 | 3422096 | −3 | 1416 |
| TM.orf3105 | argG | argininosuccinate synthase | 3424922 | 3423708 | −2 | 1215 |
| TM.orf3106 | | Nephrocystin-3 | 3427879 | 3425117 | −3 | 2763 |
| TM.orf3107 | cyaA | adenylate cyclase, family 3 | 3429289 | 3427979 | −3 | 1311 |
| TM.orf3108 | | Glutathione S-transferase domain protein | 3429468 | 3430160 | 2 | 693 |
| TM.orf3109 | | beta-lactamase domain-containing protein | 3430166 | 3431068 | 3 | 903 |
| TM.orf3110 | pqqE | pyrroloquinoline quinone biosynthesis protein PqqE | 3432137 | 3431073 | −2 | 1065 |

-continued

| Locus | Gene | Product | Start | End | Strand | Length |
|---|---|---|---|---|---|---|
| TM.orf3111 | | coenzyme PQQ synthesis D | 3432424 | 3432134 | −3 | 291 |
| TM.orf3112 | pqqC | pyrroloquinoline quinone biosynthesis protein PqqC | 3433185 | 3432421 | −1 | 765 |
| TM.orf3113 | pqqB | coenzyme PQQ biosynthesis protein B | 3434081 | 3433182 | −2 | 900 |
| TM.orf3114 | | hypothetical protein | 3434225 | 3434100 | −2 | 126 |
| TM.orf3115 | rlmN | cfr family radical SAM enzyme | 3435617 | 3434352 | −2 | 1266 |
| TM.orf3116 | | conserved hypothetical protein | 3436238 | 3435684 | −2 | 555 |
| TM.orf3117 | | conserved hypothetical protein | 3436513 | 3437232 | 1 | 720 |
| TM.orf3118 | cya2 | adenylyl cyclase class-3/4/guanylyl cyclase | 3437330 | 3438481 | 3 | 1152 |
| TM.orf3119 | | conserved hypothetical protein | 3439105 | 3440133 | 1 | 1029 |
| TM.orf3120 | purH | bifunctional phosphoribosylaminoimidazolecarboxamide formyltransferase/IMP cyclohydrolase | 3440241 | 3441824 | 2 | 1584 |
| TM.orf3121 | | hypothetical protein | 3441914 | 3442384 | 3 | 471 |
| TM.orf3122 | | conserved hypothetical protein | 3442872 | 3442390 | −1 | 483 |
| TM.orf3123 | | conserved hypothetical protein | 3443297 | 3442869 | −2 | 429 |
| TM.orf3124 | | NAD-glutamate dehydrogenase | 3448211 | 3443370 | −2 | 4842 |
| TM.orf3125 | | conserved hypothetical protein | 3449196 | 3448420 | −1 | 777 |
| TM.orf3126 | mhbM | 3-hydroxybenzoate 6-hydroxylase | 3450939 | 3449662 | −1 | 1278 |
| TM.orf3127 | | MarR family transcriptional regulator | 3451172 | 3451669 | 3 | 498 |
| TM.orf3128 | | conserved hypothetical protein | 3451809 | 3452450 | 2 | 642 |
| TM.orf3129 | | TRAP dicarboxylate transporter- DctM subunit | 3452447 | 3453766 | 3 | 1320 |
| TM.orf3130 | | conserved hypothetical protein | 3453790 | 3454284 | 1 | 495 |
| TM.orf3131 | siaP | TRAP dicarboxylate transporter- DctP subunit | 3454360 | 3455430 | 1 | 1071 |
| TM.orf3132 | | Ala-tRNA(Pro) hydrolase | 3455535 | 3456035 | 2 | 501 |
| TM.orf3133 | trxA | thioredoxin | 3456220 | 3457137 | 1 | 918 |
| TM.orf3134 | lonD | Peptidase S16, lon-like protein | 3457253 | 3457921 | 3 | 669 |
| TM.orf3135 | | conserved hypothetical protein | 3457941 | 3458153 | 2 | 213 |
| TM.orf3136 | | conserved hypothetical protein | 3458158 | 3458556 | 1 | 399 |
| TM.orf3137 | | Ubiquinone biosynthesis hydroxylase, UbiH/UbiF/VisC/COQ6 | 3460270 | 3459056 | −3 | 1215 |
| TM.orf3138 | glnB | nitrogen regulatory protein P-II | 3460624 | 3460962 | 1 | 339 |
| TM.orf3139 | | ammonium transporter | 3460989 | 3462314 | 2 | 1326 |
| TM.orf3140 | aatC | aminotransferase class I and II | 3462541 | 3463752 | 1 | 1212 |
| TM.orf3141 | ftsK | DNA segregation ATPase FtsK/SpoIIIE | 3463826 | 3466243 | 3 | 2418 |
| TM.orf3142 | lolA | Outer membrane lipoprotein carrier protein LolA | 3466269 | 3466949 | 2 | 681 |
| TM.orf3143 | | Na+-driven multidrug efflux pump | 3466974 | 3468320 | 2 | 1347 |
| TM.orf3144 | puuD | putative glutamine amidotransferase | 3468377 | 3469162 | 3 | 786 |
| TM.orf3145 | | conserved hypothetical protein | 3469186 | 3469800 | 1 | 615 |
| TM.orf3146 | alsT | putative amino acid carrier transmembrane protein | 3469958 | 3471373 | 3 | 1416 |
| TM.orf3147 | | intracellular PHB depolymerase | 3472706 | 3471480 | −2 | 1227 |
| TM.orf3148 | sco1 | Classical-complement-pathway C3/C5 convertase | 3473694 | 3473074 | −1 | 621 |
| TM.orf3149 | cobD | Cobalamin biosynthesis protein | 3473990 | 3475003 | 3 | 1014 |
| TM.orf3150 | | SH3 domain-containing YSC84-like protein | 3475748 | 3475056 | −2 | 693 |
| TM.orf3151 | cobP | Adenosylcobinamide-phosphate guanylyltransferase | 3476453 | 3475914 | −2 | 540 |
| TM.orf3152 | | Phosphoglycerate mutase | 3477076 | 3476447 | −3 | 630 |
| TM.orf3153 | | hypothetical protein | 3477915 | 3477067 | −1 | 849 |
| TM.orf3154 | cobT | nicotinate-nucleotide--dimethylbenzimidazole | 3478146 | 3479183 | 2 | 1038 |
| TM.orf3155 | yddV | diguanylate cyclase | 3479436 | 3480347 | 2 | 912 |
| TM.orf3156 | sigK | RNA polymerase sigma-70 factor, ECF family protein | 3480622 | 3481158 | 1 | 537 |
| TM.orf3157 | chrR | Anti-sigma factor ChrR | 3481158 | 3481880 | 2 | 723 |
| TM.orf3158 | | conserved hypothetical protein | 3481960 | 3482967 | 1 | 1008 |
| TM.orf3159 | lpsJ | 3-oxoadipate CoA-transferase, beta subunit | 3483693 | 3483052 | −1 | 642 |
| TM.orf3160 | lpsI | 3-oxoadipate CoA-transferase subunit A | 3484379 | 3483696 | −2 | 684 |
| TM.orf3161 | sam | RNA polymerase sigma-54 factor | 3484716 | 3485678 | 2 | 963 |
| TM.orf3162 | | hypothetical protein | 3485976 | 3486301 | 3 | 627 |
| TM.orf3163 | | 3-hydroxyacyl-CoA dehydrogenase type-2 | 3486519 | 3487283 | 2 | 765 |
| TM.orf3164 | | pterin-4-alpha-carbinolamine dehydratase | 3487679 | 3487371 | −2 | 309 |
| TM.orf3165 | | conserved hypothetical protein | 3487806 | 3488243 | 2 | 438 |
| TM.orf3166 | ybgC | Acyl-CoA thioester hydrolase ybgC | 3488700 | 3488275 | −1 | 426 |
| TM.orf3167 | | conserved hypothetical protein | 3489298 | 3489618 | 1 | 321 |
| TM.orf3168 | gltX | glutamyl-tRNA synthetase, class Ic | 3490728 | 3489820 | −1 | 909 |
| TM.orf3169 | mhpE | pyruvate carboxyltransferase | 3491016 | 3492002 | 2 | 987 |
| TM.orf3170 | | PqqC-like protein | 3492074 | 3492838 | 3 | 765 |
| TM.orf3171 | ilvE | branched-chain amino acid aminotransferase-like protein | 3492931 | 3493884 | 1 | 954 |
| TM.orf3172 | | conserved hypothetical protein | 3493934 | 3495322 | 3 | 1389 |
| TM.orf3173 | dlpA | Dimethylmenaquinone methyltransferase | 3495385 | 3496095 | 1 | 711 |
| TM.orf3174 | divJ | putative non-motile and phage-resistance protein | 3496222 | 3497631 | 1 | 1410 |
| TM.orf3175 | | HNH endonuclease family protein | 3497817 | 3498515 | 2 | 699 |
| TM.orf3176 | aspC | possible aspartate transaminase | 3498661 | 3499797 | 1 | 1137 |

-continued

| Locus | Gene | Product | Start | End | Strand | Length |
|---|---|---|---|---|---|---|
| TM.orf3177 | thiE | thiamine-phosphate pyrophosphorylase | 3500432 | 3499794 | −2 | 639 |
| TM.orf3178 | thiM | Hydroxyethylthiazole kinase | 3501238 | 3500429 | −3 | 810 |
| TM.orf3179 | coq7 | ubiquinone biosynthesis protein COQ7 | 3502079 | 3501501 | −2 | 579 |
| TM.orf3180 | | disulfide bond formation protein, DsbB family | 3502650 | 3502105 | −1 | 546 |
| TM.orf3181 | | TRAP transporter solute receptor TAXI family protein | 3502874 | 3504154 | 3 | 1281 |
| TM.orf3182 | pepB | Leucyl aminopeptidase | 3504275 | 3505681 | 3 | 1407 |
| TM.orf3183 | | conserved hypothetical protein | 3505814 | 3507070 | 3 | 1257 |
| TM.orf3184 | ada | transcriptional regulator, AraC family | 3508283 | 3507045 | −2 | 1239 |
| TM.orf3185 | yejF | putative ATP-binding component of ABC transporter | 3510038 | 3508401 | −2 | 1638 |
| TM.orf3186 | yejE | binding-protein-dependent transport systems inner membrane component | 3511088 | 3510180 | −2 | 909 |
| TM.orf3187 | yejB | peptide/nickel transport system permease protein | 3512177 | 3511092 | −2 | 1086 |
| TM.orf3188 | | ABC-type oligopeptide transport system, periplasmic component | 3514064 | 3512196 | −2 | 1869 |
| TM.orf3189 | | Inositol monophosphatase | 3514926 | 3514123 | −1 | 804 |
| TM.orf3190 | cycM | putative CytoChrome c-like protein | 3515700 | 3515083 | −1 | 618 |
| TM.orf3191 | kdsB | 3-deoxy-manno-octulosonate cytidylyltransferase | 3516147 | 3516881 | 2 | 735 |
| TM.orf3192 | ADT1 | prephenate dehydratase | 3516989 | 3517876 | 3 | 888 |
| TM.orf3193 | qacE | small multidrug resistance protein | 3517958 | 3518305 | 3 | 348 |
| TM.orf3194 | ydcN | transcriptional regulator, XRE family with cupin sensor | 3519017 | 3518373 | −2 | 645 |
| TM.orf3195 | ilvE | branched-chain amino acid aminotransferase | 3520135 | 3519266 | −3 | 870 |
| TM.orf3196 | ybbP | ABC transporter permease ybbP | 3523075 | 3520439 | −3 | 2637 |
| TM.orf3197 | ybbA | ABC transporter related protein | 3523761 | 3523072 | −1 | 690 |
| TM.orf3198 | tesA | SGNH hydrolase-type arylesterase | 3524000 | 3524653 | 3 | 654 |
| TM.orf3199 | | carbon monoxide dehydrogenase subunit G | 3524776 | 3525519 | 1 | 744 |
| TM.orf3200 | | transferase hexapeptide repeat containing protein | 3526095 | 3525565 | −1 | 531 |
| TM.orf3201 | | L-carnitine dehydratase/bile acid-inducible protein F | 3527392 | 3526133 | −3 | 1260 |
| TM.orf3202 | yngG | pyruvate carboxyltransferase | 3528387 | 3527440 | −1 | 948 |
| TM.orf3203 | benM | transcriptional regulator, LysR family | 3529436 | 3528513 | −2 | 924 |
| TM.orf3204 | | conserved hypothetical protein | 3529858 | 3529433 | −3 | 426 |
| TM.orf3205 | BphI | lactonase | 3530062 | 3530904 | 1 | 843 |
| TM.orf3206 | | conserved hypothetical protein | 3531622 | 3530864 | −3 | 759 |
| TM.orf3207 | | conserved hypothetical protein | 3531763 | 3532068 | 1 | 306 |
| TM.orf3208 | | conserved hypothetical protein | 3532080 | 3532586 | 2 | 507 |
| TM.orf3209 | yadG | ABC-type multidrug transport system, ATPase component | 3534029 | 3533049 | −2 | 981 |
| TM.orf3210 | lbsA | *Lactobacillus* shifted protein | 3534259 | 3534438 | 1 | 180 |
| TM.orf3211 | polA | DNA polymerase I | 3534664 | 3537480 | 1 | 2817 |
| TM.orf3212 | | HhH-GPD family protein | 3537477 | 3538469 | 2 | 993 |
| TM.orf3213 | | conserved hypothetical protein | 3538466 | 3538942 | 3 | 477 |
| TM.orf3214 | | conserved hypothetical protein | 3538974 | 3540389 | 2 | 1416 |
| TM.orf3215 | | hypothetical protein | 3540683 | 3540396 | −2 | 288 |
| TM.orf3216 | | conserved hypothetical protein | 3541151 | 3540885 | −2 | 267 |
| TM.orf3217 | hspH | heat shock protein, Hsp20 family | 3541701 | 3541243 | −1 | 459 |
| TM.orf3218 | | Transcription initiation factor TFIIIB, Brf1 subunit/Transcription initiation factor TFIIB | 3542719 | 3542366 | −3 | 354 |
| TM.orf3219 | aroA | 3-phosphoshikimate 1-carboxyvinyltransferase | 3543011 | 3544378 | 3 | 1368 |
| TM.orf3220 | cmk | cytidylate kinase | 3544403 | 3545047 | 3 | 645 |
| TM.orf3221 | rpsA | Ribosomal protein S1 | 3545443 | 3547167 | 1 | 1725 |
| TM.orf3222 | | HD domain protein | 3547383 | 3547958 | 2 | 576 |
| TM.orf3223 | | sulfatase | 3547999 | 3549504 | 1 | 1506 |
| TM.orf3224 | | Abortive infection bacteriophage resistance protein Abi | 3550482 | 3549514 | −1 | 969 |
| TM.orf3225 | cbbR | putative transcriptional regulator | 3551469 | 3550579 | −1 | 891 |
| TM.orf3226 | ugpB | sn-glycerol-3-phosphate-binding periplasmic protein | 3551620 | 3552942 | 1 | 1323 |
| TM.orf3227 | ugpA | sn-glycerol-3-phosphate ABC transporter permease | 3553017 | 3553922 | 2 | 906 |
| TM.orf3228 | ugpE | sn-glycerol-3-phosphate transport system permease protein | 3553909 | 3554838 | 1 | 930 |
| TM.orf3229 | sppA | signal peptide peptidase SppA, 36K type | 3554947 | 3555903 | 1 | 957 |
| TM.orf3230 | ihfB | Bacterial nucleoid DNA-binding protein | 3556054 | 3556335 | 1 | 282 |
| TM.orf3231 | | hypothetical protein | 3556477 | 3556851 | 1 | 375 |
| TM.orf3232 | pyrF | orotidine-5'-phosphate decarboxylase | 3557039 | 3557800 | 3 | 762 |
| TM.orf3233 | trpF | N-(5'phosphoribosyl)anthranilate isomerase | 3557804 | 3558508 | 3 | 705 |
| TM.orf3234 | trpB | tryptophan synthase subunit beta | 3558529 | 3559743 | 1 | 1215 |
| TM.orf3235 | trpA | RPA_AZOBR RecName: Full = Tryptophan synthase alpha chain gb | 3559740 | 3560612 | 2 | 873 |
| TM.orf3236 | accD | acetyl-CoA carboxylase carboxyl transferase subunit beta | 3560668 | 3561687 | 1 | 1020 |

-continued

| Locus | Gene | Product | Start | End | Strand | Length |
|---|---|---|---|---|---|---|
| TM.orf3237 | FOL3 | folC bifunctional protein | 3561746 | 3563083 | 3 | 1338 |
| TM.orf3238 | ytxM | carboxyl esterase | 3563117 | 3564007 | 3 | 891 |
| TM.orf3239 | cyaA | putative adenylate/guanylate cyclase | 3566353 | 3564008 | −3 | 2346 |
| TM.orf3240 | FPGS | FolC bifunctional protein | 3567653 | 3566331 | −2 | 1323 |
| TM.orf3241 | trxA | thioredoxin 1 | 3568048 | 3567725 | −3 | 324 |
| TM.orf3242 | addA | UvrD/REP helicase | 3571704 | 3568213 | −1 | 3492 |
| TM.orf3243 | | conserved hypothetical protein | 3574796 | 3571701 | −2 | 3096 |
| TM.orf3244 | | nucleotidyl transferase | 3575568 | 3574801 | −1 | 768 |
| TM.orf3245 | | aminoglycoside phosphotransferase | 3576644 | 3575565 | −2 | 1080 |
| TM.orf3246 | | ATP-binding protein RP013 | 3577213 | 3576641 | −3 | 573 |
| TM.orf3247 | ffh | signal recognition particle, subunit SRP54 | 3577543 | 3578898 | 1 | 1356 |
| TM.orf3248 | rpsP | 30S ribosomal protein S16 | 3578997 | 3579362 | 2 | 366 |
| TM.orf3249 | rimM | 50S ribosomal protein L19 | 3579412 | 3579993 | 1 | 582 |
| TM.orf3250 | trmD | tRNA (guanine-N1)-methyltransferase | 3579990 | 3580757 | 2 | 768 |
| TM.orf3251 | rplS | 50S ribosomal protein L19 | 3580972 | 3581352 | 1 | 381 |
| TM.orf3252 | leuC | 3-isopropylmalate/(R)-2-methylmalate dehydratase large subunit | 3581677 | 3583095 | 1 | 1419 |
| TM.orf3253 | leuD | 3-isopropylmalate dehydratase small subunit | 3583134 | 3583751 | 2 | 618 |
| TM.orf3254 | leuB | Isocitrate/isopropylmalate dehydrogenase | 3583878 | 3584987 | 2 | 1110 |
| TM.orf3255 | asd | Aspartate-semialdehyde dehydrogenase, USG-1 | 3585223 | 3586281 | 1 | 1059 |
| TM.orf3256 | | oxidoreductase domain protein | 3586295 | 3586954 | 3 | 660 |
| TM.orf3257 | fabG | putative 3-oxoacyl- | 3587684 | 3586980 | −2 | 705 |
| TM.orf3258 | | trap dicarboxylate transporter- dctp subunit | 3587917 | 3589041 | 1 | 1125 |
| TM.orf3259 | | TRAP-T family transporter, DctQ (4 TMs) subunit | 3589069 | 3589629 | 1 | 561 |
| TM.orf3260 | siaT | trap-t family transporter, dctm (12 tms) subunit | 3589629 | 3590936 | 2 | 1308 |
| TM.orf3261 | | transcriptional regulator, TetR family protein | 3591010 | 3591693 | 1 | 684 |
| TM.orf3262 | | enoyl-CoA hydratase | 3591720 | 3592520 | 2 | 801 |
| TM.orf3263 | | CoA-binding protein | 3592517 | 3593758 | 3 | 1242 |
| TM.orf3264 | | GNAT family acetyltransferase | 3593875 | 3594702 | 1 | 828 |
| TM.orf3265 | yngJ | putative acyl-CoA dehydrogenase yngJ | 3594699 | 3595880 | 2 | 1182 |
| TM.orf3266 | yecA | amino acid transporter | 3598008 | 3596713 | −1 | 1296 |
| TM.orf3267 | | Cupin domain protein | 3598343 | 3598005 | −2 | 339 |
| TM.orf3268 | ycgG | conserved hypothetical protein | 3599129 | 3598347 | −2 | 783 |
| TM.orf3269 | lysM | transcription regulator | 3599342 | 3599839 | 3 | 498 |
| TM.orf3270 | pdxY | pyridoxamine kinase | 3600724 | 3599858 | −3 | 867 |
| TM.orf3271 | citE | citrate lyase beta subunit | 3601172 | 3602044 | 3 | 873 |
| TM.orf3272 | | Acyl dehydratase | 3602055 | 3603122 | 2 | 1068 |
| TM.orf3273 | sdhC | succinate dehydrogenase cytochrome b-556 subunit | 3603352 | 3603738 | 1 | 387 |
| TM.orf3274 | sdhD | succinate dehydrogenase, hydrophobic membrane anchor protein | 3603788 | 3604168 | 3 | 381 |
| TM.orf3275 | sdhA | succinate dehydrogenase flavoprotein subunit | 3604176 | 3605966 | 2 | 1791 |
| TM.orf3276 | sdhB | succinate dehydrogenase iron-sulfur subunit | 3606010 | 3606783 | 1 | 774 |
| TM.orf3277 | ygaD | ABC transporter ATP-binding/permease | 3608760 | 3607006 | −1 | 1755 |
| TM.orf3278 | | ABC transporter related protein | 3610532 | 3608757 | −2 | 1776 |
| TM.orf3279 | | major facilitator transporter | 3611773 | 3610529 | −3 | 1245 |
| TM.orf3280 | fyuA | TonB-dependent receptor | 3613947 | 3611788 | −1 | 2160 |
| TM.orf3281 | pchR | helix-turn-helix domain-containing protein | 3614138 | 3615079 | 3 | 942 |
| TM.orf3282 | | hypothetical protein | 3614145 | 3613993 | −1 | 153 |
| TM.orf3283 | | urease-associated protein | 3615596 | 3615351 | −2 | 246 |
| TM.orf3284 | yegD | chaperone protein yegD | 3616092 | 3617390 | 2 | 1299 |
| TM.orf3285 | | alanine racemase domain-containing protein | 3618219 | 3617413 | −1 | 807 |
| TM.orf3286 | | HPr kinase | 3619309 | 3618341 | −3 | 969 |
| TM.orf3287 | | conserved hypothetical protein | 3619452 | 3620324 | 2 | 873 |
| TM.orf3288 | | WbuT | 3621042 | 3620362 | −1 | 681 |
| TM.orf3289 | | hypothetical protein | 3621383 | 3621243 | −2 | 141 |
| TM.orf3290 | | glycosyl transferase family 2 | 3622369 | 3621461 | −3 | 909 |
| TM.orf3291 | | conserved hypothetical protein | 3622716 | 3622423 | −1 | 294 |
| TM.orf3292 | | conserved hypothetical protein | 3623628 | 3622744 | −1 | 885 |
| TM.orf3293 | | extradiol ring-cleavage dioxygenase III subunit B | 3624532 | 3623735 | −3 | 798 |
| TM.orf3294 | | DoxD-like family protein | 3625025 | 3624582 | −2 | 444 |
| TM.orf3295 | nahR | transcriptional regulator MexT | 3625214 | 3626170 | 3 | 957 |
| TM.orf3296 | | isomerase | 3626969 | 3626145 | −2 | 825 |
| TM.orf3297 | | short-chain dehydrogenase/reductase SDR | 3627802 | 3626993 | −3 | 810 |
| TM.orf3298 | | CoxK | 3628846 | 3627869 | −3 | 978 |
| TM.orf3299 | pecT | HTH-type transcriptional regulator | 3629067 | 3630047 | 2 | 981 |
| TM.orf3300 | kefC | potassium efflux system protein | 3630112 | 3631839 | 1 | 1728 |
| TM.orf3301 | icfA | Carbonate dehydratase | 3632556 | 3631864 | −1 | 693 |
| TM.orf3302 | ugpQ | glycerophosphoryl diester phosphodiesterase | 3632751 | 3633533 | 2 | 783 |
| TM.orf3303 | ugpB | extracellular solute-binding protein, family 1 | 3633629 | 3634957 | 3 | 1329 |
| TM.orf3304 | ugpA | SN-glycerol-3-phosphate ABC transporter, permease protein | 3635054 | 3635941 | 3 | 888 |
| TM.orf3305 | ugpE | sn-glycerol-3-phosphate ABC transporter, permease protein | 3635957 | 3636811 | 3 | 855 |

-continued

| Locus | Gene | Product | Start | End | Strand | Length |
|---|---|---|---|---|---|---|
| TM.orf3306 | ugpC | glycerol-3-phosphate transporter ATP-binding subunit | 3637061 | 3638218 | 3 | 1158 |
| TM.orf3307 | mscS | MscS mechanosensitive ion channel | 3639138 | 3638236 | −1 | 903 |
| TM.orf3308 | | TM2 | 3639549 | 3639205 | −1 | 345 |
| TM.orf3309 | | 2-nitropropane dioxygenase NPD | 3640112 | 3639657 | −2 | 456 |
| TM.orf3310 | | putative nitropropane dioxygenase | 3640765 | 3640112 | −3 | 654 |
| TM.orf3311 | gitR | regulatory protein, LysR: LysR, substrate-binding | 3640840 | 3641739 | 1 | 900 |
| TM.orf3312 | | phospholipase/carboxylesterase | 3642450 | 3641746 | −1 | 705 |
| TM.orf3313 | | phospholipase/carboxylesterase | 3643159 | 3642488 | −3 | 672 |
| TM.orf3314 | | F-box protein SKIP8 | 3643373 | 3643801 | 3 | 429 |
| TM.orf3315 | | multiple antibiotic resistance (MarC)-related protein | 3643901 | 3644626 | 3 | 726 |
| TM.orf3316 | ppx | Exopolyphosphatase | 3646169 | 3644631 | −2 | 1539 |
| TM.orf3317 | ppk | Polyphosphate kinase | 3648626 | 3646239 | −2 | 2388 |
| TM.orf3318 | | putative phosphohistidine phosphatase, SixA | 3648772 | 3649290 | 1 | 519 |
| TM.orf3319 | | antibiotic biosynthesis monooxygenase | 3649628 | 3649284 | −2 | 345 |
| TM.orf3320 | | Glycine hydroxymethyltransferase | 3650926 | 3649625 | −3 | 1302 |
| TM.orf3321 | argD | acetylornithine and succinylornithine | 3652146 | 3650962 | −1 | 1185 |
| TM.orf3322 | benE | benzoate transporter | 3653378 | 3652143 | −2 | 1236 |
| TM.orf3323 | mocR | GntR family transcriptional regulator | 3653578 | 3655107 | 1 | 1530 |
| TM.orf3324 | Gde1 | glycerophosphodiester phosphodiesterase | 3656230 | 3655403 | −3 | 828 |
| TM.orf3325 | yfiQ | CoA-binding domain protein | 3658988 | 3656235 | −2 | 2754 |
| TM.orf3326 | | HAD-superfamily subfamily IIA hydrolase, hypothetical 3: HAD-superfamily hydrolase, subfamily IIA | 3659981 | 3659109 | −2 | 873 |
| TM.orf3327 | | diguanylate phosphodiesterase | 3661334 | 3660045 | −2 | 1290 |
| TM.orf3328 | pyrD | Dihydroorotate dehydrogenase | 3662385 | 3661303 | −1 | 1083 |
| TM.orf3329 | | conserved hypothetical protein | 3662783 | 3662382 | −2 | 402 |
| TM.orf3330 | argE | acetylornithine deacetylase (ArgE) | 3664125 | 3662839 | −1 | 1287 |
| TM.orf3331 | trkH | trk system potassium uptake protein TrkH | 3665726 | 3664275 | −2 | 1452 |
| TM.orf3332 | folE | GTP cyclohydrolase I | 3666626 | 3665961 | −2 | 666 |
| TM.orf3333 | apaG | ApaG | 3667368 | 3666961 | −1 | 408 |
| TM.orf3334 | metZ | O-succinylhomoserine sulfhydrylase | 3668810 | 3667530 | −2 | 1281 |
| TM.orf3335 | ynjD | ABC transporter related protein | 3669666 | 3669016 | −1 | 651 |
| TM.orf3336 | ynjC | inner membrane ABC transporter permease protein YnjC | 3671393 | 3669663 | −2 | 1731 |
| TM.orf3337 | ynjB | ABC transporter, periplasmic binding protein | 3672705 | 3671401 | −1 | 1305 |
| TM.orf3338 | | hypothetical protein | 3673748 | 3672804 | −2 | 945 |
| TM.orf3339 | traG | TRAG family protein | 3675901 | 3673769 | −3 | 2133 |
| TM.orf3340 | | hypothetical protein | 3676961 | 3676122 | −2 | 840 |
| TM.orf3341 | icd | isocitrate dehydrogenase | 3678798 | 3677308 | −1 | 1491 |
| TM.orf3342 | yhdG | putative transmembrane permease protein | 3679162 | 3680625 | 1 | 1464 |
| TM.orf3343 | maoI | tyramine oxidase | 3680702 | 3682624 | 3 | 1923 |
| TM.orf3344 | | hypothetical protein | 3682673 | 3683380 | 3 | 708 |
| TM.orf3345 | virS | AraC family transcriptional regulator | 3683558 | 3684568 | 3 | 1011 |
| TM.orf3346 | xthA | exonuclease III | 3684652 | 3685458 | 1 | 807 |
| TM.orf3347 | gsiB | extracellular solute-binding protein, family 5 | 3686923 | 3685520 | −3 | 1404 |
| TM.orf3348 | hslU | ATP-dependent protease ATP-binding subunit HslU | 3688537 | 3687224 | −3 | 1314 |
| TM.orf3349 | hslV | ATP-dependent protease peptidase subunit | 3689097 | 3688537 | −1 | 561 |
| TM.orf3350 | | conserved hypothetical protein | 3690866 | 3689211 | −2 | 1656 |
| TM.orf3351 | ycaC | isochorismatase hydrolase | 3691676 | 3690963 | −2 | 714 |
| TM.orf3352 | cpo | putative haloperoxidase protein | 3692564 | 3691734 | −2 | 831 |
| TM.orf3353 | HPA3 | GCN5-related N-acetyltransferase | 3693508 | 3693056 | −3 | 453 |
| TM.orf3354 | yijE | inner membrane transporter yiJE | 3694436 | 3693513 | −2 | 924 |
| TM.orf3355 | | acetyltransferase protein | 3695155 | 3694433 | −3 | 723 |
| TM.orf3356 | mocR | aminotransferase protein | 3695271 | 3696674 | 2 | 1404 |
| TM.orf3357 | dgdR | LysR family transcriptional regulator | 3697594 | 3696671 | −3 | 924 |
| TM.orf3358 | hisB | imidazoleglycerol-phosphate dehydratase | 3697747 | 3698352 | 1 | 606 |
| TM.orf3359 | | hypothetical protein | 3698393 | 3698851 | 3 | 459 |
| TM.orf3360 | hisH | imidazole glycerol phosphate synthase subunit hisH | 3698993 | 3699637 | 3 | 645 |
| TM.orf3361 | hisA | phosphoribosylformimino-5-aminoimidazole carboxamide ribotide | 3699708 | 3700439 | 2 | 732 |
| TM.orf3362 | hisF | imidazole glycerol phosphate synthase subunit HisF | 3700494 | 3701261 | 2 | 768 |
| TM.orf3363 | hisI | phosphoribosyl-AMP cyclohydrolase/phosphoribosyl-ATP pyrophosphohydrolase | 3701377 | 3701835 | 1 | 459 |
| TM.orf3364 | hisE | phosphoribosyl-ATP pyrophosphohydrolase | 3701816 | 3702190 | 3 | 375 |
| TM.orf3365 | | conserved hypothetical protein | 3702304 | 3702672 | 1 | 369 |
| TM.orf3366 | | Membrane flavodoxin oxidoreductase | 3702745 | 3704115 | 1 | 1371 |
| TM.orf3367 | dgoK | 2-dehydro-3-deoxygalactonokinase | 3704189 | 3705103 | 3 | 915 |
| TM.orf3368 | dgoA | 2-dehydro-3-deoxy-6-phosphogalactonate aldolase | 3705161 | 3705793 | 3 | 633 |
| TM.orf3369 | | conserved hypothetical protein | 3706414 | 3705794 | −3 | 621 |

-continued

| Locus | Gene | Product | Start | End | Strand | Length |
|---|---|---|---|---|---|---|
| TM.orf3370 | | conserved hypothetical protein | 3707291 | 3706407 | −2 | 885 |
| TM.orf3371 | mauG | methylamine utilization protein | 3708680 | 3707562 | −2 | 1119 |
| TM.orf3372 | | conserved hypothetical protein | 3709534 | 3708677 | −3 | 858 |
| TM.orf3373 | hemR | iron complex outermembrane recepter protein | 3711626 | 3709548 | −2 | 2079 |
| TM.orf3374 | | conserved hypothetical protein | 3712214 | 3711762 | −2 | 453 |
| TM.orf3375 | | conserved hypothetical protein | 3712816 | 3712292 | −3 | 525 |
| TM.orf3376 | | hypothetical protein | 3713156 | 3712809 | −2 | 348 |
| TM.orf3377 | | transcriptional regulator, AraC family | 3714267 | 3713281 | −1 | 987 |
| TM.orf3378 | nepI | major facilitator superfamily MFS_1 | 3714406 | 3715620 | 1 | 1215 |
| TM.orf3379 | | Sugar kinases, ribokinase family | 3716470 | 3715598 | −3 | 873 |
| TM.orf3380 | | HTH-type transcriptional regulator | 3716902 | 3716489 | −3 | 414 |
| TM.orf3381 | | Smr protein/MutS2 | 3717771 | 3716899 | −1 | 873 |
| TM.orf3382 | | conserved hypothetical protein | 3718475 | 3717780 | −2 | 696 |
| TM.orf3383 | lutB | Iron-sulfur cluster binding protein | 3719953 | 3718472 | −3 | 1482 |
| TM.orf3384 | | putative Fe—S oxidoreductase | 3720788 | 3719970 | −2 | 819 |
| TM.orf3385 | mltA | membrane-bound lytic murein transglycosylase A | 3722192 | 3720909 | −2 | 1284 |
| TM.orf3386 | | cytochrome P450 | 3723432 | 3722260 | −1 | 1173 |
| TM.orf3387 | | prenyltransferase and squalene oxidase repeat domain protein | 3725420 | 3723429 | −2 | 1992 |
| TM.orf3388 | | HPr(Ser) kinase/phosphatase | 3726331 | 3725417 | −3 | 915 |
| TM.orf3389 | asnO | Asparagine synthase (glutamine-hydrolyzing) | 3728229 | 3726328 | −1 | 1902 |
| TM.orf3390 | | conserved hypothetical protein | 3728504 | 3728229 | −2 | 276 |
| TM.orf3391 | | hypothetical protein | 3728685 | 3728542 | −1 | 144 |
| TM.orf3392 | bioI | cytochrome P450 enzyme | 3729760 | 3729026 | −3 | 735 |
| TM.orf3393 | | hypothetical protein | 3730089 | 3729778 | −1 | 312 |
| TM.orf3394 | | conserved hypothetical protein | 3730769 | 3730086 | −2 | 684 |
| TM.orf3395 | ytzA | FxsA | 3730977 | 3731501 | 2 | 525 |
| TM.orf3396 | secB | preprotein translocase subunit SecB | 3731642 | 3732124 | 3 | 483 |
| TM.orf3397 | yhjC | LysR family transcriptional regulator | 3733121 | 3732210 | −2 | 912 |
| TM.orf3398 | padA | NmrA family protein | 3733216 | 3734100 | 1 | 885 |
| TM.orf3399 | | class D beta-lactamase | 3734157 | 3735041 | 2 | 885 |
| TM.orf3400 | dnaQ | DNA polymerase III, epsilon subunit and related 3'-5' exonuclease | 3735732 | 3735046 | −1 | 687 |
| TM.orf3401 | coaE | Dephospho-CoA kinase | 3736443 | 3735775 | −1 | 669 |
| TM.orf3402 | aroE | shikimate 5-dehydrogenase | 3737348 | 3736437 | −2 | 912 |
| TM.orf3403 | | Nucleotide-binding protein implicated in inhibition of septum formation | 3737986 | 3737348 | −3 | 639 |
| TM.orf3404 | | phosphotransferase | 3738944 | 3737991 | −2 | 954 |
| TM.orf3405 | hemE | uroporphyrinogen decarboxylase | 3739697 | 3740749 | 3 | 1053 |
| TM.orf3406 | hemH | Protoheme ferro-lyase | 3740758 | 3741849 | 1 | 1092 |
| TM.orf3407 | | membrane protein | 3741890 | 3742336 | 3 | 447 |
| TM.orf3408 | rho | transcription termination factor Rho | 3743021 | 3744280 | 3 | 1260 |
| TM.orf3409 | qor | NADPH: quinone reductase and related Zn-dependent oxidoreductase | 3745374 | 3744400 | −1 | 975 |
| TM.orf3410 | | carboxymethylenebutenolidase | 3746263 | 3745568 | −3 | 696 |
| TM.orf3411 | ogt | methylated-DNA- | 3746941 | 3746366 | −3 | 576 |
| TM.orf3412 | yyaL | conserved hypothetical protein | 3749004 | 3746938 | −1 | 2067 |
| TM.orf3413 | | conserved hypothetical protein | 3749135 | 3749389 | 3 | 255 |
| TM.orf3414 | fdx4 | ferredoxin, 2Fe—2S | 3749397 | 3749807 | 2 | 411 |
| TM.orf3415 | mnmE | tRNA modification GTPase TrmE | 3749964 | 3751349 | 2 | 1386 |
| TM.orf3416 | mnmG | tRNA uridine 5-carboxymethylaminomethyl modification enzyme GidA | 3751553 | 3753502 | 3 | 1950 |
| TM.orf3417 | rsmG | S-adenosylmethionine-dependent methyltransferase involved in cell division | 3753508 | 3754236 | 1 | 729 |
| TM.orf3418 | parA | chromosome segregation ATPase | 3754208 | 3755032 | 3 | 825 |
| TM.orf3419 | parB | chromosome partitioning protein parB | 3755029 | 3755961 | 1 | 933 |
| TM.orf3420 | | DNA polymerase III, delta subunit | 3757059 | 3756025 | −1 | 1035 |
| TM.orf3421 | | LPS-assembly lipoprotein | 3757593 | 3757075 | −1 | 519 |
| TM.orf3422 | leuS | leucyl-tRNA synthetase | 3760225 | 3757640 | −3 | 2586 |
| TM.orf3423 | | conserved hypothetical protein | 3760903 | 3760355 | −3 | 549 |
| TM.orf3424 | | Outer membrane protein (porin) | 3761439 | 3762518 | 2 | 1080 |
| TM.orf3425 | | Outer membrane protein (porin) | 3762847 | 3763941 | 1 | 1095 |
| TM.orf3426 | | Outer membrane protein (porin) | 3764382 | 3765479 | 2 | 1098 |
| TM.orf3427 | | sulfotransferase | 3765670 | 3766569 | 1 | 900 |
| TM.orf3428 | | conserved hypothetical protein | 3766566 | 3767432 | 2 | 867 |
| TM.orf3429 | | putative enzyme with PLP-binding domain alanine racemase | 3768118 | 3768804 | 1 | 687 |
| TM.orf3430 | | conserved hypothetical protein | 3769318 | 3768809 | −3 | 510 |
| TM.orf3431 | | conserved hypothetical protein | 3770663 | 3769416 | −2 | 1248 |
| TM.orf3432 | ribA | GTP cyclohydrolase II | 3772029 | 3770914 | −1 | 1116 |
| TM.orf3433 | | YceI family protein | 3772739 | 3772092 | −2 | 648 |
| TM.orf3434 | | CDP-alcohol phosphatidyltransferase | 3773527 | 3772739 | −3 | 789 |
| TM.orf3435 | | deaminase-reductase domain-containing protein | 3773762 | 3774832 | 3 | 1071 |
| TM.orf3436 | kanE | FAD dependent oxidoreductase | 3774829 | 3775785 | 1 | 957 |
| TM.orf3437 | | conserved hypothetical protein | 3775834 | 3776253 | 1 | 420 |

-continued

| Locus | Gene | Product | Start | End | Strand | Length |
|---|---|---|---|---|---|---|
| TM.orf3438 | | putative glycosyl transferase | 3776268 | 3777335 | 2 | 1068 |
| TM.orf3439 | | Methyltransferase type 12 | 3777335 | 3778162 | 3 | 828 |
| TM.orf3440 | sphR | two component transcriptional regulator | 3778236 | 3778937 | 2 | 702 |
| TM.orf3441 | nahR | transcriptional regulator, LysR family | 3779852 | 3778944 | −2 | 909 |
| TM.orf3442 | | ThiJ/PfpI domain protein | 3779976 | 3780632 | 2 | 657 |
| TM.orf3443 | | hypothetical protein | 3779977 | 3779864 | −3 | 114 |
| TM.orf3444 | fadB | enoyl-CoA hydratase/isomerase | 3781441 | 3780680 | −3 | 762 |
| TM.orf3445 | | transcriptional regulators | 3782264 | 3781557 | −2 | 708 |
| TM.orf3446 | yifB | Predicted ATPase with chaperone activity | 3783896 | 3782283 | −2 | 1614 |
| TM.orf3447 | | conserved hypothetical protein | 3785042 | 3784608 | −2 | 435 |
| TM.orf3448 | nth | endonuclease III | 3785229 | 3785960 | 2 | 732 |
| TM.orf3449 | | conserved hypothetical protein | 3786067 | 3786216 | 1 | 150 |
| TM.orf3450 | ppa | inorganic pyrophosphatase | 3787457 | 3786930 | −2 | 528 |
| TM.orf3451 | ampG | major facilitator superfamily permease | 3788915 | 3787551 | −2 | 1365 |
| TM.orf3452 | typA | GTP-binding protein TypA/BipA | 3790767 | 3788941 | −1 | 1827 |
| TM.orf3453 | | Sugar kinase | 3791831 | 3790839 | −3 | 993 |
| TM.orf3454 | | conserved hypothetical protein | 3792175 | 3792870 | 2 | 696 |
| TM.orf3455 | | hypothetical protein | 3792902 | 3793315 | 1 | 414 |
| TM.orf3456 | | tetratricopeptide TPR_4 | 3794296 | 3793322 | −1 | 975 |
| TM.orf3457 | | type I phosphodiesterase/nucleotide pyrophosphatase | 3795910 | 3794378 | −1 | 1533 |
| TM.orf3458 | yihL | putative transcriptional regulator | 3796104 | 3796805 | 3 | 702 |
| TM.orf3459 | flhA | alcohol dehydrogenase class III | 3796872 | 3797984 | 3 | 1113 |
| TM.orf3460 | Esd | intracellular septation protein A | 3797989 | 3798858 | 2 | 870 |
| TM.orf3461 | | hypothetical protein | 3799428 | 3798883 | −2 | 546 |
| TM.orf3462 | arsC | putative arsenate reductase | 3799966 | 3799613 | −1 | 354 |
| TM.orf3463 | gshB | glutathione synthetase | 3800927 | 3799986 | −3 | 942 |
| TM.orf3464 | | tetratricopeptide repeat family protein | 3801935 | 3801054 | −3 | 882 |
| TM.orf3465 | | Predicted periplasmic or secreted lipoprotein | 3802603 | 3801932 | −1 | 672 |
| TM.orf3466 | | conserved hypothetical protein | 3803051 | 3802647 | −3 | 405 |
| TM.orf3467 | | uroporphyrin-III C/tetrapyrrole (corrin/porphyrin) methyltransferase | 3804199 | 3803048 | −1 | 1152 |
| TM.orf3468 | | Extracellular ligand-binding receptor | 3804283 | 3805578 | 2 | 1296 |
| TM.orf3469 | | coproporphyrinogen III oxidase | 3806806 | 3805607 | −1 | 1200 |
| TM.orf3470 | | Xanthosine triphosphate pyrophosphatase | 3807426 | 3806815 | −2 | 612 |
| TM.orf3471 | rph | RNase PH | 3808418 | 3807441 | −3 | 978 |
| TM.orf3472 | hrcA | Transcriptional regulator of heat shock gene | 3808725 | 3809855 | 3 | 1131 |
| TM.orf3473 | grpE | GrpE protein | 3810026 | 3810646 | 1 | 621 |
| TM.orf3474 | dnaK | molecular chaperone DnaK | 3810999 | 3812927 | 3 | 1929 |
| TM.orf3475 | dnaJ | chaperone protein DnaJ | 3813080 | 3814261 | 1 | 1182 |
| TM.orf3476 | dapB | dihydrodipicolinate reductase | 3814452 | 3815207 | 3 | 756 |
| TM.orf3477 | yedA | inner membrane transporter yedA | 3816161 | 3815238 | −3 | 924 |
| TM.orf3478 | phbC | Poly-beta-hydroxybutyrate polymerase domain protein | 3818234 | 3816252 | −3 | 1983 |
| TM.orf3479 | | hypothetical protein | 3818477 | 3818340 | −3 | 138 |
| TM.orf3480 | yhiI | HlyD family secretion protein | 3818514 | 3819494 | 3 | 981 |
| TM.orf3481 | yhiH | ABC transporter, ATP binding/permease protein | 3819491 | 3822256 | 1 | 2766 |
| TM.orf3482 | yhhJ | Inner membrane transport permease yhhJ | 3822261 | 3823385 | 3 | 1125 |
| TM.orf3483 | hipA | HipA domain protein | 3824820 | 3823498 | −2 | 1323 |
| TM.orf3484 | | hypothetical protein | 3824978 | 3824820 | −3 | 159 |
| TM.orf3485 | icc | putative ICC protein | 3826129 | 3825308 | −1 | 822 |
| TM.orf3486 | potA | putative ABC transporter | 3827137 | 3826136 | −1 | 1002 |
| TM.orf3487 | modB | binding-protein-dependent transport systems inner membrane component | 3827937 | 3827134 | −2 | 804 |
| TM.orf3488 | cysW | putative permease protein | 3828776 | 3827943 | −3 | 834 |
| TM.orf3489 | | family 1 extracellular solute-binding protein | 3829893 | 3828871 | −2 | 1023 |
| TM.orf3490 | purR | regulatory protein | 3831030 | 3829978 | −2 | 1053 |
| TM.orf3491 | mviN | virulence factor | 3832713 | 3831157 | −2 | 1557 |
| TM.orf3492 | glnD | [protein-PII] uridylyltransferase | 3835601 | 3832800 | −3 | 2802 |
| TM.orf3493 | metQ | YaeC family lipoprotein | 3836668 | 3835802 | −1 | 867 |
| TM.orf3494 | metQ | D-methionine ABC superfamily ATP binding cassette transporter, binding protein | 3837713 | 3836868 | −3 | 846 |
| TM.orf3495 | mcp3 | methyl-accepting chemotaxis sensory transducer | 3839287 | 3837932 | −1 | 1356 |
| TM.orf3496 | | esterase/lipase/thioesterase | 3840277 | 3839309 | −1 | 969 |
| TM.orf3497 | | virulence protein | 3841146 | 3840379 | −2 | 768 |
| TM.orf3498 | mprF | putative membrane protein | 3843692 | 3841143 | −3 | 2550 |
| TM.orf3499 | | branched chain amino acid ABC transporter amino acid-binding protein | 3845162 | 3843942 | −3 | 1221 |
| TM.orf3500 | alkK | medium-chain-fatty-acid-CoA ligase | 3845541 | 3847160 | 3 | 1620 |
| TM.orf3501 | mutS | DNA mismatch repair protein | 3849952 | 3847139 | −1 | 2814 |
| TM.orf3502 | tme | malic enzyme | 3850401 | 3852698 | 3 | 2298 |
| TM.orf3503 | phoR | two-component sensor histidine kinase | 3852914 | 3854356 | 1 | 1443 |
| TM.orf3504 | lcfB | acyl-CoA synthase | 3854482 | 3856020 | 2 | 1539 |
| TM.orf3505 | sphX | phosphate ABC transporter, periplasmic binding protein | 3856419 | 3857441 | 3 | 1023 |

-continued

| Locus | Gene | Product | Start | End | Strand | Length |
|---|---|---|---|---|---|---|
| TM.orf3506 | yqgH | phosphate ABC transporter, permease protein PstC | 3857697 | 3859079 | 3 | 1383 |
| TM.orf3507 | yqgI | phosphate ABC transporter, inner membrane subunit PstA | 3859099 | 3860424 | 2 | 1326 |
| TM.orf3508 | | Phosphate import ATP-binding protein | 3860520 | 3861290 | 3 | 771 |
| TM.orf3509 | phoU | Phosphate transport system protein PhoU | 3861318 | 3862043 | 3 | 726 |
| TM.orf3510 | phoB | Response regulator | 3862169 | 3862867 | 1 | 699 |
| TM.orf3511 | rhtB | lysine exporter protein LysE/YggA | 3862963 | 3863589 | 2 | 627 |
| TM.orf3512 | trpS | Tryptophanyl-tRNA synthetase | 3863762 | 3864754 | 1 | 993 |
| TM.orf3513 | | putative permease | 3864903 | 3865814 | 3 | 912 |
| TM.orf3514 | | conserved hypothetical protein | 3865814 | 3866596 | 1 | 783 |
| TM.orf3515 | | universal stress family protein | 3866612 | 3867124 | 1 | 513 |
| TM.orf3516 | cya1 | adenylate cyclase | 3868421 | 3867117 | −3 | 1305 |
| TM.orf3517 | soxR | Redox-sensitive transcriptional activator soxR | 3869016 | 3868549 | −2 | 468 |
| TM.orf3518 | | conserved hypothetical protein | 3869119 | 3869538 | 2 | 420 |
| TM.orf3519 | | RND efflux membrane fusion protein precursor | 3869543 | 3870643 | 1 | 1101 |
| TM.orf3520 | | RND efflux transporter | 3870640 | 3873729 | 2 | 3090 |
| TM.orf3521 | | thioredoxin | 3873814 | 3874359 | 2 | 546 |
| TM.orf3522 | | Diacylglycerol kinase, catalytic region | 3876693 | 3875188 | −2 | 1506 |
| TM.orf3523 | fabG | oxidoreductase, short chain dehydrogenase/reductase family | 3877381 | 3876680 | −1 | 702 |
| TM.orf3524 | ddpX | D-alanyl-D-alanine dipeptidase | 3877980 | 3877423 | −2 | 558 |
| TM.orf3525 | yeaZ | peptidase M22, glycoprotease | 3878054 | 3878785 | 1 | 732 |
| TM.orf3526 | | ribosomal-protein-alanine acetyltransferase | 3878782 | 3879258 | 2 | 477 |
| TM.orf3527 | | transcriptional regulatory protein | 3879811 | 3880233 | 2 | 423 |
| TM.orf3528 | fur | ferric uptake regulator family protein | 3880551 | 3880997 | 3 | 447 |
| TM.orf3529 | | hemolysin | 3881199 | 3881978 | 3 | 780 |
| TM.orf3530 | plsC | 1-acyl-sn-glycerol-3-phosphate acyltransferase | 3881975 | 3882907 | 1 | 933 |
| TM.orf3531 | miaB | RNA modification protein | 3883012 | 3884415 | 2 | 1404 |
| TM.orf3532 | ybeZ | phosphate starvation-inducible protein PhoH and related proteins | 3884457 | 3885599 | 3 | 1143 |
| TM.orf3533 | | Predicted metal-dependent hydrolase | 3885596 | 3886255 | 1 | 660 |
| TM.orf3534 | | CBS domain-containing protein | 3886567 | 3887403 | 2 | 837 |
| TM.orf3535 | lnt | Apolipoprotein N-acyltransferase | 3887442 | 3889046 | 3 | 1605 |
| TM.orf3536 | | transcriptional regulator | 3889352 | 3889789 | 1 | 438 |
| TM.orf3537 | metK | S-adenosylmethionine synthetase | 3890091 | 3891260 | 3 | 1170 |
| TM.orf3538 | trmB | tRNA (guanine-N7-)-methyltransferase | 3891360 | 3892103 | 3 | 744 |
| TM.orf3539 | rimP | Ribosome maturation factor rimP | 3892428 | 3892922 | 3 | 495 |
| TM.orf3540 | nusA | transcription elongation factor NusA | 3892931 | 3894490 | 1 | 1560 |
| TM.orf3541 | | conserved hypothetical protein | 3894501 | 3895187 | 3 | 687 |
| TM.orf3542 | infB | translation initiation factor IF-2 | 3895198 | 3898329 | 2 | 3132 |
| TM.orf3543 | rbfA | ribosome-binding factor A | 3898431 | 3898880 | 3 | 450 |
| TM.orf3544 | truB | Pseudouridine synthase | 3898885 | 3899802 | 2 | 918 |
| TM.orf3545 | rpsO | ribosomal protein S15 | 3899820 | 3900089 | 3 | 270 |
| TM.orf3546 | pnp | polyribonucleotide nucleotidyltransferase | 3900584 | 3902830 | 1 | 2247 |
| TM.orf3547 | | Dioxygenases related to 2-nitropropane dioxygenase | 3903207 | 3904556 | 3 | 1350 |
| TM.orf3548 | fur | Fe2+/Zn2+ uptake regulation proteins | 3904706 | 3905116 | 1 | 411 |
| TM.orf3549 | rbr | Rubrerythrin | 3905178 | 3905681 | 3 | 504 |
| TM.orf3550 | | conserved hypothetical protein | 3906332 | 3905733 | −3 | 600 |
| TM.orf3551 | gyaR | lactate dehydrogenase and related dehydrogenase | 3906637 | 3907617 | 2 | 981 |
| TM.orf3552 | | conserved hypothetical protein | 3907757 | 3908482 | 1 | 726 |
| TM.orf3553 | | conserved hypothetical protein | 3908952 | 3908497 | −2 | 456 |
| TM.orf3554 | | molybdopterin biosynthesis protein | 3909780 | 3908965 | −2 | 816 |
| TM.orf3555 | cysK | cysteine synthase A | 3910819 | 3909845 | −1 | 975 |
| TM.orf3556 | iscR | transcriptional regulator | 3911327 | 3910872 | −3 | 456 |
| TM.orf3557 | dut | deoxyuridine 5'triphosphate nucleotidohydrolase protein | 3911860 | 3911402 | −1 | 459 |
| TM.orf3558 | | phosphopantothenoylcysteine decarboxylase/phosphopantothenate--cysteine ligase | 3913134 | 3911860 | −2 | 1275 |
| TM.orf3559 | ubiB | protein kinase | 3914820 | 3913306 | −2 | 1515 |
| TM.orf3560 | ubiE | 2-octaprenyl-6-methoxy-1,4-benzoquinone methylase/demethylmenaquinone methyltransferase | 3915654 | 3914848 | −2 | 807 |
| TM.orf3561 | mutM | formamidopyrimidine-DNA glycosylase | 3915740 | 3916603 | 1 | 864 |
| TM.orf3562 | | conserved hypothetical protein | 3916600 | 3917028 | 2 | 429 |
| TM.orf3563 | | enoyl-CoA hydratase/isomerase family protein | 3917177 | 3917950 | 1 | 774 |
| TM.orf3564 | rpsT | Ribosomal protein S20p | 3918135 | 3918404 | 3 | 270 |
| TM.orf3565 | | rhodanese domain-containing protein | 3918958 | 3919428 | 2 | 471 |

Example 4

Conjugation of *Tistrella mobilis* Plasmid

Conjugation refers to the transfer of a plasmid from one bacterial cell to another. During conjugation, the bacterial cell that harbors the plasmid is regarded as the donor cell and the other cell lacking the plasmid is regarded as recipient cells. The donor cell must have a set of genes that are capable of doing two functions: 1) production of the sex pilus in which two bacterial cells are brought together and through which the plasmid DNA is transferred to the recipient cell, and 2) the DNA-processing component that processes the plasmid at a particular site so that a single strand of the plasmid is unwound and transferred to the recipient cell. The sex pilus in most Gram-negative bacteria is encoded by a set of 11 genes with conserved sequences and functions. *Tistrella mobilis*, being Gram-negative, is found to harbor the same set of genes on its chromosomal DNA. The corresponding 11 homologous genes can be found from orf TM.2187-2197, which in certain embodiments indicates the capability of *T. mobilis* to produce the sex pilus required for the conjugation process. Furthermore, plasmid 3, which harbors the didemnin gene cluster, is found to encode several genes that in some embodiments are involved in the DNA processing of the plasmid. Among them, P3.orf0026, encodes a relaxase, a central component for DNA processing, which further implies that plasmid 3 may be transferred to another cell by conjugation. Other nearby sequences of the relaxase also encode some other genes that are involved in the conjugation. For example, P3.orf0056 encodes a lytic transglycosylase, and it is believed to degrade bacterial cell wall for DNA transfer during conjugation.

Therefore, in specific embodiments plasmid 3 in which the didemnin gene cluster resides may transfer to another bacterial species. Other species in the genus of *Tistrella* could be candidates in embodiments wherein they do not have the same plasmid. Species from closely related genera, such as members of *Azospirillum* and *Agrobacteria* (for example only), may be recipients, in certain embodiments.

REFERENCES

All patents and publications mentioned in the specification are indicative of the level of those skilled in the art to which the invention pertains. All patents and publications are herein incorporated by reference in their entirety to the same extent as if each individual publication was specifically and individually indicated to be incorporated by reference.

Patents

U.S. Pat. No. 5,294,603
U.S. Pat. No. 5,399,363
U.S. Pat. No. 5,466,468
U.S. Pat. No. 5,543,158
U.S. Pat. No. 5,580,579
U.S. Pat. No. 5,629,001
U.S. Pat. No. 5,641,515
U.S. Pat. No. 5,792,451
U.S. Pat. No. 6,613,308
U.S. Pat. No. 6,841,530

PUBLICATIONS

Chen Y H, Smanski M J, Shen B. 2010. Improvement of secondary metabolite production in *Streptomyces* by manipulating pathway regulation. Appl Microbiol biotechnol. 86(1): 19-25

Fischbach M A, Walsh C T (2006) Assembly-line enzymology for polyketide and nonribosomal peptide antibiotics: Logic, machinery, and mechanisms. Chem Rev 106:3468-3496.

Imker H J, Krahn D, Clerc J, Kaiser M, Walsh C T (2010) N-Acylation during Glidobactin Biosynthesis by the Tridomain Nonribosomal Peptide Synthetase Module GlbF. Chem Biol 17: 1077-1083

Jou G, González I, Albericio F, Lloyd-Williams P, Giralt E. 1997. Total Synthesis of Dehydrodidemnin B. Use of Uronium and Phosphonium Salt Coupling Reagents in Peptide Synthesis in Solution. J Org Chem. 62:354-366.

Lautru S, Oves-Costales D, Pernodet J L, Challis G L. (2007) MbtH-like protein-mediated cross-talk between non-ribosomal peptide antibiotic and siderophore biosynthetic pathways in *Streptomyces coelicolor* M145. Microbiology 153:1405-1412.

Le Tourneau C, Faivre S, Ciruelos E, Domínguez M J, López-Martín J A, Izquierdo M A, Jimeno J, Raymond E. 2010. Reports of clinical benefit of plitidepsin (Aplidine), a new marine-derived anticancer agent, in patients with advanced medullary thyroid carcinoma. Am J Clin Oncol. 33:132-6.

Marahiel M A, Stachelhaus T, Mootz H D. 1997. Modular peptide synthetases involved in nonribosomal peptide synthesis. Chemical reviews 97(7): 2651-2673

Mateos M V, Cibeira M T, Richardson P G, Prosper F, Oriol A, de la Rubia J, Lahuerta J J, García-Sanz R, Extremera S, Szyldergemajn S, Corrado C, Singer H, Mitsiades C S, Anderson K C, Bladé J, San Miguel J. 2010. Phase II clinical and pharmacokinetic study of plitidepsin 3-hour infusion every two weeks alone or with dexamethasone in relapsed and refractory multiple myeloma. Clin Cancer Res. 16:3260-3269.

Mayer, S. C., Ramanjulu, J., Vers, M. D., Pfizenmayer, A. J., and Joullie, M. M., Synthesis of new didemnin B analogs for investigations of structure/biological activity relationships, J. Org. Chem., 1994, 59, 5192-5205.

Ramaswamy A V, Sorrels C M, Gerwick W H. 2007. Cloning and biochemical characterization of the hectochlorin biosynthetic gene cluster from the marine cyanobacterium *Lyngbya majuscule*. J Nat. Prod. 70(12): 1977-1986

Rausch C, Weber T, Kohlbacher O, Wohlleben W, Huson D H (2005) Specificity prediction of adenylation domains in nonribosomal peptide synthetases (NRPS) using Transductive Support Vector Machines (TSVM). Nucleic Acids Res 33: 5799-5808.

Rawat D S, Joshi M C, Joshi P, Atheaya H. 2006. Marine peptides and related compounds in clinical trial. Anticancer Agents Med Chem. 6:33-40.

Rinehart K L Jr, Gloer J B, Hughes R G Jr, Renis H E, McGovren J P, Swynenberg E B, Stringfellow D A, Kuentzel S L, Li L H. 1981. Didemnins: antiviral and antitumor depsipeptides from a caribbean tunicate. Science 212:933-935.

Salomon C E, Magarvey N A, Sherman D H. 2004. Merging the potential of microbial genetics with biological and chemical diversity: an even brighter future for marine natural product drug discovery. Nat. Prod. Rep. 21: 105-121

Schwarzer, H. D. Mootz, U. Linne and M. A. Marahiel. 2002. Regeneration of misprimed nonribosomal peptide synthetases by type II thioesterases. Proc Natl Acad Sci USA. 99(22): 14083-14088

Shi, B.-H., et al., *Tistrella mobilis* gen. nov., sp. Nov., a novel polyhydroxyalkanoate-producing bacterium belonging to α-Proteobacteria, J. Gen. Appl. Microbiol., 48, 335-343 (2002).

Soto-Matos A, Szyldergemajn S, Extremera S, Miguel-Lillo B, Alfaro V, Coronado C, Lardelli P, Roy E, Corrado C S, Kahatt C. 2011. Plitidepsin has a safe cardiac profile: a comprehensive analysis. Mar Drugs 9:1007-1023.

Vera M D, Joullié M M. Natural products as probes of cell biology: 20 years of didemnin research. 2002 Med Res Rev. 22:102-45.

Zhang D C, Liu H C, Zhou Y G, Schinner F, Margesin R., *Tistrella bauzanensis* sp. nov., a novel bacterium isolated from soil, Int J Syst Evol Microbiol. 2010 Oct. 15.

Although the present invention and its advantages have been described in detail, it should be understood that various changes, substitutions and alterations can be made herein without departing from the spirit and scope of the invention as defined by the appended claims. Moreover, the scope of the present application is not intended to be limited to the particular embodiments of the process, machine, manufacture, composition of matter, means, methods and steps described in the specification. As one of ordinary skill in the art will readily appreciate from the disclosure of the present invention, processes, machines, manufacture, compositions of matter, means, methods, or steps, presently existing or later to be developed that perform substantially the same function or achieve substantially the same result as the corresponding embodiments described herein may be utilized according to the present invention. Accordingly, the appended claims are intended to include within their scope such processes, machines, manufacture, compositions of matter, means, methods, or steps.

SEQUENCE LISTING (66 sequences)

SEQ ID NO: 1 - protein, 10 aa, Artificial Sequence
  Synthetic peptide
DAWQFGLIDK

SEQ ID NO: 2 - protein, 10 aa, Artificial Sequence
  Synthetic peptide
DHPWIAETVK

SEQ ID NO: 3 - protein, 10 aa, Artificial Sequence
  Synthetic peptide
DVQFAAQVVK

SEQ ID NO: 4 - protein, 10 aa, Artificial Sequence
  Synthetic peptide
DAWFLGHVVK

SEQ ID NO: 5 - protein, 10 aa, Artificial Sequence
  Synthetic peptide
DFWNIGMVHK

SEQ ID NO: 6 - protein, 10 aa, Artificial Sequence
  Synthetic peptide
DAFFLGITFK

SEQ ID NO: 7 - protein, 10 aa, Artificial Sequence
  Synthetic peptide
DAWFLGNVVK

SEQ ID NO: 8 - protein, 10 aa, Artificial Sequence
  Synthetic peptide
DVQFAAQVVK

SEQ ID NO: 9 - protein, 10 aa, Artificial Sequence
  Synthetic peptide
DASTLAAVCK

SEQ ID NO: 10 - DNA, 786 bp, Tistrella mobilis
atgcagcccaccgcctcgcgctgggtccagcccggccaggatcgatggctcaccggtcccgccggccgaagcgccgcgccctggcggctgctctgcatcccccatgccggcggcggcgccagcgccttccgcccctgggaggcgttcaccggcccggatgtcgagcttctggtcgcccagctgccgggccgcgaaagccgttttcccgaaccggcgctcgaccgggtggcaccggtggtcgacgggctggccaccgccctcggccgtcttgcgcccaaaccgaccctgatcttcggccacagcatgggtgcgatgatcggctatgaactggccgcccggctggtgggtgaggcctcgccccatgcaccgcgcacgctgatcgtctcgggccgcaccgcccccggctcatccagcaccttgggcgatctgctcgggctggacgatgccggcttcgcagatgcacttgccgcccgctatgacggtatccccgccgccctgctcgccgatcgcgaattgatggccgtgttcctgccgaccctcagggccgatttccggatggtcgcggaatatcgcccggatcctgccgcctgcccgcgcctgccctgcccgatcctggcgctgggtggcgccgacgacattcatgccgcccccgaacggctgaccgcctggcaggatttcaccaccgccggcttcatgcgcgagatctttccgggcgggcatttctacctggcggccgatcctgcctgggtggttgcgcgcgtgctggccgcgcgcagcatggtctga

SEQ ID NO: 11 - DNA, 1452 bp, Tistrella mobilis
atgacggtcgccgatatggacatgaccgacgagccggagcgtcccgggctgttcggccggatcggcggctggctccgccgccatctctggtcgctgacgctctccgtgctgatctttggtgcgctcgtcatcctgttctggccggcgatgttcatcaccgtgccggccggtcatgccggggtggtctggcaccgtttcagcgggaccgatgtcgagaaccccacgggggaagggctgcaggtgatctggccctgggaccggctggagatctatgacgtccgcttccagaccgtgacccagacctatgatgcgatcaccgcagacggtctgacggtcgcgaccaccatttcgttccgctaccgggtgaaccaggaatatgtcggcatcctgcacaagaatgtcggcccggaatatctgcacaagatcattatcccggaagtcggatcggtggcccgggcgcgcatctcgcagtacacggccgaggatttttattcgaacctgcgcaccatcgtgcagaacgagatctatgaaggcgtgaagtcgaatttcctgcgcggcaactattacagccaacccggaatcgatctgatcgaactgcaggacgtgctgatcaaggcgatccatctgcccgagcgggttgcccaggcgatcgagcgcaaggtcgagcagtatcagcgtcagctggaatatgattaccgcctggcgaccgagcagaaggaagccgaacgcaagcggatcgaaggcgaaggtatccgcatgctgttcgatcgggtcggcgcctcggaaattccggattatctcacctggctcggcatcaatgcctcggtgcagctcgcccagtcgaccaatgccaaggtggtggtgatcggcaacaaggattcgggtggcatgccgctgatcctgggcggcatcgacagcaatggcgcccgcgcggcgacgacgtccggcgccacgggcgcgccccaggctgccgatggcggtgccggccagccggtcatcgtgggcgacgtggatacgggcacggctgagatccggccggtcggttcggaaccgctcaatcagacaggtgcggctcccgcgccggctggcggcccgaaatcagggccgcgcatggatagcggcgagagcgaggcggtcgtcgaaggcgtgcccgccggcaccgcctcggtcggccgggccatggtgccggaaaccaccacgcccgagcatcagacggcgccggcgaccccggtgcagcctgcctcgccccagccggcgcccaccgccgtgcgccagggcttcctgccgggtgagccggtgaccctggaacagctgagccgctggctgggcatcggtggcggcacgggtgccgtgaccacgccctatgggccggcggggttcgggccctatggcgtcgttcctgaaaccgccccgcccgtgggcggcgccagggtcgcgggcgcggggggctga

SEQ ID NO: 12 - DNA, 1683 bp, Tistrella mobilis
atgcccttgatcgagcttattcgccgcgacctgacggcgaagccggcgaccctcctgttcatcgccgcgctcgccggtgtcagcaatgcgctggtgatggcgatcatcaacaattccgccgggctctacgaagacgcgctcgacctgcggaccgtggcgctgtttgtgatcgtggtggcgatctatgtgctgagccagcgccggatgatgcagatcaccgccaccgaggtggaggagatcatccatcgtcagcgcagcagcctgatcgatgcggtttcgcgatccgatcttctgccgctggaacaggtggggcggggcaacatcctcgccagcgtcatccgcgatacccagacgatatcccaggccgccaacctgctggtgatcgccgcacagtcggtgattctggtcgggctggcgatgatctacatcttcatcaccgaccgcaccgccttctggctgagcaccggcttcatcgcgattgcggtgtttctggtcatccggcggctgatcgacctgcgcaaccggtatccggctgcgatgatgaaggaaaaccaggttttcgaaagcatgcgcgacgtgctcgacggcttcaaggaggtgaagctgtcgtcggcacgccgcgatgccctgctgcgcgacatggcgcgggtgtcgatcgaggcccgtgatgccaaggccgatatgcaggtgaagtcgggcaatgaattcgtcttcggccagacgatgatcttcctgctgctgggcctggtggtgttcgtggtgccgagcttcggcaataccgagcccgaggcggtggtgcgcacggcgacggcgatcctgttcatcgtgggcccgctcagcatggtgattcaggccgtgcctatgatggcgatggccaatgccgccgcggacaatctgatgcgcatggaccgggtgctgcgcgagatcgtcgccgcatccgaggtggccgccaccccgccccagaccctgacctcgttcgaggagatccggctggacggggtcgcctttgcctatgccccggtcggcggcgtgtccttcggggtggggccggtggacctgaccatccggtcgggcgagctgatcttcgtgaccggcggcaacggctcgggcaagtcgaccctgatccgcctgctgctcggcctctatcatgccgacaggggcatgatccggctggatggaaaaccggttacccgcggctctttcgaaacctatcgttcgctgttttcggcgatctacgccgactaccatctcttccgcaggctctatggcatcgaaccgccggatgtggccgagtttgacgcgctggtgaagctgatggagatgggcggcaaggtagcgcttcagggtgacctgttcgatacgatcgacctgtcgagcggccagcgcaagcgtctggccctgatggtgtcgatgatcgaggaccggccggtgctggtgctcgacgaatgggcggcggatcaggacccgcagttccggcgcaagttctaccgggaactgctgccgatgctgaaagcgcgcggcaagacggtgatcgccatcacccatgacgaccgctatttcgacgttgccgaccgtcgggtggcgatggaggaggggcgcgtggtcaggatcgtcgacaaccgagatgcccgtattgaagacgacgctcgtattgaagacgaagatggggaggacccggcatga

SEQ ID NO: 13 - DNA, 213 bp, Tistrella mobilis
atgccgccgaccatgggcctgctgctccccaccatctatgtcgtgatgtcggtgatggtcgggctgtgcggcgccggccgcaaaccggggttcgtcgtctcgttcctgctgtcgctgctggtcacccccttcgtgatgctgctgctgctctatgcgacacgcccgcgcgagccggcacgccccgtggtggcgcgcaagacgaaacgccattga

SEQ ID NO: 14 - DNA, 573 bp, Tistrella mobilis
atgtccaccgccgaagtgacggctgctcccgccgaagagtacacccccgagctgcgcgccgacgatgcgcgcgcgctggtcaagcgttgcgcgctctggggcgcgggcgccggcctgctgcctttccccctgctcgacgtcgctctggtcacgggcgtgcaggtgaagatgatctacgagctgtcgaagctctatgacgtgccgttcagcgagaaccgcgccaaggcgatcatcggctcgctggccaacaccgtcgtccccggcaccgccgcggccggcctggtcggtggcgtcgccagcctggtgaagtcggtgccggtggtcggtaccgtcatcggcctcgcggtttcgcccaccgtctcctatgccgtgacctatgccatcggccgggtgttcatccagcacttcgagaccggcggcacgctgctgaacttcaacccggatcagctgcgcgagcacttcaaggccgaattcgaggccgccaaggccgatgcgccgtccaccgtcgaggctgccaaggccgctgccgacaccaagaccgaggccaagcccgccgccaccaaggcgtcgtga

SEQ ID NO: 15 - DNA, 2964 bp, Tistrella mobilis
atgtcaccatcaccaccgtctagtccgggggcggcggccgagcaggtcgagcgccagctgaccacgccgatcgaacaggcggtttcgggcatttcgggcgtgcagcagatcacctcgcagagccgcgccggcatgtcgctggtccagatccagttccgcctggggctggacgggctgctgctcgccaacgaggtgcgcaacaaggtggcgccgctgaccgacacgctgccccaggcggcgcgggcgccggtggtggcgcagcaatcgctcgacgcccagccgatcatgttcctgacggtggcgagcgacagccatgatgcgctggagatcagcgataccgccaatcgcctgctgctgccgcggatcgcggcgctggacggcgtggcccaggcgacgctgctgggtgagcggcgttatgccatccgcatcgtgctcgacccgatccgcctggcctcttacggcatcaccatcggcgatgtccgggcggcgatcgtcgcccagaatgccgacgtgcccggcggcgaaatccgcacccgtaccgaccgcaccgatgtggtggtggaaggggcgctgtcgaccgcggccgaattcgaccggctggtggtgcgcgccgagccgggctatctggttcgcatctccgatctgggccgggcggaggtggggccggaaagcctggacaatgccatccgcttcaacggccgcgatgtggtggccgtcggcatcgtgccgcagagcaccgccaatccgctcgacatcgccaggctggtgaaggccgagctgccggccctgcaggccggcctgcccggcggtttccggctcgagatcgcctttgacagcacgatctatatcgacgcttcggtgcacgaggtgttcgagacgatcgcgatcgccgtcgccctggtgctgggcgtggtggttattttcctcggctcgctgcgttccagcgccatcgcgctggtgaccatcccgctgtcgctgctgggcacgctggggctgatggcggcgatggatttcagtatcaacaccctgaccctgatggcggtggtgctggcgatcggcctggtggtcgacgatgcgatcgtcgagatcgaaaacgtccagcgccatgtcgatgacgggctggatgccttcaccgcatccttcctgggcagccgcgagatcggcttcgcggtgatcgcgaccacgctgacgctggcggcggtcttcgcgcccatcggcctggtcggcggccagatcggcatgctgttccgggaattcgccttcactctggcgggggccgtgctgatctcgggcttcatcgcccgcacgctgtcgccgatgatgtgcgcgcggctgatcggcgcacgggccgaacacggctatgcccgccgggtggaacgggcgaccgaggcgctggcccgcgcctatgcccggttgctgggctggctgctgcaccggcgctggctggtgctgctgggggtgatcgccgcgctttatgtcggcttctcggcgaccagccggctgaacttcgccttcgcgccggtcgaggatcagggctatatcctgttcgatatcgaggcgcgcggtacctcgactctcgatcatcttcaggatcagatcgcccgggtggaggcggtgctgaaaaccgtgcccgaggcgaccggcgtcctcaccctgctcggcagccccaagccgtctgcggccaatgcctatctgctgctgaagccctggggggagcgcagccgcagcgccaccgaaatcggcgatgcgctgaagccgctgctggcggcgatcccgggcctgcggatcgatgttctgcaggtcagcccgctgggtggcggcggcagttcgcggccgatccagctgatgatcaccaccaccggcagctatgacgatctggcccggaccatggaccggctggtgacgaaggcgcgcgatctgccgtcgatcgcggacccggcctccagcctggagctggaccggccgcagctggaggtgacgctggaccgcgacggcgcgggcgagcagggggtgacggcaaccgcgctcggcgacacgctgcaggcggcgcttggtggcaacccggtttccaccttcaccaaccgcggcgaactctacaaggtgatcatcgacctgccgcccgaatggcggggccaggtggagacgatcaacacgctggaaatccgcggcaagagcgtcgatccgctgccgctgcgcgatttcgtggaactgcaccgcacagtcggcgccgacacgctggagcacacagacgggctgcgctcggccaccttcacggcggcggtcgcccccggtcatcagctggccgaagccttccaggctctgatgccgctgatgggcgaggtgctgcagcctggcatgaagccggtgctggccggcgatgccgccaaggcttcgcaggaaagcggctcggccggtctggtgctgctgctggcgctggtgttcatcttcttcatgctgagcgcccagttcgaaagcttccgcgacccggtgatcgtgctggccatcgcgccgctggcggtggcgggtgcgatcttcaccctgagcgagaccggcggcgggctgaacatctacagcttcatcggcttcgtgaccctgatcggcctgatcgccaagcacggcatcctgatcaccgaattcgccaatcagctgcgcgatgccggccgcgaccggaccgaggcggtgatcgaggcggccgaaacccggctccggccgatcatcatgaccacgatcgccaccgtgctgggcgcggtgccgctggccatcgccaccggcgccggcgccggcgggcgccgcgaactgggctgggtgatcgtcggcggcatgacctttggtacgttcgtgtcgctgttcgtcatacctgcggtttatactctgatctcgcggaagcggcggaaggtgctggtggaaccgccatcgcccgatgcgctgcttcagcagagattgaaggatcggccggcctcatga

SEQ ID NO: 16 - DNA, 1134 bp, Tistrella mobilis
atgagggcgagaggctggatcacgctggtgatcgttgcaggcctggccggtgccgccggctgggcgtggcaggccggtctcgtgcccggcgtgcctgcgccgggggcgacgaaagggccggccgtggccggaaccgccgccacgccgccccagcagcccccggcggcgccggcgatgaaggtgggcgtggccaaggccggccgcggcacggcctatgatcgcctgatcaccttcggcacggtggaaccggtggcacgcatcgtgctgtcgccgcaatccggcggccatgtcgtcgccgtgctgttccgcgagggggaggcggtgaagcagggccagcccctggtccggctggaccagcgcgtggccgaggccgagcttgcaagcgcccgggcgaccgcggcgctggacgcccagaacctgaagcgcgacgaagaactgggccgccggggcaccaaatcccgcgccgatatcgaccagtcgcgggcggcggtcgcggcctcgcgggcggcgctggaggtgaagcagacccagctcgacctgctcaccctgcgcgcacccatcgacggcgtcgccggcacccgcaagatcgaggtcggcagctttctttcccccggtgaagaggcgctgacggtcgaggatcgctctcgcctgcgggtgacgttccgggtgtcggaaaaacttctgccccggctgaagaccggcctgccggtcaccctctcgtcccagagcctgggccccgaccccatccaggggcgggtgacgttggtcgatccctcgatcgaacccgacagccgcagcatcctgctccgtgccgagctgacccaggccgaaatcggcggccggccgatccatccgggcctgttcgtcaatgtcgatctcttgctcgacagccgcgagggcgctgtactggtgccgcggccggcggtgatgtcgtcgctctcgggcgactacgtctatgtggccgacaacggcaaggcgatccgccgcccggtgaccatcggtgccgacggcgatggcggcacggtcgagattgtgaccgggctcgatgcgggtacgccggtgatcgtggaaggccagttcaaggtcgaggacggcatgcggatcgatccggtgccggcggacgggggcggctga

SEQ ID NO: 17 - DNA, 234 bp, Tistrella mobilis
atgagctgggacgacgaagaagaccgcacgatctatgaagtggtcgtgaaccacgaggaacagtattcgatctggcccgccgaccgcgacctgccgctcggctggaacaaggccggcaaacagggcccgaaggccgaatgcctggagtatatcaaagaggtctggacggatatgcggccgcttagtctgcggaagaagatggaggagcaggcgcgggaggcgggggagaggtga

SEQ ID NO: 18 - DNA, 207 bp, Tistrella mobilis
gtgaaaaagtcgcgcaaagtccacatcaacaagatcctcatcagtgaaatggccttgatctttggccaagttcaaggccgccccgcctggcgacggcacgggcaggactttggcggccggatgaaattgcctgaagagttcatgctcggcttccactccttccatgccgccgatgaaaacagcggcaacgagatcatcgcgcgatag

SEQ ID NO: 19 - DNA, 138 bp, Tistrella mobilis
atgggccgcagcggcagcatcgttgccgatggcgacgatgcgagaggggcgcagcaagacaatgagctgttggagcagatcttcgccagctcgcctctcacgcgcgttgtgctgccggttggtgaaaggatctcctga

SEQ ID NO: 20 - DNA, 183 bp, Tistrella mobilis
atgcgggtggagagggaagacgttccaaaggaagatgcgagcatcaatgtgctccagcatgccccatatgaccgcggcggttcgttcggccacggcactgcctatcgtcggacgctcggcgacctggtcgagatcccaacgcctagcgtgctggcttatgtgaacgtcgtcggtcagagctaa

SEQ ID NO: 21 - DNA, 573 bp, Tistrella mobilis
ttggccgggcttgattttgacagtgagtttggaattgaggaacagctacccagggacttcaaaattcgggttaatcagcggggcagtggcaagagttatctccaatggaaaggtgtattcattggagagccactgactgacaacattgccgatcgcgatggctaccggttccatgatgtcttccattttgcctatgcagccatcttgcattggtcgccggtgatacgggcattaatcaagcacaagcgaaagagcaatccgaaatacgatgaagagcaggacagcggccgggccatcgtcgttgaggaaggacttacggcctggattttttccagggccaaagagttgaatttctttgaggaacaggaaaaggtttcacttggaattctcaagacaattggcgagttcgtgagcggttacgaagtagagaaatgtccgttgaaactctgggagaaggccatcctggatggttatgctgtatttcgccagctcaaattaaatcaaggtggatggattattggagaccgcgaacaacgtgccatcacatacatgccattggagtctgaaaaatga

SEQ ID NO: 22 - DNA, 228 bp, Tistrella mobilis
gtgaactgggaaatcgaatatgcggccaaacagggcaagcgcattgttggtgtttgggagcatggcgagaaggaatgcgacctcccagaggctctgaaagaatatgctgacgctttggttgggtggaacggcgatgcgatcattgatgcgatcaacgggaaggactcgtgggagaagcctgacggtggcgcctgcgacccggttccactcaagcggcacccctgctga

SEQ ID NO: 23 - DNA, 975 bp, Tistrella mobilis
gtgcccatgaccgccagcgagaagaccagcaccgcaccggccaggcctgccgcaaccgcaaccggctctgccgtcggccccggcccggccgcccgcagcaatgcctatctcgacatgggccgcctcggccgcagcagcgagctgatctacggcatcgggctgatcatcatcttcctggtggtgccgctgggcgcggcccaggtgatcggcccgatccaggcctgggcaatcaatacctacggcccccctgacgccatggtcaatctgttcgcgaccacggccaacatcgtgggcttcctgatctggatggcgatgttcccgatctggatcctgggcgtcttcctggttgtccggctgctcaaccagcggccgttcatgaccctgatctcgccgacgcgcacctatgatctgaagctggtcggcctcgccttcctgatctatctgcccctggtgacgctgtcctcgctcgccggcatctggctcgccggccagccggtgaccttcaacttcgtgttcgaaccggcaggctggatcgcgggcctggcccttggcctcgtgctctacctgatccaggcgacctccgacgaactggtcttccgcgcctatcccctccagggcgtctacgccgtgatcggccgcccggtggtcgccgccatcggcgccgcgctgatcttctccctctaccattacagccccgccaacacgcccgaaacctatgccagcctgttcatcgccggcctgttcgcggccgcgctgacggtcaaggcccagcgcctggaaccggcgatcggcgtccacctcgccaacaacctgtcgctgttctccatcgtccagaaccccgaagtcaccccggcagaaccgatctggcgcctggccgaaccggtgggcatgagctgggcgctggtggcgacggcgattgtcgcggcggtggtgttttgggtggtgttttttggggtttgggggaggagggggtga

SEQ ID NO: 24 - DNA, 1197 bp, Tistrella mobilis
gtgaccatgtccacctcgtccccgcgatcctctgccgccgtcagccgcggcgccgcgctgttgctgatcgtcgccatcgtgctggtggcgctgaacctgcgcccggcgctcaccagcatcgggccgctgctcggcaccgtctccgccgcgctcggcctcgacagcgccaccgccagcctggtcaccaccctgccggtgatgtgcctgggcctgttcggcccggcagcccccatgctcgcccgccgcatcggcgtgccggccgccgcggtggtggcgctggtgatgatcgcggtgggcgtggtgctgcgtggcttcttcgggcccaccggcctgttcgccggctcgctgctgggcggcgccggcatcggcattgccggggtcctgctgccgggggtcgtgaaacaggcgtttccagacaaagccgggttgttgaccggtatctacaccatggcgctctgcggcggtgccgcgatcgccgccggggtcaccgcgccgattgccgaggccagcggcagctgggcggtggcgctgggcgtctgggcgatcccggcgctgctcgccgccgcggtctggtggccggcggcgcggcatctggacacccgggcggggcaccggcccaataccggcacgcggcttctgacctcgccgctggcctggtcgatcacgctgttcatgggcctgcaaagctcgctcgcctattcggtgttcggctggctgcccagcattctgcaggatcgtggcgtcagcgtggtgatgtcggggctggtggtgtcggtgtcgctgctggtgcagacgatctcggcgctgttcgtgcccgtgctggctgcccggcggcgcaatcagcagctctgggttctggcgatcatggtctgcacgatttcaggcatgctcggcatgatgtgggggccggttgcgaccatgtggccctgggcggtggtgctgggcatcggccagggcggctgtttcgcgctggcgctggtgatgatcgtgctgcggtcgggcgatgcgatgacggcggcccggctttccggcatggcccagtcggtgggctacacgcttgcggcactcgggccgctcgccatcggcctgatccacgagctcaccggcggctggtcgctggtcgcctggctgctcagcggcatcggcctggtcgccctggtcaacggcctgatcgccgcccgcgaccgcacgttgtga

SEQ ID NO: 25 - DNA, 768 bp, Tistrella mobilis
atgtccagcctcggcgccgtcgcccggcgcagtctcgtcgatgccgcgatcgagcggttgcgtgcccagatcggccgggatggctggggggcaggggacaggattccgccggaacccgaactggcccaggccctgggtgtcggccgcggcacggtgcgcgaggccgtgcgggcgctcgcctatctgggcctgctggaggtccgccagggcgacggcacctatgtccgggcggtcgacgagccggccgacgccctgcgccgggtcgccaatgccgggctgcgcgatcatctggagctgcgcgcggctctggaggtagaggctgcacggctggccgccttgcgtgtaacacccgacagcctggcccgcatcgaccgcgccctggccgcccgcggtctggtcgagccggcgccaagtgatcccgccgccttcgagacctatctggaacaggacatcgccttccacctgtcggtggccgaggccgccggcaatgcggcgctcgccgaactctatggctggttcaccaatcagctgcgccgctatctgcgcatctcgctcgccgatcggagcctgcccgagccgagcctcgctgcccatgtcgcggtgcgcgatgccatcgcggcgcgtgatcccgaccgggcggcacaggcggcacgcgacctcctggccccgctgatggcggtggtcgaaggccggttgtccgacccgtcttcgcccccgaaagcctcccgtaccaagcccctccgcacactgaaagcccccggtctgtga

SEQ ID NO: 26 - protein, 261 aa, Tistrella mobilis
MQPTASRWVQPGQDRWLTGPAGRSAAPWRLLCIPHAGGGASAFRPWEAFTGPDVELLVAQLPGRESRFPEPALDRVAPVVDGLATALGRLAPKPTLIFGHSMGAMIGYELAARLVGEASPHAPRTLIVSGRTAPGSSSTLGDLLGLDDAGFADALAARYDGIPAALLADRELMAVFLPTLRADFRMVAEYRPDPAACPRLPCPILALGGADDIHAAPERLTAWQDFTTAGFMREIFPGGHFYLAADPAWVVARVLAARSMV

SEQ ID NO: 27 - protein, 483 aa, Tistrella mobilis
MTVADMDMTDEPERPGLFGRIGGWLRRHLWSLTLSVLIFGALVILFWPAMFITVPAGHAGVVWHRFSGTDVENPTGEGLQVIWPWDRLEIYDVRFQTVTQTYDAITADGLTVATTISFRYRVNQEYVGILHKNVGPEYLHKIIIPEVGSVARARISQYTAEDFYSNLRTIVQNEIYEGVKSNFLRGNYYSQPGIDLIELQDVLIKAIHLPERVAQAIERKVEQYQRQLEYDYRLATEQKEAERKRIEGEGIRMLFDRVGASEIPDYLTWLGINASVQLAQSTNAKVVVIGNKDSGGMPLILGGIDSNGARAATTSGATGAPQAADGGAGQPVIVGDVDTGTAEIRPVGSEPLNQTGAAPAPAGGPKSGPRMDSGESEAVVEGVPAGTASVGRAMVPETTTPEHQTAPATPVQPASPQPAPTAVRQGFLPGEPVTLEQLSRWLGIGGGTGAVTTPYGPAGFGPYGVVPETAPPVGGARVAGAGG

SEQ ID NO: 28 - protein, 560 aa, Tistrella mobilis
MPLIELIRRDLTAKPATLLFIAALAGVSNALVMAIINNSAGLYEDALDLRTVALFVIVVAIYVLSQRRMMQITATEVEEIIHRQRSSLIDAVSRSDLLPLEQVGRGNILASVIRDTQTISQAANLLVIAAQSVILVGLAMIYIFITDRTAFWLSTGFIAIAVFLVIRRLIDLRNRYPAAMMKENQVFESMRDVLDGFKEVKLSSARRDALLRDMARVSIEARDAKADMQVKSGNEFVFGQTMIFLLLGLVVFVVPSFGNTEPEAVVRTATAILFIVGPLSMVIQAVPMMAMANAAADNLMRMDRVLREIVAASEVAATPPQTLTSFEEIRLDGVAFAYAPVGGVSFGVGPVDLTIRSGELIFVTGGNGSGKSTLIRLLLGLYHADRGMIRLDGKPVTRGSFETYRSLFSAIYADYHLFRRLYGIEPPDVAEFDALVKLMEMGGKVALQGDLFDTIDLSSGQRKRLALMVSMIEDRPVLVLDEWAADQDPQFRRKFYRELLPMLKARGKTVIAITHDDRYFDVADRRVAMEEGRVVRIVDNRDARIEDDARIEDEDGEDPA

SEQ ID NO: 29 - protein, 70 aa, Tistrella mobilis
MPPTMGLLLPTIYVVMSVMVGLCGAGRKPGFVVSFLLSLLVTPFVMLLLLYATRPREPARPVVARKTKRH

SEQ ID NO: 30 - protein, 190 aa, Tistrella mobilis
MSTAEVTAAPAEEYTPELRADDARALVKRCALWGAGAGLLPFPLLDVALVTGVQVKMIYELSKLYDVPFSENRAKAIIGSLANTVVPGTAAAGLVGGVASLVKSVPVVGTVIGLAVSPTVSYAVTYAIGRVFIQHFETGGTLLNFNPDQLREHFKAEFEAAKADAPSTVEAAKAAADTKTEAKPAATKAS

SEQ ID NO: 31 - protein, 987 aa, Tistrella mobilis
MSPSPPSSPGAAAEQVERQLTTPIEQAVSGISGVQQITSQSRAGMSLVQIQFRLGLDGLLLANEVRNKVAPLTDTLPQAARAPVVAQQSLDAQPIMFLTVASDSHDALEISDTANRLLLPRIAALDGVAQATLLGERRYAIRIVLDPIRLASYGITIGDVRAAIVAQNADVPGGEIRTRTDRTDVVVEGALSTAAEFDRLVVRAEPGYLVRISDLGRAEVGPESLDNAIRFNGRDVVAVGIVPQSTANPLDIARLVKAELPALQAGLPGGFRLEIAFDSTIYIDASVHEVFETIAIAVALVLGVVVIFLGSLRSSAIALVTIPLSLLGTLGLMAAMDFSINTLTLMAVVLAIGLVVDDAIVEIENVQRHVDDGLDAFTASFLGSREIGFAVIATTLTLAAVFAPIGLVGGQIGMLFREFAFTLAGAVLISGFIARTLSPMMCARLIGARAEHGYARRVERATEALARAYARLLGWLLHRRWLVLLGVIAALYVGFSATSRLNFAFAPVEDQGYILFDIEARGTSTLDHLQDQIARVEAVLKTVPEATGVLTLLGSPKPSAANAYLLLKPWGERSRSATEIGDALKPLLAAIPGLRIDVLQVSPLGGGGSSRPIQLMITTTGSYDDLARTMDRLVTKARDLPSIADPASSLELDRPQLEVTLDRDGAGEQGVTATALGDTLQAALGGNPVSTFTNRGELYKVIIDLPPEWRGQVETINTLEIRGKSVDPLPLRDFVELHRTVGADTLEHTDGLRSATFTAAVAPGHQLAEAFQALMPLMGEVLQPGMKPVLAGDAAKASQESGSAGLVLLLALVFIFFMLSAQFESFRDPVIVLAIAPLAVAGAIFTLSETGGGLNIYSFIGFVTLIGLIAKHGILITEFANQLRDAGRDRTEAVIEAAETRLRPIIMTTIATVLGAVPLAIATGAGAGGRRELGWVIVGGMTFGTFVSLFVIPAVYTLISRKRRKVLVEPPSPDALLQQRLKDRPAS

SEQ ID NO: 32 - protein, 377 aa, Tistrella mobilis
MRARGWITLVIVAGLAGAAGWAWQAGLVPGVPAPGATKGPAVAGTAATPPQQPPAAPAMKVGVAKAGRGTAYDRLITFGTVEPVARIVLSPQSGGHVVAVLFREGEAVKQGQPLVRLDQRVAEAELASARATAALDAQNLKRDEELGRRGTKSRADIDQSRAAVAASRAALEVKQTQLDLLTLRAPIDGVAGTRKIEVGSFLSPGEEALTVEDRSRLRVTFRVSEKLLPRLKTGLPVTLSSQSLGPDPIQGRVTLVDPSIEPDSRSILLRAELTQAEIGGRPIHPGLFVNVDLLLDSREGAVLVPRPAVMSSLSGDYVYVADNGKAIRRPVTIGADGDGGTVEIVTGLDAGTPVIVEGQFKVEDGMRIDPVPADGGG

SEQ ID NO: 33 - protein, 77 aa, Tistrella mobilis
MSWDDEEDRTIYEVVVNHEEQYSIWPADRDLPLGWNKAGKQGPKAECLEYIKEVWTDMRPLSLRKKMEEQAREAGER

SEQ ID NO: 34 - protein, 68 aa, Tistrella mobilis
MKKSRKVHINKILISEMALIFGQVQGRPAWRRHGQDFGGRMKLPEEFMLGFHSFHAADENSGNEIIAR

SEQ ID NO: 35 - protein, 45 aa, Tistrella mobilis
MGRSGSIVADGDDARGAQQDNELLEQIFASSPLTRVVLPVGERIS

SEQ ID NO: 36 - protein, 60 aa, Tistrella mobilis
MRVEREDVPKEDASINVLQHAPYDRGGSFGHGTAYRRTLGDLVEIPTPSVLAYVNVVGQS

SEQ ID NO: 37 - protein, 190 aa, Tistrella mobilis
MAGLDFDSEFGIEEQLPRDFKIRVNQRGSGKSYLQWKGVFIGEPLTDNIADRDGYRFHDVFHFAYAAILHWSPVIRALIKHKRKSNPKYDEEQDSGRAIVVEEGLTAWIFSRAKELNFFEEQEKVSLGILKTIGEFVSGYEVEKCPLKLWEKAILDGYAVFRQLKLNQGGWIIGDREQRAITYMPLESEK

SEQ ID NO: 38 - protein, 75 aa, Tistrella mobilis
MNWEIEYAAKQGKRIVGVWEHGEKECDLPEALKEYADALVGWNGDAIIDAINGKDSWEKPDGGACDPVPLKRHPC

SEQ ID NO: 39 - protein, 324 aa, Tistrella mobilis
MPMTASEKTSTAPARPAATATGSAVGPGPAARSNAYLDMGRLGRSSELIYGIGLIIIFLVVPLGAAQVIGPIQAWAINTYGPPDAMVNLFATTANIVGFLIWMAMFPIWILGVFLVVRLLNQRPFMTLISPTRTYDLKLVGLAFLIYLPLVTLSSLAGIWLAGQPVTFNFVFEPAGWIAGLALGLVLYLIQATSDELVFRAYPLQGVYAVIGRPVVAAIGAALIFSLYHYSPANTPETYASLFIAGLFAAALTVKAQRLEPAIGVHLANNLSLFSIVQNPEVTPAEPIWRLAEPVGMSWALVATAIVAAVVFWVVFFGVWGRRG

SEQ ID NO: 40 - protein, 398 aa, Tistrella mobilis
MTMSTSSPRSSAAVSRGAALLLIVAIVLVALNLRPALTSIGPLLGTVSAALGLDSATASLVTTLPVMCLGLFGPAAPMLARRIGVPAAAVVALVMIAVGVVLRGFFGPTGLFAGSLLGGAGIGIAGVLLPGVVKQAFPDKAGLLTGIYTMALCGGAAIAAGVTAPIAEASGSWAVALGVWAIPALLAAAVWWPAARHLDTRAGHRPNTGTRLLTSPLAWSITLFMGLQSSLAYSVFGWLPSILQDRGVSVVMSGLVVSVSLLVQTISALFVPVLAARRRNQQLWVLAIMVCTISGMLGMMWGPVATMWPWAVVLGIGQGGCFALALVMIVLRSGDAMTAARLSGMAQSVGYTLAALGPLAIGLIHELTGGWSLVAWLLSGIGLVALVNGLIAARDRTL

SEQ ID NO: 41 - protein, 255 aa, Tistrella mobilis
MSSLGAVARRSLVDAAIERLRAQIGRDGWGAGDRIPPEPELAQALGVGRGTVREAVRALAYLGLLEVRQGDGTYVRAVDEPADALRRVANAGLRDHLELRAALEVEAARLAALRVTPDSLARIDRALAARGLVEPAPSDPAAFETYLEQDIAFHLSVAEAAGNAALAELYGWFTNQLRRYLRISLADRSLPEPSLAAHVAVRDAIAARDPDRAAQAARDLLAPLMAVVEGRLSDPSSPPKASRTKPLRTLKAPGL

SEQ ID NO: 42 - DNA, 6372 bp, Tistrella mobilis
atgaccgcgccacatttcatcgcacatcaaaacatctggctggatgagcggctgaataccggaccgggctcatatcacatcggtggatatgttgaactccgtggtcctctggatatcgatatcttcggcgcggcactgaaggcggtggcggctgcacatgccggcctgcatatgcaaccggtgcccgaaggagacggttttcgtcttctcgcataccaagacaccttctcgtcacctgtcagcgtcgatctgtcgcaggagggaaatcctgcggcagctgcgaacgcctggatggcggcggatttccgccggatgtttccggccggcgcccccctgttcaggtgggggttgatacgcctcaccgccgaccgccatttctggaccaagacctatcaccatctgatcgtcgacggccacgcgatctcgcggatcgtgcaggatgccgcacatgcatacacctcgctgcttgccggccgcgtccccggcctcgccggcagcgatccgctggcgatcggtgatccgcttgcaggcgacggcgtgtcggcgcggcaccactggtcgacggttctggcagcggccccgccggtgctcaacccggtaccgcccctgccacccccggatctcggcccgccggatctcaccccgccggagcccggcatgccgggccggcgaacccggatcgggctggagcgcggggtctatgatggcctcgcccggcttgccgcacaggccggcgccggcctgccgcagctgcttctggtgctggcctctgccgccctgctccgccgggcggggcgggatgctctggtcgccggcctgccggtcgccaacaggccgaccgccgcccacaaggcggccgtcggcctgttcgccaccatgcagccggtcatcgttgcgatcgatgccaccgaccgcccgctcgatgtcgcagccgctctggcccgcaggatgcgcagcgcctatcgccatcgcagcatcgcctttgccgaacaggcggcgatgctggcggcggtgcgcggccggggcacgcccgctttcgatctcaccctgtctttcgagccgcacgactacgacgcccgcttcggcccggtgacggcgaccgcccataccctctccaccgggcgagagccgcatccgctctcgatcttcgtgcgcgactatcatgacggtgccgccgtcaccgtcgatctggactggcgcagcgacgttttcgccgccgacgacatcccggccctgatcgcccgcttcaaccggctctgccgcaggctcctcgaccagcctcaggccagcctcggccggctcgaccagccggataccgaaaccctcgtccggctcagacgcctgggctgcggccggccgccacgaccgggcgatctcgcaccgctcgccgatacgatcgcggcccaggccgccgccacccccgcagccctcgcggtggtcgatgccgcgaccggggatcgtctggactatcagaccctcgtcgcctgcgccggccgccgcgcggccgcccttcaacgcgccggtggcggccccgaaagcgtgatcggccttgcccatccttcggggatcgaggcggtgatctcgcggctcgcggtctcgatggcaggcgccgcctggctgccgctcgatcccgaggatccccctgcccgccgggcgacgatgctcgatcaggcccgtcccctgctggtgctggacgaccagtcggcccgcgctctcgacctgaccgttgccgccgatgcccggccggcagcatggccggttcatcccgaacagctcgcctatctgctgttcacctcgggctcgaccggcacgcccaagcccgtcgccgtcccgcaccgcgccctggccatgcacatggcctggatgggccggcgctatccgctcggccccgacgacgtcgtcctgcagaagaccccggccggtttcgacgcctcgatctgggagtttctggcgccgctgatggccggtgcgcggctggtgctggcgccagccggcagccatcgcgaccctgagatgatcgggcggctttgcgcagatcacggcgccaccatcctgcaggccacgccgaccctgatcgacgcgctggccgcaggcggggcgctcgcccgtgccggccggctgcgccgcctgttcgcgggcggcgagatcctgggcccggcgaccatcgccgccgcccgggcagcgctgcccgccgatgccgtcctgatcaatctctacggccctacggaatgctgtatcgacgcctcggccgccgacatcccggcggatctgcagggggcggcgccgctgggcgatccggttgacggcgccagcctgcaggtgatcgatgccgcgggcgacccggtcggcccgggggtcgccggtgaactcgccatcggcggcctggccgtcggccgtggctatcacggcgatccggtgcgcaccgcgttcgccttccgccccgaccccgaggcgaaggcgccgggcgcccgccgctatctgaccggcgatcgcgtccgccgcacggaacgggatgccctgctggcgctgggccggatcgacggccagatcaagctggccggccggcggatcgaaccgggcgagatcgaagccgcgctgatggtccatcccgccatcgcccaggcgggcgcagccctgctgccggcgaccgacggcgccgctccccggctcggcgcctgcatcgtgctccgccccggccatcctgccccggcccccgacgagctgcgccgccatctggcggcccgcctgcccgccgtgctccaccctgcgatcgtgacctccgccgaccggctgccgctgtcgcgttcaggcaagctcgaccgccgggctcttggcaaggcgatggccgacgaggtaccggccaccgccgcccgcacccgcctcgacggcccgctccaggccgaaatcgccgcgatctgggccgaagtgctcgacctgccgatgcccggatccgccgatgatttcttcgcccttggcggccactcgctgaaggccatgcaggtggcgacgcggctgcgcgcggtgttcgatgtcgaaatcggcctggaagagctgttcgaccatccccgcctcgacgatctggcggcactcgtcgccgcccggcgccgggatgcccctgcggaccccggccccgtgctcgacatcctgccggtcccggccagcggcctctgcccgctgtcgtctgcgcaggagcggatctggtttctggcccagtggccggatggcgccgtcgcctacaatatggcgatggcggtccgcatcgacggcccgctcgacgtcgcagcctttgccgaggccgcggccgtgctgcccgatcgccatccgatgctgcgcacctgcttcgcggcccccgacggcgtgccgcttcagcgggtcgaccctgaggcacggctggtgctcgcgacccgcgatctcagggatctcgatcccgcggcacgcgatgcggcggtgaccgaggccgccgcccgcgacgcagccacgcccttcgacctgacccgggcgccgctgctgcggctgaccctgctgcggctcgccgatgacgcccatgtcctgctggtcaacctgcaccacatcgccggcgacggctggtcggggcagatcgtgctggaagagctgaccgccctttatgccgcccggatcggcgccggtcccgatctgccgccggcgcccgcgctcacctatgccgatgtcgccgactggcagcgccgccgcctgaacgaggccgaagcccgccgccagctcgaccattggcggggggtgctgaccgacccgccggtgctggacctgccgaccgaccggccgcggccgccggtggtctcatcggacggcggctgccttgtccgcgacctgcctgatgatcttctggtggatctccgcaggcttgcggcaggcgccggctgcacgcccttcatggccatgaccgccctgttcggcctgctgctcggccgcatggccggccaggacgaggtcgtgatcggcacgccggtcaccaaccgtccggaccggcggctggaggatctggtcggcttcttcaccaacaccctgccgctcaggctggatctgaggggggccgatcttcccgccctgctctcccgcacccgcgccacctgcctcgccgccttcgaccatccggacctgcccttcgagcgcctggtcgatgccttcgcgcccgaacgcagcctggcccatacaccgctcttccaggtgatgctggcctggcagctggccggcgccagccggctggaactgccggggcttgccgtcagccggcttgcccccgccttcaccgccgccaaattcgacctgatgctttcggtcgaagagaccggccggtcgatgtcctggcgcttcgactatcgcgccgagctgttcgagcccgagacgatcgccctgatcgccgaccggcttatcgccctgatccgcgccgccgcccgtcatccggcagcgcgtctgccggaactcttcgaagtcccggttccgacagtgccgacgccccccgcgcccgcatccgatgtcgtcgacctcatcctcgcccgtctcgacgccgatcccggccagatcgcgctggtcgatgcggccacgggcatcagcctttccgccgcagaactggcagcccgcgcccgccgccgtgcggcggggctggtcgcggccggcatcggccccgatcgcatcgtcgccctcgcccatccccgcggggccgagctggtggtgtcgatgctggcggtggcgattgccggcggtgcctggcttgccctcgacgaggacgagcccgaggcgcgccgggcgctgatcctggcgaccgccgcccccgatctggtgctggatgccgacggcgccgcccggatcgatgccgccgccggcgatcatccgctgccggccggcgtccgccatcccgaccggctggcctatctgctgttcacctcgggctccaccggcacgcccaagccggtggccgtgccgcaccgcgcgctcgcccggcacatggcctggatgaaccgcagcttcccgctcgaccccgcagatgccgtgcttcagaagacgcccaccggcttcgacgcctcggtctgggagttccaggcaccgctgatgaccggcgcccggctggtgctggcccctgccggcagccatcgcgcgcccgagaccctgggcaggctggtcgacgcccatggcatcaccattcttcaggcaaccccgactctggtcgatgcgctggcggccacgggcgccctcgcccgcggccagcagctgcgccggctgttcatcggcggcgaagcgctgggtacccccaccattcgcgccgcgcgcaccgtgctgccgtccggctgcgcgatcatcaacctctacggccccaccgaatgctgcatcgatgccaccgcctgggtcgcggacggtctgcccgcggcgggcacggcgccgctgggggcggcgatcgacggtgtgcatctcatggtgctcgaccgcaccggccgtcccgtcccgccgggcatgccgggcgaactcgccatcggtggcgagaccgtcggccgcggctatcacggcgatccggtgcgcaccgcgctcgccttccgtcctgacccggcggccccccgccccggtgcccgctgctatctgaccggcgaccgggtgctggtcgatgcccgcggccggctgcgctatcagggccggatcgatgcccagatgaaactccgcggccagcggatcgagccgggcgagatcgaggcggtgttgagcgcccatcccgccatcgcccgcgccggggtgacggtggtgagcgccgagggcggcgagaccctggtcgcctggctgacctgccatccgggaagcgttttgcctgccgccgaggtgctccgccgccatgtcgcccggcatctgccgatccacatgatcccggcgcgcttcgttgcaaccgatgccctgccgctcaccgcctcgggcaagctcgaccgccgggcgctgaccgcccggccgctgcccgacgccgaccgcccggccggcagcgatgccccggccagcccggtcgagatcctgattgcggaaatctgggctgaggtgctggaccggccggtcatcgcgcgcagtgacgacttcttcgcccttggcggccactcgctcaaggccgtgcgcatgctcgcccggctgaacgaggcgctgccggtggaggtgccgctgcgcaccgtgttcgagaacccgaccgtggcgacgcttgccgccgccctgggcgccctgaccgatgcggcactggccggagatgacgatctcgccgccctgctggccgaaatcgaggccctgaccggggcagaggggcccgaggtagatgggcccgggacagatgggcccgaggccgaaacctttccggataccgccgcccaatga

SEQ ID NO: 43 - DNA, 5391 bp, Tistrella mobilis
atgagcacgctcccgcccgatacgcctgccggccgcagcctgcttgaccgcatggccgccctcagccccgcccagcgcgcggcgctgaagcagcgtctggcggcccgcgacggggctccggcagcacctgcaacggccgtcgctgcggagacatggcccgaggtcggcgcacaagccccgctttcccccgcccagatgcgctttctgttcctggccgaagacgaggccggcgatgcccaggccatgtcgctgatgctgcgcatcgatggtccgctcgatgccgaccggctggcggcggcggtctcggacatcgtcaccgcccaggcggcgctgcgctgccggatcctgaaaaccgcccgggccccggtgcaggaggtgctgcccgcccccgcaccggccgaagcactgccggtcgtccagatcgcaccggcggaggatgccgatgccgccctggttgcggcgggcctcgccctcggccacgaaagcttcgatctcgccgtcggcccactcgcccgcttccgcctgtttcgctgtgcgccggatctgcatgggctgggggtggtgctgcaccacatcgtggccgatggctggtcggccgggctttgcctcgccctgatccaggacgcctatgcccggcggatggccggccggccgccggcaccgccgcccgcgcgttccgccttcgacgaagcccggcgtctggccgatctggcagccggggaagcgcatcgccgccgtctcgaccaatgggtcgaccgtctggccggtgcaccgcgacggctgatgctggatggcggaccgggagagccgggccccgcccggcatctgcccttccggatcaaccccgcccaggccgaagccctggccggtctcagccggcgcgtgcccggtgccacggtcttcaccgccctgctcgccgcctggggcgcggtgctcggccggttcaccgatcagggcgacaccacgatcgcggtcgcggtcgccaaccgccccgatccggcgctcgaccgcacgatcggcgaattcgccgatctggtggtgctgcggctcgccaccgccgacgatccgggcgtggacgccctgctcacccgcacccgcgacgcggtgatcgacgcccaggcccatgacggcatcaccctcgcccagatcatggaagcgatcgaccgccgccatggcgccggggcccggccggcgatcgatgccgccttcagcttcctgaacgtgccggcgcctgcggccgacgcccatggcctgcgcttccggccgctgccactgccggccgaccggctggatttcgcactctatctgacggcgcacgaagatcctgccggcggactggcgggatcgctgggcttccggcctgatctcgtgccaccggcgctcgccgccgcactcgccgacgctttcgggctggtcgtcgacgccatcagcctggacggcagcctgccggtctcgcgcctggccctgacgaccgaacccgccggcgacgatctgccggtggtcaccggccccgatggccggctgcatctggcgcccgtgggcctgccgggccggcttctgcccggccccgaccgcgcgcggcggctctccgacggccggctgcggctgctgcccggcatcgacggcgcactgcgccgcggcactgcgcgggttcatccggccgcggtggaagcggcgctgcgccgcctgcccggcgtgctcgatgcggcggtctggacccgcatcgccaccgatcacgaggcccgtctggtcgcggcggtcgcgaccggcattccgtcgatcgagcctgcgggtttcgcggccgggctcgtggacgcgctgccgctgctgctccgcccggatgccgtcctgccggttcatgccatcccgcgcgatgccgagggccggcccgaccgcgccgccctcgaccggctggccgtgcccgcggccccgcaccggacggatcaggcggccctggtctgggtggaggcgccggcccccgctctgccgcgcctgccgctcgacagcctgcccggcaccgccggagcggcggatgacgcgggctggctggtgccgggcgacccgccgcctcgggcgctggccgatggggggccgctggttctgcccgccgatgccccgcgcacgctggatgccgccctgatcgcaaccgccgcccgccatccggggcgcggcattctgcatgacgacggccgcggatcgccacggcttcaggattatgccgggcttctggcggccgcccgccgcacgctcggccggcttcaggcagaaggcctgcgtccgggcgaccgggcggtgctggtcttcgccgaccttccccgtcatatcgaggcgctctgggcctgcattctgggcggcatccggccggtgacggtcgccgtaccccatgccgccggcgatgccgtcgcggccaagctttcgggcacccatgcgcatctgggcgcgccgccggtgctgaccgataccgacacccgcgatcatctgagccggatcctgcccgacgcccggatcctggtcgccgcccccgacaccgatacgcctgacggggttccccatccggccacccccgacgatgtcgccttcatccagctctcctcgggctcgaccggtgtgcccaaatgcatccaggtcacccatggcggggtgatcgcccatgtcttcggccaagtcgccgcctgggggcacgggcccgacgacgtgtcgatgaactggctgcccttcgaccatgtcgtgccgatgctgacctgccatctgaaggacacggtgctcggccgccagcagatccaggcccccaccgcggcggtgctggaccggccgctgctctggctcgatctgatcgaacgccaccgggtgacgctggcctgggcgcccaatttcgcctttcgcctggtcgccgacgccctgtcgcgtgagacggggcggcggcgcgacctgtcttcgatccgctggttcatcaatgcgggcgaacaggtgactgcaccggtggtcgccgatgcgctggcggccatggtgccgcatggcctgcgtcctggcgcggttcgcaatgaattcggcatggccgaactctgcacggtgatgaccggcggcatcgacttcaccgcagacggcgcctgccgccatgtcaccgccggatcgctggccggccggctgcgcgccgccgcgacgcccggccccggcacggtcagcttcgtcgatgccggccggccgatccctggtgtcgcgatccgcatcgccgatcccgacggcgccacctgcccggaaggcgtgatcggccggcttcaggcgcggggtgccgtcaccacccccggctatatcgacaacgccgccgccaatgaagcggccttcgccgatgccggctggttcgacaccggcgatctgggcttcatcgccgatggccgcctggtgctgaccggccggctgaaagagatgatcgtcgtctgcggcgccaatcactatgcccatgacgtcgaagacgaggccggccgcgcggcgggggtcgccgccaccttcgtcgccgccaccgccgtcgaccgccccgatctcggcaccgaagggatcgccgttttctacgtgcccgaggcttgtctggccgagatcggttccgccgatgatgccggcccgcgccgcgccgaaatcgccgagatcaccgcccgtctcgcccgccggctcggcatcgcaccctcggtggtggtgccgctggagcgggccgatttccccaagaccaccagcggcaagatccagcgcaccgccctgcgccaccggctggaagcgggcgatttcgatgcccggcttgccgccctcggcctcaccccgggccgcgatcgggggccgggcctgcccgactggttcctggagccgggggatgcccccgccccgccgcttgccggcgccccgcggcttgggctgatcgaagaccgcctgccgcgcggcatggcgctggccgatgccatcgaccgccggcgcgcgctactggcccgtctggccggccagactgtcgagctggtcaccgtgacacccgccggcgacgtcaccgccgccgcggtcgatgccttcaccgccgccgcggccgaggagctgcccggcctgcatctgcgtcggatcgtcatggccgacggcacgcccgaagcgctcatcaccgacgagattgcccgtggcaccctgccggtggtccacctcgcggccggcggccgcacccggccggtgctgcacccggcgcggctcgcccccgacacccctgcccaaggtatcgccccggggcaatcctggctggtcaccggcggccatggcgggcttgggcgggccctgatccgccacctgctcgatcgcggcgtggcctccgtcaccgtcatcggccggcacatggcgacggcggatgacccgcgagtccatgccctgtcgctcgatcttgccgccgccgatgccggcgcgcggcttgcagtcctcggccggttcgacggcatcgcccatctggcggggctctatcgcgagcggccggcggccgaagaagacggcagggcggtggccgagctggcggcgcccaagaccggcatgctgccggcgcttgcccgcctgctgcgggatgacgggctgctgatcgccttctcctccgtcgtggcccatctgccggcggccggcaccgcggcctatgccgccgccaatgccgccctcgaagccgaagccgctgcgctgcgccggcccggcgggccacacctcgtcaccatcgcctggacgaattgggacgggcccggcatgggggcggccgtcaccggtgccgccggcctcgcccgcggccgcggcctgctgcccatcccgcccgccgacggtctggccagcctggatgtcgtgctggccgccggcctcacccgcgcggtgatcggcgccgatcgccgccatccgatgatcgcggcccgttgcatcgatccggaactgtcccccgcccgcgcccgcgcggtgctgctggtggcaggtgagacggctgccccggcgacgctccgccgggccgaagacatcttcggcacccctgccggccccgggctccgccatgtcgaccatctgccggaaagcgacgacgcccttgtggtccttgccgccggcggcgacaccatcgcggccgtggcaccccgcacggcgaccgaaaccgcgctcgccgcgatctggtcggaactgctgccggcaccggtcgccggcatcgatgccgatttcttcgccgccggcggccacagcctgctcgccgcccggatcgtcacccggatcaacgaccatttcggcctgcaccttaccccggccgcgctgttcgatgccccgaccatccgggcgctggcggcgcatgtcgacggcgttgcggcgcccggcccggccggggccgacgaggatttcgaggagggcgccctgtga

SEQ ID NO: 44 - DNA, 3993 bp, Tistrella mobilis
gtgaccgccaccgacctgctcgcccgcgtcgccggtgccggcatccagctctggtccgagaatggcgagctgcgcttccgggcaccgaaaggagcgctgaccccggaactgcgggccgagatcggggcgcgccgcgccgagttgatcgcgcttctggccgaggcagccgccgtcgccgcggcggatgaccgcgacccgctgccctccttccggcctgaactggatgatgagatcccgctcgcccccggtcaggcccgctggtggttcctcgaccggctgggcgccgatccgagggcggcgctgatcaccgcggcgctcgatctcaggggctcgctcgacatcgcccgcctggcccgggccttcgccgacatcgcccgccgccatcagccgctcaggaccgcgatcctcgatcatcagggcacgccgcgcgccgtgctccggccggtgcccacggcctggccgctgccggtgaccgatgccgccgacgacgccacggccgatgcgatggcgcgcgagattgccgcccggccgatcgatctggcggacgggctcaacctccgcaccgcgctcctccgccaggcgcccgatcatcaccgactggtggtggtgctgcaccatgccgccgccgatggctggtcgctgggcgtgctgctccacgaggtgcaggttctgtatgacggcggcacgctgccgccgctccgccgcagctatgccgaggtgatgcaggatcaggcgcggatccgcgccgccgatctcgatgtctggcgcaagctgctggccgatctgccgccggcgtccgatctcgttctgcccgggcatcccgagccggccggggacgacccggtgatccggcggcgtctttccccagagacgtcggcccggctcgacgccctcggccgcgggctgggcgtcacccccttcatcatcctgaccgcggccgcccagatcctgatcggccggctgtcgggcagccacgacttcgccctcggcaccccggttgccaaccggcccgatgccgatgccgaggcgctgatcggcttcgtcaccaacacgctggtgctgcgcgccgccctcggccgggcgcgcacggtgcgcgagctgctcaccgccatccgcggcgacacccgcgacgcgctcgcccaccagtcgcttcccttcgaccggctggtcgacgcgctgggcattgcccgcaccggcaccgacaacccgctcttccgggtgctggtcgcggccggcgccgccgatctgccggcgccggggctgggcggtctcgacgtcgccattctgcccgccccggccacgagcacccggctcgaccttgaaattcacggccatgccgggcccgagggcttcgatctggcggtcactttcgatccgacccggatcggccgcaccgctgccaccgacctgctggaccggctgggtctgatcctggacggcatggcgacccgccccgatgaagcctgggccgacctgccgatcctgaccgcggccgaggccgcccgcatcgatgcggcggcccgcggcgccgccatccgccacccgcgggtgctggacgaaatcctggcccgcgcggccgaggctcccacggcaccggctttgatcgacgcccatggcagcctcgatcgccgccgtctgatcggccgcgccgccgcgctcgccgggcaactcggcgccgtgcagggtgcaccggtggggttgatgctcggccgcggtcaggcccatggcatcggcctgctgggcgcctggcttgccggtgcgggggccatgccgctcgatcccgagctgccggatgcccggctcgcgaccatgatcgccatcgcggaaccggccgcgatcgtcgccgatgcggcagagatcgaccggctgcgccggctgaccgaccggcccgtccttcctctgccggaggccaccgccgaaacccggccagtcgcgacatcgcccgacgacctcgcctatctgctcttcacctcgggctcgaccggcacgcccaagggggtgcgagtcgcctggcgcacgctcgaccagctgatcggctggcaccgggcccgccatcccgtgcccgcccgcaccctcggcttcgcgccgctcggcttcgacgtctcgatgcaggaagcggcccttgcctgggccgagggcgggacgctggtcaccgccgacgaggccacccgccgcgacccggcggcgcttgccgccttcatctcgcgtcacgacatcgcccggctgttcctgccggtggtgatgctccatgcgctggccgaccatctggccgaccatcccgaccggacccccacctcggtgcagatgatcgcgaccgcgggcgagcagctgcgcatcaccgccccggtccgcgactggtgccggcggcagcccttcgccatcgacaaccagtacggcccgaccgagacccatgtcgtcgccgccgaactgctgccggccgccaatgtcgaccgctggcccgaccgcccggccatcggccgcccgatcgacggcgccacgcttttcgtcaccgacccggccggccatctcctgcccgacgaggtggcgggcgaactgctgatcggcggaacggccccggcgctcggctatgccggcgatgccgcccgcaccgcggaacgcttcgtcaccggccccgatggcggccgcgcctatcgcaccggcgaccgggtgctccgccatcgcgacggccggctcagctatctgggccgggccgacgaccaggtgaagatccgcggtttccgggtcgaaccgggcgagatcgaggcggcgctgggcagccatccggatgtcgcccaggcgctggtggtggtgcggacgatcgccggccaggcgacgctggtcgcccatgtcgagccgcgcgcacgccccgccgacgagaccggcttcgctcaggcgctcgccgaccatctgcgtgcccgcctgcccgagccgatggtgccggcgcgctgggtgatcagcccggccctgccgcgctcggccaacggcaagctcgaccgccgggccctgccggccacggacggcatgccgctcgccgccgccacggccgcgccgcccgccaccgaaagcgagcggcggctggcggcgatctgggccgaaatcctggccctgccggtcgatgcggtgtcgcgcggcgacgatttcttcgccctcggcggccattcgctgcgtgccacccagctgatcgcccgcatcggccgcgatctggggctggagcccggcgtcgcccaggtcttcgagaccccgcgcctggccgacctcgccgccgccctcgatgccctgacgccggtcgcccggacggcgccgatcccgcgccgcacggacgacgacgacctgccgctctccttcgcgcaggagcggttgtggttcatcgaccagttgagcccggcgcgcggcgcctacaacatgccggccgccctgcgcctgaccggtcggctggaccacgatgccctggcgcgcgccttcgccacaatctgccgccgccatgccgtgctgcgcaccgcgatgatcgagcgcgacggccggccggtgcagcgcatccatcccgcacccgagacctggccgctgccggtggaggatctctcggacctcgccgatcccgaggccgaggtggtcgcccgcgcggtcgaagatgccgagacgcccttcgacctcacccggccgctcaagatccgcacccggctgctgaggctgggtgagagcagccatgtcctgctcgccaccctccatcacatcgcctccgacggctggtcgatcggggtgatggtgcgcgagctgggcgcgctctatgccgctttcgccgccggccggcccgatccgatgccgccgctcgccgtcgactatgccgatgtggcgctctggcagcgcgcccgcctgtccggggctgaacgcgaccggctgctcgaccactggcgcagcgtgctcgacggcttcaccgccccgaaccggtcttcgaccgcccccggccggcggtgcagagctatcagggcgcgctga

SEQ ID NO: 45 - DNA, 11562 bp, Tistrella mobilis
gtgcagagctatcagggcgcgctgacccgccggccgatgccggcggcacttgcccgccatgtcgacgagacggcgcgccgccacaaggctacgcccttcgtggtgctgctcgccgccttccagctgctgatcggccgcatctctggcaccaccgacgtggcagtcggctcgcccatcgccaaccgcacccatcccgataccgaggcgctgatcggcttcttcgtcaacgccctggtgctgcgcagccgcttcaacgacgatccggacttcgccgccttcaccgaccgggtgcgccaggtggtgctcgacgcccaggaccatcaggacctgcccttcgaagtgctggtcgaggcactggagcccgaccgggcgctggatcgcaaccccctgttccagatcgccttcgcggtccagaacgccgaagtgccgccgctcgcgcttgacgggctcgacatcagggccgtcgagcgcgaggtgacccgcacccgcttcgatctggaactccatgtctggccgtcggagaccggctacgacctggtcgcctattacgccaccgaccttttcgacgcggccaccatcgaccggctgctcggccgctacgaaaccctgctcgccgccgccctggcccggcccgaggccccggtctcgatcctgccggtcgcgaccgcggatgaaacggccgccctcgccgcgctccgtgccggcccgccggccgcggccttccgtcccgtcaccgccgaaattgccgaccgggcggccgaggcccccgcggccccggcgatcctgcaccagggcgcgcccctctctcgcaccgatctggaccaggccgccacccgcctcgcccggcggctgatcgcggccggtatcgggcccgaagaccgggtcggcctgctcttcgaccgctcgcccgctttcgtgatcgcggcactggcggtgctgcgtgcgggggccgcctacgtcccgatggtgaccgactatccggacgagcgcatccgctggcagatcgccgatgccggcatgcgcgcggtgctggccgccgccgatcaggcaccccgcatcggggatgccgtgccggtgctggtaccggacgacgatacaggtgacggcgatgccgcggcccggctgcccgatccggcgggcatcgatgccgaccgtctcgcctatgtggtctatacctcaggctccaccggtcggcccaagggggtggccatcacccatggcgggctcgccaatctggtcgcctggcaccggcgggcctatgcacccgaccagaccacccgcatggcccaggtggccggcctcgccttcgacgccgccggctgggagatctggccggcgctcgccgccggggccgccctggtcctgccccagccgggcgccggccgcgatcccgacctgctgctggccgatttcgtcacccatcgcgtgacccaggccttcgtgccgacgccgcttgccgccccgctgctctcgcgccccaggcccgaggggttgaagctcgacctgctgctgaccggtggtgagcgcctggcgacggcccccgagatgcccggcgtgcggctgatcaaccattacggccccaccgagaccgcggtggtcgcgaccgccggcccggtcgatccggcagagatcgccgccggccgcgcacccgccatcggccggccgatcgacggcttcaccgcccatgtcctggaccgccggatgcgtccggtgcccttcggcgtggcgggtgaactctggctgggcggcgccggtctggcccgcggctatctgggccgggcggaactgaccgccacggccttcctgcccgacccgttctcgaccacccccggggcccggctctaccgcaccggcgatctggtggtgcggcgtgccgacggatcgctcgatttccgtggccgcgctgacgcccaggtgaagctccgcggccaccggatcgaaccgggtgaaatcgaggcggcgctgcgcgacgatccggcggtcgccgaggccgccgtgctgctggcgccggcaggcgatgcccaggccgccgcccggcttatcgccttcgtggtggcggacaccgccgccgacgaggccgaccgtgccgcccgcgaggccgagcgcgccgaggactggcgccggctttatgccgatacctatggcgcgctggacggcgacccggtgtttcgcatcgccggctggaccagcagctatgaccgcagcccgatcccggcccccgaaatggccacctggcgcgatgccacggtcgccgccatcgagcggctgggcggagagacggtctgggaaatcggttgcggcagcggtctgctgctctggaagctggcaccgcgccgccgccgctaccatgccaccgacttctccgccgaggcgatcgcgcatctgaaggccgatctggcccgaagcggcatcgatcacgtcacgctggagcgccgtgccgccgacgacatggccgaccggcaggcaggcccctgggataaccggccggcgggcccctgggatgcgatcgtcatcaattcggtcatccagtatttcccgggcgaggactatctgctgcgggtgctgcgcggcgcgctcgatgccatcgcgcccgaaggcgcgctctttgccggcgacattcgcgccgcccatgtcgagcgcggtttccagacctcgatcgccctgcatcaggcccccgcggccaccccggcggaggcgctctcagcccgcatcgccgatgccctggcggccgaaaaggaactgctgatcgacccggcctggttcctgacccgcgccgcggcactgcccggtgtggcagggatggacatccggctgaagcgcggccgcgaccgcaacgagatgacccgcttccgctatgacgtcaccctgttcaagggtgcggctcgggcgccgctggtgcccgaccggcggatggtctgggcggacggccccgatttccccgccctctgtgcgcgggtggcggcagagggtggccggatcgagatcctggacctgcccaatgcccgcactgccgccgacatggcggcggccgaccggctggacggccgccatgccacggcgggcgacatcgccgcggccgcagccgaagcggcgcgggatgccgtggatcccgaaaccctctggtcgatcgccgatgaagccggcgtcgccctgcgcatcacctgggccgaggatccggccctgatgcatgtgctgatcgaacccgccgccgtggccgaagatccgcgcccgccgctctgggcgccctggcggtcgatgccggcgcgcagcccgatcaacgacccgctggccgccggtgccgaccggcgcatgatccgccgcctgcgcgaccatctgcgccgccgcctgcccgaggccctggttccagccgagatcaggctgctcgaccggctgccgctcacccccaacggcaagctggatcgggccgcgctgctggcacggctcgccacccgacagaccgccgcccccgagaccacgaccgcccccgccggcgccaccgaggcgaccctctcccggatctggtgcgaggtgctgggcgtggccgccatcggccgtcacgagaatttcttcgaggccggcggcgattcgatcctgtcgatccaggtcgcatcccgcgcccgcaaggccgggctgccgctggccgtccgcgacctcttcgcccatcagaccctggcggaactggccggggcgctggacgcccgcgccgaaaccgatgccggccgcgatgcctgtctgccggtcgacggccccgtgccgctcacccccgtccaggcctggttcctggaccgggaaccggtcgatccgcatcacttcaaccaggcgatcctgctgaccctgccggccggaaccgaggatgcggcgatccaggccgccgtacagacccttgccggccgccatgatgcgctgcgcctgcgcttctccccagacggcagcggccggatgatgcagcaggcgggcccggtggacggtgccacccggttcgacagcatcgatgcccgcttcgacgactggagcgcccatgccgcccgggtccaggcggggctcgacctcgcccgcggcccgctgctcagggtggtgcgctaccggacgggtgccggggccgaccgcctgctgattgtcgcccatcacctggtgatcgacgcggtgtcgtggcggctgctgctcgacgaactgcgcgagctgctggcgggcggcggcggcgccgatccggcgccggccccctccttcacccgctgggcggcggcactggccgatcgcgctgcccgcggcgccttcgacgacgagatcccgcactggcaggcggtcgcccacgccgcgacctcggcggcgggcctgccagtcgacgacccggccgcgcccgatctggtcgagcgtgcccgcaccacccatcgtgcgctcgacgaggctcgcaccgaccggctgctgcgcgccgccaaccgggcgctacgcaccgaggcagccgagatcatcaccgcggccgtcgcccgcgcgctggcccggctgacggccacttccctggccaccgcccccggcccggtcaccctgctgatcgaccgcgaaggccatggacgcgaggatctggtgccgggtctcgatcccgcccggatcaccggctggttcaccgccattcacccggtggcgctgatcgtcgatccggccgagccgccccgggccagcctcgcccggatcaaggacacgctccgcgctgtgccgcgccggggcgccggcttcggcccgctcatccgcgccgggcggatcgagaccccgccacccgcgcccgagatcgccttcaactatctgggccaggtcgatgccgcactcgatggcggcggcctgctggcggcggcaccggaaccggtcgggccgctacagagcccggcggccacacggttgcatgcgttgaccatcggcgcggcggtgatggcgggccggctcagggtcgaaatcacctggcccggcgaccgcatcgccgccgcccgcatggagcggctggccgatgatgtggtggccgaactcggcgccctggtcgatgtctgcatggcggccgatgccgccgggctgacgccctcggatctgccgctcgccgggctggatcagccgggcctcgatggcctgctcgcccggctgccgatcccggcggaggcggtggaaaccgcctggccggcaacggcacttcagcacggcctgctgctgcaaggcgcgcgcggcccggccgagggggcggcgctctatgtcgaacaattcgccttccgcctgcgcccgcccgtcgacaccggagcgctggtccgcgcctgggatctggtcaccgcccgccaccaggcgctgcgctcgctgatcctgcacgaggggctggagcggccgctggtggtggtcgcgcgacaccacaggcctgagatcgcgaccagcgaccatcgggtgcttgcaccggccgcggccgaagcggcgctcgatgccgcactcgcccgcgaccgcgccacccgcttcgatgccgcccgggcctgcccctggcgcctggccctgcaccggttgcccggggatgccggctctgatgaagatgtcggggcgggcgacatcgtgctggtctggagcttccaccacgccctgctcgacggctggtcgaccttccgggtgctggaagaggtgctggccgcctataccgccctcacccgccgcagtacgccggatctggcgcccgccgccccgctcgcccgcttcgccgcctggctcgccgcccgcgatccgctggccgaggagacctattggcgggcagccctcgacaatctgcccgagccgcagccgctgcccgggggccgccccggcgggtcggcgacggcagagcgccaccacgtcaccggccgcctgcctgccccggcggcggcacggatcatagaggccgcccggctgctgaaggtgacgccggccaccatcgcccaggccgcctgggcgatggtgctggcccgccatggcgaccgcgacgacgtcgtcttcggcaccacggtctcgggccggcccgaggcggtggcagaggtcgaacgcatggtcggcctgttcatcaacacggtcgccgtgcgcgtgcggatcgatcccgcccgccgcatcggcgactggctggccgagcttcaggaaagccgccgcgccgccaccgccttcgaggccgcccccctgggcctggtccagcgctgggccctgccgggagagcagcgccggccgctgttcgaaaccatcctcgccttcgaaaactacccggtcgccgaggcgctgaagggcgatgccgccaccccgccggtgctggacgtcgccgacaccgtctatgagggccgcacggaatatccgctgaccgtcaccgtgctgccgggcgacgggttcgcggtagacatcgcctatgatccggggctggtcgatgccgatgcggccgaccggctgctcggccagatgctgaccgcgcttgccggcctcacccgggatcccctggcccggctggccacagtcgacgtgctggatgcggccgagcgccggctgatcgccgactggtcgcagggccgcggcgcggcggcgatcgcggccggcttcgccggggatccggcaccggttgccgatgacgaccggccattgcatctgcgccttgccgaccatggggccggggagccggcgctgatccaaggcgatcgccggctggatcgcgcttggctcgacaccgccgcccgccgggtcgccgcccggctggttgcggcaggtgtgggcaagggcgatctcgtcgccctgctgatgccgcgctgccccgaactggtcgcggccatggtcggcatccatctggccggcgccgcctatctgccgctcgacccggtttatcccgatgcccgcattgccgcggttctgggccatgcccggccgcgggcggtgcttgcggatatggcggggctcggccgtcttcacgacctggccggcgccccggcgctgcggctggatgtcgccgccgtcaccggcaccggccccctgctccacccgctgccccaacccgccgcggactggcgggatcagcccgcctatgtcatctacacctcgggatccaccggcacgcccaagggcgtggtcgtcaccctcggcaatctcgcccggctgatcgatgccacccggccctggttcgatttcggacccggggacgtctggaccctgttccactcccccgccttcgacttctcggtctgggagatctgggggccgctcgcaaccggcggccggctggtgatcgtcgatcacgaccaggcccgcgacccggccggcttccatcgcctgctggcgcatgaaggcgtgacggtgctgaaccagacgccgagcgccttcgcagccctcgacgcggccgatgccctggcggcaggcgtcccggccggcccggcactcgatacgctgcgtctggtgatcttcggcggcgaggccctggatgccgcaagccttgccggctggttcgcccgccatggcgacgaccgcccggcgctggtcaacatgtacggcatcaccgaaaccaccgttcatgtcacccatgcccggatccgcgcgccccacgccgctgaaaccggcacggcgccgatcggcgtgccgatccccgatctcaccctgcaactgctcgaccatcaggggcgcccggtgccgatcggggcggcgggggaaatccatgtcggcggccgcggcctcgcccgcggctatctgggtcgcgacgacctgacggccgagcgtttcatcaccaccgccgacggcacccggctctatcgcagcggcgatctcggccgctggcgcagcgatggccggctcgatcatctggggcggatcgacgcccaggtgaagatccgcggtttccggatcgaaccggccgaaatccgcgcggccctcatcgcccatccggccatcgccgatgccgcggtggcggcccgggccggcggcgcggatggggaattgcggctggtggcctggatcctggccgacgaggtcccggaagatctgcgcgaccatctgaaggcccggctgcccgactggatggtcccctccgcgatcatgccggtggcggcgctgccgctcacccgcaacggcaagctcgaccttgccgccctgcccgacccgtcaccggtcgccggcagcggcggtgcggcgcccgccacggcgaccgaagcccggctggcccggatctgggaagagctgctgggcgtgccggcacccggccgccgtgatgatttcttcgccctcggcggccattcgctgctgctcgcccgcctcgcccaccggattgcgcgggaattcggcgtcaccctggactggccgaccctcttcgccgccaccagcctcgaagcccaggccgacaggatcgagggcctggccggcagcgatggcctgccgccgctgcgcccggtgccgcgcgacggccggccgctgccgctgtcggccgcccagcgccggatgctgttcctgaacgaggccgcccccggcccggcgcacaccatcccgctgctgctcggcctgaccggccctctcgatctcgcccggttgcaggcggcgatcgacgggctcatcacccggcacgaggcgctgcggtcgcgcttcccgaccgtggccggccagccggtccagctggtggcgcctgcggaaccgcagccgctggtcgtggtcgagcccgaggatgcggccgaatggatccgggccgaactcgcccggcccttcgatctggcgaacgagcccgccttccggtgcaccctgctcaggcgtgggcggcaggatcatgtcctggtcgcctgtctgcaccatgtcgcgggtgacggctggtcggtcgggctgctggcgcgcgatctgggcgcgctctatcagggcgacgccgacctgccgccggtggtgatcggatcggccgatctgggtgccgccgaggccgatccccggcggatggcggcggtggatgcggcgctggaccggcgcgccgtggccctggccgggctgccggtgctggacctgccgaccgaccggcccagacccgacatccgtcgcggcctgggcgcctgccacgggttcaccctgcccgccgccctggcagaggcggcccgcagccttgccaccgcccggggcacgacgacggccgtggtgctggcggcggcccaggcggccctgctcggcggccttgcccaggccgaccgcttcgccatcggcctgccggccgcagagcgcctggcgcccgagaccgccgagaccgtcggcctgctggtcgaaaccctggttctggcggtggatctcggccaggtcagcggggccgggctgatcgaccggctggcggccgagatgcgcgccgcgctgggcgcgcggccgctgccgctcgaccggctgatcgaccggctggcgccgccgcgcgatccggcgcgcacaccggtcttccagaccatgttcggccatgaacgtctggccgcccacgggctcgacatgggccccgatctggccgcagagctgctcccggcgcccatggccggcgcccgcaccgatctcaccctgatcctgaccgaccgtgcggatggcgggctggacgggttgatcgaatacgacaccgacctgttcgaagcggcaaccatcgaccgcctggccaccggctatgcccggctgctggccgccctgatcgcggcgcccgaccggctggtcgcacagctgccgctcggcgacccggccccggccgtccccgcatcggccccgcggcctgccggcccggctgcggcgttccgcgccgtcgtggcggcccgcacgcaggcgatcgccatcagccatgccgacggcacccggatcgactatgccgatctgctcgaccgcgccgacaggctcgcccgcgggctgacagcccgggggctccgccccggcacccatgtcgggctctatgccgaacgttcggtcgcgggtatcgtggcgacgctcgcgatcatgctggcgggtgccgcctatgtgccgatcgatcccgcctatccggccgagcgtcaggcgatcctcgcccgggatggcgggctggaggcgctgatcctgccccgaaccgcccccctgcccgactgggcggccggcgttggccggatcgttcggatcgaccaggatggccgggtcgatcggcatggcagcggcgatctgcgcatcaccggcacgcccgcccccgacggaccggtatcgccggaggccgtggcctatctgatgttcacctcgggctccaccggccggcccaagccgatcgcggtgccctggcgggcggtgatggtgcgtgcgatcgccggcggctatgccgcgatcgggcccgagacggtgatcccgcacatctccaatccgtccttcgacgcagcgaccttcgagatctggggcgcgctgttcaacggtgcccggctgcatctcgtcgatcagccggtgctggtcgatccgggccggctggccgatgaactgacgactgccggtgccaccctcgccttcgtgaccacctcgctcttcaaccgcatctcggaacaggcgcccagcgctttcgcggacttcgatcgggtgctggtcggcggcgaggcggtgcagatgcgctggatccgggcggcggcggccgcctgtcccgccacccgcttcgccaatatctacggccccaccgaaaccaccaccttcgccacggtcttcgacatcgacgatgcggcgatcgatgccgccccgatcggccggccgatcgccgacaccacagcgcagattctggaccaccatctccggccgctgcccgatggcgtgcccggggaactctgcctgggcggcgccggccttgcccatggctatccgggcgatccggtgcgcacggcgctggccttcgtgcccgacccgttcgccaccaccccgggggcgcgtctctaccgcaccggcgaccgggtggtgcgcgatgcccggggcaggctccgctatctgggccgccgcgacggccagatcaagctgcgcggccatcgcatcgagcccggagaaatcgccgccgcggcgcacaccgttccgggcgtggcccaggcccatgcgatgctgcgccgggacgacgacacaccccggctggtgctctacgcaaccggcaccaccaccccggcggcacttgcaaccgccctccgcggcctcctgccgcgctggatggtgccctcggcggtgctggtgctcgacagcctgccggtcaccgccaatggcaagatcgataccgcccgtctgccggcaccgccggcggtcgcagcggacaccgtggcggcgaccggcggcggcaccatcgaccggctggcggcgatctgggccgccctgctcggccatcgcacgttcgggccggccgacaacttcttcgatgtcggcggtcattcgctgctgctggtcgatctgcgtgcccgcatcgccgaggagctgggggtgacgctggccatgaccgacttcttcgccgccccgaccctggccgatctggcccggcggatcgacgagggcgcgacgccggcgacacctgcccggccgggcgccgccgccgatcgcctggacggccgcagccgtcttgccgcccgccgccgcagaccctga

SEQ ID NO: 46 - DNA, 5118 bp, Tistrella mobilis
atgatccccgccgacgaccacagcatgaccaatgccgggaccgcgccgtcgcccaccgacatcgcgatcatcggcatggcctgtcgcgtgcccggcgccgacgggcccgaggcgctggcgcggctgctggccgaggggcgcgagggcatcgccgatctgcccgccgatgacggcatcgacgatccgcgctgggtgcggcgcaaggggctgctggccgatcccttcggcttcgatgccgggctgttcggccatgccccgcgagaggcggcgctgatcgacccgcaggcgcggctgctgctggaactgggctgggaagcgctggaacgcgccggccagccgccccgggcaaccgagggccagggccgcaccgccgtctatgccggcgccggcatcagcacctatctgctgacccatctgctcaacaatcccgcggcggccgatctcgccacacccttcgaggcggtgctcgccaattcgggcgacagcctggtgacgcgcatcgcctatgagctggatctgcgcggcccggcggtggacgtccagaccgcctgttcgacctcgctggtggcggtgcatctggcggtgcaggcgctgattgccggcgaatgccggatggcactggccggcggcgcctcgatcgacctgccggcgcctgccggctactggtacgcgcccggcatgatcctgagccccgacggccattgccgggccttcgcggccgatgccgccggcacggtgccggcctcgggcggcggcatggtggtgctgaaacggctggtcgatgcgctggaagacggcgaccacatccatgcggtgatccgcggctccgccaccaacaacgacggcgccgcccggatcggcttcaccgccccgggtgtcgagggtcaggccgaggtgatcgccgaggcgctgacgctggccggcattgcgtccgagcagatcggcatgatcgaggctcatggcaccggcacaccgatcggcgacccgatcgaggttcaggcgctcacccgcgccttcgggcccgaggtgccgcgcgggcagtgcctgctgggctcgatcaagagcaatctgggccatctgaacgcggccgccggcgtggtcggcctgatcaaggcggtgatggcggtcgaggccggcatggtgccgcccaccctgcatgcggaccagcccaacccggccctcgacctcgccgccacgcctttccggctggcgacggccctcagcccctggccggcgatccccgggccgcggcgcgcgggcgtcagctccttcggcatgggcggcagcaatgcccatgtggtgatcgaacaggccccgccgcaccccgtgcgcccggccgccccggcccggctgctgtgcttcgcggcggcgaccgccaccgcactcgaccgcatgagcatggccccgatcccggcgacggccgatgccggcttcaccctgcttgccggccgggcgcgtctgccgcatcggcgggtgctgctgcagctgccggatggcgggatggagacgatcgacggtcaggcccccgaccagccggtgaccgtggcgctcgcccggcccgatgccgccgtcgccgccggtctggcggccctcggcctggacctcagccccgatggcacgctgatgctggaggtcgagggccgcgacgagaccgcgctcctccgcgccgtcgcccgcgcctggacgcagggtgccgacatcgatgccgtccggctctacggtcccggccgccgccggctgccgctgcccggctatccattcgaacatggccatcacgagatcccgcgccccgccgccatgccgaccgcggccgatccgctggccctgccgcccaggctggccgatccgaccgactggttctggctgccggtcagccgcgaaatcccgccaccttcggtcgaggcagaggcggcgggcgccgtcatcaccggcccggtgctgatcctggcggacgcgctgggggtgagcgcgatcctggccgatcggctgcgggcggccggccacggcgtcaccctggtcacgcccggcagcgcgttcgccgcggcggggccggaccgtttcaccctggatcccgcggatccgggccagttccgcagcctgatcgcagcgctcgacgccgagccgcgcaccatcctccatgcctgggcgctgagggggccgaggccacccgccgccggggtcgagaccatcgccgcggtgcagagccgggggctgcatgccctgctccacctgcttcaggccctgggcagcccgggcacggggccggaacgccggctgctggtggcggccgaccggctgctgccggtgacggacaacgacctccggcccgatcacgcgccgctgctgggggccgccaagatcgtttcgcaggaatacgaccgcatcctctgccggatggtcgatcccggcaccgccgcaccggcgcggctggccgatatccttttggccgagctgaccgagggggcggaggcgccgcgcgtgaccagctggcgcggcggccggcgcttcgtcggcgaagaagccccgcgacggctgaccggggatggccgggcgcgtttcgtgcccggcggggtgacggtgatcaccggcgggctgggcggcatgggcctcgcctttgccgaagaggtggcggagcttgcccccggcggggcgctggtgctgatcggccggtcggtcttccccgaccccgaagactgggaggactggctggtcgagaatggcgagaccggccgcatcgcccgcagcatccggcgcctgcaggcgatcatcgcccgcggcacacggctgatggtggcgaccgccgatgtggccgatgccggcgcggtcgaggcggttctggccgaggcgcgccgccgcttcgggccgatcaccgccctgctgcacaccgcggccctcgccgattatgaaggcgtgatccacggccgcgcgcgggcgcgcaccgaccgggtgatggccgccaagcttcagggcacgctggtgctcgaccaggcgacgcggaacgatccgctgaccctgttcctgctctgctcctcgctcggcaccgtgctctaccatgtgaagttcggccaggtcggctatgcggcggcgaacgagttcatcgacgccttcgcccgggcgcgggccgccgaccccgcccgccccggcgccacagtcgcgatccgctggtcggactggcgcgacagcggcatgtcggtggcggcgctcgcccgctgggcggagcgcaccggcatcgacgagagcgactatatctcggacggtctgaccgatctggaaggccggctggccatgcgccgcgccgcgggccaggcggcgccgctgatcggggtgtcgcagcacgacctgcggatgctggttgcccaggatccgctcagggcaaaagccttcctggcggagaccgatcgcgcccatgcaaggccggcgctggcgcaggattacgtggcgccgcgcacggcggccgagcgcgaggtcgcacggatctggcagcggctgctgggcatcgaccgggtcggcgcgctggatgatttctatgatctgggcggccattccctgctcgccacgcaggttctgtcgcggatcaccgagcggctgaaggtcgaggtgccgctggatgccttcctggacgatcccacggtggaagcgctggcagggctgatcgacgcggccgaggcggcccgtgccgccaccaccgccgcggccgggagcctgccggccgaaactgcggatgatgacgggccgatcccccatgccggccggccggcggaggggctgccgctgtctttcgcccaggcgcgctgctggttcctggaccagatggagccgggcagcgccggctataacatgccgatggcgctggaggtgacggggccgctggaccaggtggccctggcgcacagcatcgacctgatcctggcccggcacgaagggctgcggacgctgtgtgtcgtgcgggatggcgagccgcgccagatcgtggtgccggagcgcaggggcgttctggagatccgggcggcagccgagccttcaagcctgcaggccctggccgaggccgaagcccgcaaagcctttgacctgacgcgggacatccccttccgcgccgccctggtgccggtcgggcccgagcggcatctgctgctgatcaccatgcaccatatcgcatccgacggctggtcgatgggggtgttcctggacgagctggcgcggttctatgccggctttgccgcgggccaggtgccggccccggcgcccctgccggtgcagatgccggatgtggctgcctggcagcggcagcgctatgccggcggccggctggaggcgctgaccggctggtggcgcgaccggctggcggggctgcccgatctggtgctgccgaccgaccggccgcggccgcccgtgcgcagcgatgccggcgggctgatcgcggtgccgctggaccctgcggccatggcccggctgcgggcgctggggcgggcggagcgggcgagcccattcatggtgctgctggcgatcttccgccacctgctgggccgctattcggggcaggaggatttcgcgatcggcacgccggtggcggcccggtcccggcccgaactggagccgctgatcggctttttcgccaacacgctggccatccgcagccgcataccttcagatgcaagcctgcgccgggcggtggcgatcgtgcgcgaggatgccggccaggccttcgcccgccaggacctgcccttcgaccggctggtggaagagctgggcatcgcccgcgaccccgggcgcaaccccgtgttccaggtgctgttcgtgctgcagaatgccggccgggcgaccccgcgggtggcggggctggagctgacgccgcttaaggcggataccgccaccgcgaagttcgacctgacgctgtcggtggtgccggggcccgtggcggagggggccgagaccgaggattacaaacaggcgttgttcgaattcgccaccgacctgttcgatccggccggaatcgagatgatgggagcatgtttcgccgaactggtcatgcgactttcggttgaagccgacgcgccgatgtcgtccattgcgctgactgccgcggggatggcggccgcagccgatgacgacggctggtga

SEQ ID NO: 47 - DNA, 4842 bp, Tistrella mobilis
atgacccgcgataccaccgacgccgacctgacggcccggctcgcagccctcgaccccgcccgtcgggcgctgctggaacggagcttggccgcccgccgggcgatgccgcccgcggatctggccggcgccgttgcgcggatgctggcaggcagccccgccgcccgggcgatggtctttaccctgcgggaactgggggtcggaaaaggcggggtcgtcggggtgcttttagccgaaacggctaagcacgggcccgaaatagccgcaatggctatttccgcggggctggccaccggcgccgatgtgctggtggcggcagatggcgatcggatgccgggcgacatgatcacgctgccctcggccgacctgccctggcccgaggtgccggcgaacaccccggcggttgcagcggaaccggttggacgggtgctgatcgacgggtcggatgggtaccagccggtcgatctggcggggcgcttcgcccggctggcggagatcttcgccggggcacgacgggtggcggtggaaagcgggaccgacgacccggatgccgtggcggcgctgatgcttgcggccgcaggcgggctgggcctgaccgggatcgaagcggcgaccacccggccacgggccatgctggcgcggctggccgcatcgccggcccaggccatggccatccggcccggatcgctggcccggctgatcgaggccgcaggcggcagcgaccatccgggcctggcgggcattgcggcgatcgatttcggcggggcggcggtgccggcggcgctggtggcgctggtggcgaagctgcagggccggcggctgttctgccattatgccgatggtagcggtgcgccgctggccggctgggagatcgacccggcgctggtgacgggagagaccgcaccggcggggcggcccctggccaagggccggatccggatcgtggacggcagcggcgccatggcgccggccggcatggtggggcggatcgagatccgcgctgccacggagggggataccgcagagggaggggccccctgggtggcgaccggcgatgccggacggcgcacgcgcgacgggctgctggaaaccctggcccggccggatggccggctgcgccgggacggccggctgctggacctggccgcggtggaacggcggatcgcccgcctgccgggggtggcggatgcgcatctgcgcctgcgccgcacggaagccggcccggttctgctggccgccctggtgccggccggtgcgcccgagcgggcggcggccgccctggccgccctgcccggctggtgccggcccgaggcggtgcagctggtcgaccatctgccgctgaccgccgcgggcgagatcgatacggcggcgctggaccagctgccggtgcccgacgaggccctgctggaggcggcggacgccgccctggcccccgcccccgcgatgaaggacccggacgcggtggacctggcgcggctggcggtgctgccgcccgcaccggaccggcgcgcgccgccgcccgaaaccctggtcgccaccggcgcgccgctgcccaggccgcgctttcgcaccctgcccgagattctggaccatgcggcagaccatgcggccgcacgcgggatcgggatcatccgcgacggccgcggtacgatggagcagatcgaccatgccggcttccgcgaccgggtgcggcttctggcgggcgggctggcccgcgccgggatcggccggggcgaccggctgctgctggtagtggcggagatcgccgactatctgaccggtttctgggcggcccaatggctgggtgccgtgccggtgccggtgtcggtggcaggcagctggaccatagaggacggcaatgccgccaagctgctgcagacccgccggctgctgggccatccgccggtgctggccgatcgcggccgcgccggcctgattgccgatttcctggcggcccacgaggacgacatgtcggcggggccggtgctggacccggcgctgctggccgaaggcggcgccatcgaagaggcggtggcggcggacccggatgcgccggcaatcctgctgctgacctcgggctcgacaggtgcgcccaaggcggtggtgcagacccatcgcacgctgatcgcccggaccaccgcgaccatcgcccatcgcgactatggcccgcaggatctgtcgttcaactggatgccgctggaccatgtgggcgcggtggtgatgttccatctgcgcgatctggccgcaggggccgggcagatccatgcgccgatcgatctggttctggccgagccgctgaactggctgcgctggatgagccgcgaccgggtgacggtgagctgggcgccgaatttcgccttcggcctgatcgtcgccgaggcggcgcggccgggggcgctggacgggatcgacctgtcggcgctgcgcatcctgatcaatgccggcgaggcgatcgtgccgcgcaccgcccggcgcttcatcaccgccctggccccgcacgggctggggcctgcggtgatgaagcccgaatggggcatgtcggaaacctgctctgccgtgatctgttccgacggcttcaccctggagggcaccacggatgacgacatggccgccgatctgggcggccccgtgcccggcaccgccttccggatcgtggaggcgagcggcatgctgccggtggggcggctgcaggtgaaggggccgacggtgaccccgggctatctggaaaaccccgaggccaatgccgaagcctttaccgcggacggctggttcgacaccggcgatctgggcacgatgaccggaggccggctgaagatcaccggccgggccaaggacgcgatcatcgtgaacggccgcaatctgcacgcccacgagatcgaggcggtggcggaagaggtgccgggcgtggcggtatcgtggacgaccgccttcgccaaccgcccggccggggccgataccgaccggctggtggtgacctgggttcccgaagaaccggtgatcgatcgcgaaaccgtggccggcgcgatccgcgcccgcatcgcccgccggctgggggtgaccccggcggcagtggtggcggtgcggcgcgaagacgtgcccaagacggcgatcggcaagatccagcgcgcccgtgtccgcgccgattacgaggccggccgcttcggcgggctggtggcggcccccgccgccggcgcgcccgaccagggcgttgttgacctgccgctggcccggccggtctggcggccggcggccctgcgccggcccgatccggcgacgcgggcggtgatccaccagtcagacggcggagatgccgtggcggcgatcgcggccctgcgcgaccggctggcgccgctgctgactgagggcagcggccgattgcgggtggtgctgggggtgcgcgggctggaggcgatcgaccccggcgacccgacgcccgaaccggccacggcggcgctggccgcctgggcggcgagcctggcgcaggaaaccgcgcggctggaactgagggtggtggatctggacccgggcgccgatgccgcggccagagaggcggagctggccgaagaggccgggcatgccgaccccgaaccggtggtggcccggcgcggcagccggcggctggcccgccgtctggaaccgctggacatggacctgcctgcaccccgggtgctgccgatcacggcgggcggcatctggctgctggccggcgggaccggcgggctgggggtggaactggcggagctgctgggccggcgcttcggggcgcggctgctgctggtctcgcgcagcgatgccacggcggacccgatgaaggcggcgcggctggcgcggctgagcgcggccggggtggagcatctggcgatgaccgcggatgtaaccgaccgcgcagcgctggacgcggccattcatgcggcccggagccattggggcgcgccgctggccggtattgtgcagatggcgaccgacggggcgctggacgcacaatgggcggagatggccgatcgcggcgggctggccgacagtgatgcggcgctggcggcgaccatcggcccgaaactggagggcacccgcaatctggtcgcgatcgcgcgcgaccatggcgacctgccgctgatcggcttcggcacggtgaacgcgctgttcggcgcgccgacgctgggcgcctattcggccgccaatgccgccatggcggcggtgctggccggcgaacgcagccgccgccaggccatcgcaacggcggcaaccgggccggtgacgaccatcgactggtcgatgtgggacgggctgggcctggcccagggtgccccggaacccgcccgcgcccgcacccgggcgctgggctaccggatcatcggccgcagccagggcctgcgggcgctgctggcggcgctggcgctggaccggccgcgggtggtggcgggtgtggatgccggcagccacccggtgatgcggcggccgcgtgcggcaccgccgcggccgctgctggtgccggtgacccggggaagcgtcatcaacgccaccgaccgtttcggccggcgggtgacgatcggcaccggggccgccgccccggccgggccgggcccggttgccgacccgccgcgcgggccggtcgagacccggatcgcggcgctgtggtgcgagctgctggaacggccggcgatcggccggcacgagaactttttcgagatcggcggccattcgctgctgctggcccggctgcgcgcccggatggtgccgcttgccgggcgcgagatcggcatcgttgaactgttccgccaccccaccatccgcgacctggcccgcctggttgccgcagacaccgccgagatcgaggccggggaatga

SEQ ID NO: 48 - DNA, 4242 bp, Tistrella mobilis
atgaccgtcgacaccgccgacaccgcgcagagcttccccgtccacaccgtgccgatcgccgtgaccggccttgcctgccgcgcaatcggcgtggacggccccgatgccctgcgccgggtgctgctggaagggcgcgacgtgctggcgcgccatgatgccgccgatgccgcggccctgggcgtgcccgccgccctggcgcgggatccgcgctatgtcggcaccgcagcgatgctgccggggcaggagagcttcgaccacgcgctgttcggcctgtcgctgcgcgaggcggagctgctggacccccagcaccggctgttcctggaactctgccgcgaggcgctggaagatgccgcctggcttgccccggcggccgggcgccgggtaggcgtgttcggcggctgcggcagcccgatctatctgatgacccggctggccggtgccggtgcggcgctggaagcggcgggtgcgacggcgctgagctttgcggccaagccggatttcctgtcgctgcgcgtggcctatcggctggatctgcgcgggccggcgatgaccgtgcagaccggctgttcgaccggcatgagcgtggtgcaggcggccgtggccgccctggcggccggcgaatgcgaggccgcactggccggcgccgcctgcctgacccggctggacccggccggctatctgcaccatccgggcgcgatcgaaagcccgaccggccgctgccggcccttcgacgctgcggccgacggcacggtcggcggcagcggcggcgcggtggtggtgctgaagcggctggccgatgcggaacgcgatggcgaccatgtccatgcggtgatccgggcggtggcgatcaccaatgacggcggcgccaagatcggcttcaccgcgccgggggaagcggcccaggccgaggcggtcgcacgcgcattccgtgcgtctggcattcaccccgatacgattggttgcgtggaagcccatggcaccgccacggcgctgggcgacccgatcgaggtggcggcgctgacccgcggcttccgggccgccggcggcacgcgcctggcccatgcggcgctgggatcggtgaagggcaatcttggccatgccgatgcggcggccggcatgctgtcgatcgccaaggcggtgctgtcggtggcccatggcgagatctaccccaccgccaacaccaccagggcgaaccccgaattgcggctggccgaaaccccgttccgcctgccgaccgcacccgaagcctggcccgtcgccgaccatccccggcggatggcggtgaactgctatggcatgggcggcaccaatctgcacgccattctggaacaggccccggccaggaacccgcgcgcggcagcgcccgcgggcccgctggtcttcgtgctgtcggccgcagatgcggagatgctggaggcgctggcggcccggatggccgcggccttcagggccgatgatgcgccggccgccctggatgccgccttttcgctggccaccggccgaccggccctggcggcaaggcgggcggtggtggcgcgggatgtggccgaggccgcgcggctgctgaccatgcctgcccctgccctgccggtgctgcgcgaccggccggtcgtgatcgacggcgccgatgccggctgggcggcgctgctgcccgatctgaccgacagccccgatgcccgcgggctggtcgacggggtggcgccggcgcggttggtcttcgggccggacaatgcgccggggggcgatccggcagatccgctgatcgtggatggccgcgaccggatgcaggcgctggcgcggctgtggtgcctgggggtgcgggtcgactggacggcggtgtttgcaggcaccagcccgcggcgggtgccgctgccggtgatgccctatcgcccgacccgctgctggatcgacctggcaccggcggagcccgcgaccgctgcggccgcggcgccggtggctttgacacccggtttcgtcgaggccccgcttgccgccgggacggcgatgcccgcaaccatcgtcaccggatgtgccgcgccgacgaccggccttggaaccaccctgccgctggccgaggccggtgcagtgaccgggcgggtgctgctggtgctgcccggggcgctgggcctggccggacgccggccggccgaccccgaggaactgcggcaggccagggccttgcatgaccggcccggcgtggagctgacgatcatcgacacggccgcggccgtggatctgccgccggccgccgcggccgccctcgcggcccgcatccgcgccgaggcggcgggcgatgccccggcggtcgccttcgacggcgcccgccggctggtgccggtggccgaagcggtggccgccgacgaggcggcgccgctgacggatgacggctggccggcaccggaaacagcagggccggagaccgcaggaccggagctggccgaacccgcagcttcggccgccgcggcccggcttgccgccctgccggtggaaccggcgcgcgggccggcgctggaggcggcattggaccggctgtgcgccgcgcacagcgttgccatgctgcgcacaagggggatcgccccggtgcccggcgccaccatcacccgggccgagctggaccggcggatcgggctggtgcagggacagggacagttgggacaggggcagggatggcgccgcatgctggacgcggccctggccgatctggcggcggacgggctgctgaccattgccggcgaccggctgatctgggggccggcggtggccgatctgccggcgccggatgtggcggcagaccgggtgcgggcgatcgaccccgatcatgccgggctggtggcgctgatcaaccattgcatggcggcccatggcgaggtcttcgccggccggcgcccggccaccacggtgattgcggggcgcgaggccgggcggctgtttgcgggcgccggcccggcgatcgagcgccattccagccgggcccgggtgctggatgccgcggccgatgcggtggtggcggcggtggatgccgcagccgccgccggacgcacggcccggatcgtggaggtgggcggcggcacgggggccttcaccggcccggtgctggaccggctggccggccgggcggtcgactatcttttcaccgatgtgtcgggcgaattcgtggcgcgggcgcgggcgacgctggccgcacgcgggctgaccggggtgcgggtggcacggttcgacgtgtcgcgcgacccggcggatcaggggctggagacggggggcgccgatctggtgctggcgctggacgtgatccacgccaccgccgatctggccgtctctctcgacaatgtcgcgcggctgctgcggccgggcgggctgctgctgctggccgaactggtcatcgcccggcgctgggtgaacgcgatctggggccttgccaccggctggtgggtgatggcggatgaccgcaccacctctccgctgatcgatccggccgcctggcagcgggtgctggaaggcgcgggcttcgcgaccgaggcggtgctgcccgataccgacggcgccgatacccgcctgttcatcgcccgcaacacccgcacgaccctggctgagctggcgctgtacgagggcgagttgccagagcccctgccccccgccatgcgacatgtgctgatacgcccggccgcggcgggtgatctggtcgccgccgccctggccggggccgaggcgcgggcgctggaatgggcgaccggcgccgaagcagtggcctggaccggcgacggccggcccgatgcccggctgcgcggcctgctgcggcatacgcgggccgcggtgctgatgccgcctgccgccgccgatgcggcgggggcggcagcggcggcggcggtggatggcgatgcggccttcgccctggtggcggggctgtggcacgacctgctgggggtgatgcccgaggatgctgccgccgatttctacgccgccggcggcgacagcctgatcgccacgcgcctgctggcgctgctggccgaacgccacgggctggagttgccggcctctgcgctgtttgcggcaaccacggcgggcgagatggccgggctgatccgtgccgcggccccggcggcggcggaaccggccgcgatggagagcgatgccgacctgctggacctgctggccgatatcgagagcatgtcggatgacgagatcgccgccgccatggcccggctggaggggcaggaaccggatgggcgggaggtcgccgaatga

SEQ ID NO: 49 - DNA, 3861 bp, Tistrella mobilis
atgaccgcggatatctccgcccggctggaccggctgagcccggcgcagcgtgcgctgttcgaacgcatgcgcggcaagcgcccggaccctgccgctgcgcctgaaacagcgcccgacaccgcgccagaggcggcgccgctgtccttcgcgcaggcacggctgtggttcctggaccggttgcagccggggagcccggcctacaacatcgcctctgccgtcgagatccgcggagagatcgacccggcggcgctggatgcggcgcttcagcaggtgatcgcccgccatggcgtgctgcggacgcggtatgaggagggggcggatggcccccggcagatcgtggacccggccccgcccggcccggtgctgcggctggccgatgcgccggatgccgcggcggcggcggccctggccacggcggaggcgcgccggcccttcgatctggccacggggccggttttccggctgctgctgatccggacggcacccgcccggcatgtgctggcggtgacggtgcaccatatcgccgccgatgcctggtcgctgggcattctgttcgacgagctgatggccgcctatcgcgcccggctggacgggctgccggcggatctgccggtgctgaccacctcttacgccgcctatgccgcggaacagcgcgcggcgctggatgcggcggccgaggcccggctgctggactggtggcgccaccggctggacgggctgccggtgctggactggccggcgggcccgccccggccgccagtccagcgtttcgagggcgcggcccggcgcttcgacgtgccggcggcgctgaccgcggccgtggaggcgctgggccggcaccatggcgcgtcgacctttcagaccctgatggcggcggcgcaggttctgatccatcacgagaccggccagcgcgatttcgccctgggcgcgccggtcgccaaccggcggcggcgcgagcacgaggcgctgatcgggtttttcgtcaacaccctgcccttccgggccaggttcgacgacgaccccgccttcaccacctggctggaacggctgcgcgacgatgcgcgcgcggtgctggcccatcaggatctgccgttcgagaaactggtcgaggcgctggaagacacccgcgaccccagccgcaacccgctggtgcaggtggtgctggccttccagaacgcgccggtcggcagcggtaccgcccccggcgggttgagcctgcgcgggctggagaccgatcagggcatcgcccgcttcgacctggagatccatctgacccgcgcccccggcggcgggctggcgggcatgatcctgtacgacaccgcgctgttcgatgcggcgcgggtcgaccggctggggcggcgcttcgtgcggctgctggagatggtggcggccgatcccggacagcggatcggcgatctggtgccgctgctggacgaggatctggcggcgatcgcggccgccgcccccgcggtgccgccggcggcggaactggtgccggtgcggctggcgcgcatggtggcggcgcgggcggcggcgccggccgtggaggatccgggcggcggcatcgactatgccgggctggatgcggccgcggcccggctgatgcaggcactggcgcgttcggggatcggccggggcgatgtggtggcggtgatcctgtccccggggcgggccgccgctgcggcggcaatgggcatctgggcggcgggtgccgcctatctgccgctggacccgcgccacccgccggcacggctggcggcgctgatccgccgcgccggcgcgcgggcggtggtggcgccggccctgcccgaaggggtggagctgctgccgcggctggatgtcgacgtcggcccggataacggcggtttcggcaatggcggggcggcggcgcgggcggcccggatcaacacggcggaggatgccgcctatctgatcttcacctccggctcgacgggcgagcccaagggggtggtggtgccgcatggcgcgctggcggggctggtcgactggcatgtgaatgccttcggcacggggccggccacccgggcgagcctggtggccggccccggtttcgacgccgcggtctgggaaatctggccggtactggccgcgggcggcaccgcggtcgcggcggatcccgccatgctggccgatccggcggcgctggccggctggctggtcgaccggcggatcacccaggccttcatgcccaccccgctggtcggcgggctgctgggccgggcctggccggcggagaccgcactccgcctgatgctggcggggggcgagcggctgacggaccggccgccccagggcctgcccttccggctggtcaacaattacgggccgaccgaggcggcggtggtcgcgagttcagggacggtgtctccggggccggcggcgagtatcgggctgcccgatatcggcggggcgatcaccggggcgcggctgcatgtgctgaatgcggccagccggccggtcggcatcgacatgccgggtgaactgcatgtcggcgggcgcgggctggcccggggctatgccggcgatccggtgcgcacggcgctggccttccggcccgatgccacgggcgatggcgtacggctgtatgcgaccggcgatctggtggtgctgcgggccgatggccggctggattttctgggccgggccgacgaccaggtgaaactgcgcggccaccggatcgagcccgcagagattgcggccgcgatccgcgcgctggacggcgtgcaggatgcggcggtgatcctgcgcgaggacggcgccgagccccggctctgcgcctacgtggtgtcgacggccgcaccggcgcggctggcccgccggctgcgcgaccggctgccgggctatatggtgccggcggactgggtgcagctggaccggctgccgctgacgacatcgggcaagctggaccggcgggcgctgccggcgcccgagatggcggcggcgaccggggcggtggcggaaaccgcggccgaacggctgatcgccggcatctgggccgaggtgctgggccggaagctgccgcccggccgcgacgatgatttcttcgccctgggcggccattccctggcggcggcacgggtggcggcgcggctgcaggcggcggggcggccgttgccgctggcaacgctcttccgcgccaccacactggcggcgctggcggcggagctggaggcggcggccgcgccggaggatgacgacagcatcgatctgccggacttcgcgccggtcgtcgacggcgaggtgccgctcagccccggccaggcgcggtggtggttcctggaccggctgggtgccgacccggccgccgcggtgatctcggcggcgctggatctgacggggccgctggatgtggaccggctggcggcggccttcgggcagatcgtcgcccggcatctgccgctccgcaccgccatcctggcggtggacgagcagccgcgggcagtgccgcagccggtgcccatgccctggccgctgccggtgctgccggtcgcggacgaggctgaggcaaacctgctggcacgggacctggcggcccggcccttcgatctggcgtcggggccgttcctccgcacgcatttgttgcggtttggcgctgagagacatctttttgattgtggttctgcaccatgtcgcggccgatggctggtcgatgggggtgctgatccgcgagctgcaggatctttatgccgggcgggcgccggcgccgctttcggtggattatcccgcaaccgcgcggcgggctgccgcgctgaccggccgggatctcgccttctggcgggatcgtctggacgggctgccgccgccgcaagcggtgccggggcggccggaaaacctgcctga

SEQ ID NO: 50 - DNA, 2622 bp, Tistrella mobilis
gtgccggggcggccggaaaacctgcctgacgccgccgatccggtcgtggtggtgcccctccccgaggccgcgagccgggggctggacgcgctggcacgccgggcgggggtgacgccgttcatgacgctgctgacggcggcacagatcctgttcgcgcggctgtggggcacgcgcgatttcgcgctgggcacgccggtcgccaaccggccggatccggcttcggaagccctgatcggctttctggtcaacacggtggtgctgcgcagttcgctggcgcaagccgaggacagcctggaccggctgctggcgcgggtaaaggccgataccatcgcggcgctggcccatcaggccctgcccttcgaccggctggtcgaggcgctggatgtcacgcgcagcggcaccgacaacccgctgttccgggtgctggtcgcctggcagccgggggatctggcgacacccgatctggcggggctggaggtgacgccccggccctcgcccctgatcggcacgcggctggatctggagatccacggccaggccgggccgggcggctggcatctggcactgacctacgccccggcacggctggcgcgcgcggatgccacggccatcggcacccggctggcgcgggtgctgacggcgatggcggcagagccggaccagcgctggacggcgctgccgatcctgggcgacgacgaagcggcgcggatcgatgcggcggcacgcgggcgcgcgatgacccatccgcgggtgctggacgagatcctggcgcgggcggcggaagaccctgccgccccggcgctgatcgacggccggagcagcatcaaccgccacagcctgaccgggcgggcggcggcgctggcgcagcagatttgcaaggcgcatggccgatccgtggggttgatgctcgggcgcggtcaggcgcatgggatggggctgctgggggtgtggctcgccggggcggcggcgatgccgctggatcccgatctgccggatgcgcggctgaagaccatgatcgagatcggccggccggcggcgatcatcgccgatccggcgcagctggcgcggctgcgcgcgctgaccgatctgccggtgacggtgctgcccgagggcgaggccggccccccgccggtgacggtcggacccgacgatcccgcctatctgctgttcacctcgggctctaccggcacgcccaagggggtgatggtggcctggcggacgctggaccaactgaccggctggcatcgcgcgcggcatcctgtgccggcgccgacgctgggctttgcacccctgggcttcgacgtgtcgatgcaggaggcggcgctcgcctgggccgaaggcagcccgctggtggttaccgacgagacggtccggcgcgatccggcggcgctgatcgctttcatccgcgcgcatcaggtcgcgcggctgttcctgccggtggtgatgctgcatgcgctggccgatcatctggccgcccatcccgagcggatcccgacctcggttgcgctgatcgcgacggcgggggagcagctgcggatcaccggcccggtgcgcgactggtgccggcagagccggttcgcgatcgacaaccagtacgggccgaccgaaacccacgtcgtggcggcggagctgctgccggccgacgccgtcgacgactggcccgaccggccggcgatcggccggccggtggatggcgcggtgctgttcgtgaccgacccggacggccgggttctgcccgacgaggtggcgggcgagctgctgatcggcggcacggccccggcgatcggctatgccggcgatccgctgcgcacggccgagcgcttcgtgaccggccccgacggcagcctggtctatcgcaccggcgaccgggtggtccgcggccgggacgggcggctgacctatctgggccgggccgacgaccaggtgaagatccgcggcttccgggtggagccgggcgagatcgaggcggcgctgggcgcccatgacgatgtcgcccaggtgctggtgacggtgcgccacatcgccggcgccgcgacgctggtcgcccatgtcgaacccagggtgatgccggccgacccggccggtctcgcgggccggctggcggcctggctgcaaacccggctgccggcaccgatggtgccggcgcgctgggtgatcagcccggccctgccccgatcggccaatggcaagctggaccgcaaggccctgccggcggtggacggcatccccccggggcagagcgtcggtgcggcaccggcgacggaaaccgagacggcgctggccaggatctggaccgcgatcctgggcgtggagaccgtgtcgcgcggcgacgacttcttcgcactcggcggccattcgctgcgcgcgacccagctggtcgcccgcatcgaacgggagctgggcatccgggtgcagctggcgacggtgttcgaacagccgacccttcagggcctggccgcggcggtggacgaggcgcgcaccgacgcgctcgccgacgatctggcgcttctggacgacgacgagcttgccgccctgctgggtgatgacgatctgagcgcccttctgggcgacgacgacctgagcgcccttgcgggcgacgacgatccggagaccgccgcatga

SEQ ID NO: 51 - DNA, 6492 bp, Tistrella mobilis
atgaccgacgccccccgcccctcggccgaggcgctgcgcgcgaaactgaaaacgctctcgcccgaacagcgcgcggcgctggaacgcaggctggcggcagccaaggcgggggccgctgccaccggcacggcaatcccgcgcattccgcgcgaccccgcgccggcggcatccttcgcgcaggaacggctgtggttcatcgaccggctggcaccgggcactgcggcctacaacctgcccgccgtgctgcggctggcgggcgcgctggaccaccgggcgctggaagacgccatcgggcggatcgtcgcccggcacgaggcgctgcgcaccgcgctggtcgaacgcgacggccggccggtgcagctgatcgccccgccgccggctgcctggccgatcgcggtcgaggatctgagcgactgcccggcggagatggtgacggcacgggtcgccgccgaggcagagacgcccttcgatctggcccagccgttcaagctgcgcagccggctgctgaaactggccgccgacgaccatctgctgctgatcaccctgcatcatgtggcatccgacggctggtcgctgggggtgctgaccgccgaaatcggcacgcattacgcggcggcacgcgcgggccgcgaaaccgacctgccgccgctggcctgccagtatgccgatttcgccgcctggcagcgggggcggctgagcggggcggcgcttgagcgcgagatcgaccactggcgccgcaccctcgacggcttcgtgcccggcgagttcccgaccgaccggccgcggccggccgagcagcgcttcgagggcgcggtggtcagccgccggctgccggcggcgctggctgcgaaggtcgatgccgcggcgcggcggcacaaggcgacgcccttcatcattctgctcgccgccttcaacgccctgctcgcccgctggtcgggcgaggtggatgtatcggtcggcatcccggtcgccaaccgcacccatcccgatctggaggcgctgatcgggtttttcgtgaatgcgctggtggtgcgggtgccgctggacggcgacccgaccatggacgagatcatcacccgcagccgggcggcggccaccaccgcctatgaccatcaggacctgccctttgaacggctggtggcggagctggcgcccgagcgcgacccgtcgcggccgccgctgttccggatcgcctttgcggtgcaaaacgcgccccggggcagcgtcaccctggccgggctggaactgcgccccttcacggccgaaatcacccgcacccgcatggagatggagtggcatgtcttcgagcgccgcgacgagaccggcgccgcggcggggctggacctggtcgtcgcccatgcgaccgcgctgtttggccgggcgacggtcgaacggctgatcgacggctttgcggtgctgctggaagcggggctcgaccggccggagacgcggctgtcggccctgccggtgatgacggcggccatggaaagggcggtgatgaccgcgggccgcgggccggcccctgaggccatccccgcccccgacctcagccgggtgctggcagaacggctcgccaccgaccgggtggttgtggccgaggccggcggcccgcggctgaccggccaccagttgcaggcgcgggtggagcggatggcggcggcgctggccgcgcgcgggctcgcccccgaaaccccggtgctgctgctgatggatcgcggcatcgaccagatcaccgccaccctcgccatctggcgggcggggctctgccagatgccggtcgatccggcccagcccgatgcgcggctggcggcgatgatcgccggcggtgccccggggcttgcgatcagcgatcctgacggcctggcacggctctccaccctcgcccccgatttgccccgctgcgggccggcggaccttaatgccgagccgcggccgctgccggcggtgcatggcgaccagctcgcctggatgatcttcacctccggctcgaccggcacacccaaggcgacgctggtgacccatggcggcgcgctcaacaccggtttcgcccaggcgcggatgctggggctggggacggaagaccgggtggcgcaactcgcctcgcccggcttcgatgccgccctttcggaactgctgatggcgctgatcgccggggcggaactgatgccggtgccggcggcggtggcgcgcgacccgctggcgctgggcgatttcctggcggccgaacgggtgacggtggcgacgctgaccccgaccatgctggcggcgatcggccgggatctgcccgatctggcggtgctgctggtcgccggcgaggcctgcccgcccgaactggtccgccgcttcgcccccggacggcggatggtgaatgcctatggcccgaccgaatgcgcggtctgcgccaccatggcggtcgggctggacgcagaggcgggcccgccgccgatcggctccgcgatcgacggcgcggaacttctgatcctggacccgcgcggccggccggtgccggatggcgttgcgggcgaactctgcatcggcggggcaggcgtcggccgcggctatgccgggcgggcggacctcaccgccgaacgcttcgtgccccaccccgcccccgaccggcccggcgcccggctctatcgcagcggcgatctggtccgccgccggccggatggcgcgctcgactatctgggccggatcgacacccagatcaaactcggcggcaaccggatcgaacccggcgagatcgaggcggtgctgcgcgccgacccggatgtggccgatgcggtggtggatgtgatcgagatggagaggccggttgcggccgcgcccgcggatgcgggcagcggcccggcgatcgcgctccgccccgccgacgccctggccgatggccggcggctggaactctggccctcgatcgccgagcatttcgtctatgacgagacgctctaccacgccatgacccatgacgaggcccgcaacgcccattaccgggcggcgatccgcgccgcggtgccgggcaaggtggtcgtggatatcggcaccggcgccgatgccatcctggcccggctatgcgtcgaggcgggcgccgcgaaggtctatgcggtggagctgctgaaagcctcggccgacgccgcgcgcgcgaccgtgcggcggctggggctcgacgaccggatcatcgtcgtcgaaggcgatgcccggcgggtgaccctgcccgagcccgcagacatctgcgtgtcggaaatcatcggcccgatcggcggctgcgaaggctctgccgtcatcctgaacgatgtctggcggctgctgaagcccggggcggagatgatcccggcgcgcacggtgtcgatggtggcggggctggaactgccggccggtttccgcgaggcgccgggcttttccagcctgaccgccggctatgtgcggcggatcttcgaggatcgcggcgggcccttcgacctcaggctctgcctgaagggcatcggccccgatgatctgctgaccgatgccgccgtgttcgaggatctggaccatgccgggccggttgcgaccgaaagccggcatcatgtggtgctgaccacccgccgcgccggccatctgtcggggctgaccgtctggctgaaactggaagccgcgcgcggccgggtgatggacacgctgggcgagatctgctgctggctgccggtcttcctgccggtcttcggcgagggccggcccgtggccgcgggcagccgcatcgccatgaccatcacccgcaccctgcatgccaacggcatcaacccggatttccggctgaccggcacgatcgagatgcccgacggcaccagcgagcccttcgactggttctcgcccaatcatggtgccgaagcgggcttccgcgcctcgcccttctatcgccggatcttccccgaaacggcagtgcccgacctgcccaccccgaccgcgtctcccgccaccgatcgccggctggtcgcctgggtcacgccgcgcggcggggccgaccccgagggcgatgcggcgctggcccgcgaccgggtggaggaatggcgggcactctacgagaccgcagggccggccgcggcagagacggcagcagatccgacgccggagacggaccccggagacgccctcttcgccggctggaacagcagctataccggccggccgatcccggtcgacgagatgcgcgactggcgcgaccggacggtggcggcgatccgccgcgccctgccggcggggcgcccggcccatatcgccgagatcggctgcggtgccgggctgctgctggaaccgctggcgccggctgccgcctcgatcctcggcaccgatttctcggccgcgacgctcgccgggctggaaacccggctggcgggccatggctggggccatgtccggctggaacgccaggaagccgccgacccgctgccgatcgaccgcccggtcgatctggtggtgatgaattcggtggcgcagtatttcccggcgcccgcccatctggaaaaggtgctgctgcggatcggcgcggccctggccgggggcggtgccgccttcctgggcgatatccgcgatcacgggctggcggagatcttccatgcctcggttctggcctttcagtccggcggcgccctgcccgaccgcgacagcgtggcccgggcggtggcggcggatgaagagctgatgctggacccggcctggttccacggcctgatcggccgcatcccgggcctcgcccatgtcgaaaccctgatcaagcgtggccggggcgacaacgagctggtgcgctatcgctatgacgtgatggcggtgttcggcccggcccccgcggccatccggcccgaggccacgctgccctggccgggtgccgaagcgctggccgcgcgactcgccggcctgaccggcgcgctggaagtgaccgacatccccgatgcgcggatcgccgacgacaccgcccgcgggcagcggctggggctggtgtctgcaactgctacgggtgaacccgcccatcctgacagcctgcacgagatgggcgaaaggctgggccgggcggtgcggctggcgccggcggcctccggcatcgcaggcgcgatggatgcgctgttcgatgtgccgggcctcgccgacgacccgctggcccggggctggatgcgcagccccgtgtcgcggggccggttggcaaacgatcccttggcgcgccgccgcaagtccgccctcgccgaccggctgcgccgccgggcgcgtgaggtgctgccggcggcgatggtgccgcaggcggtgatggtgctggaccggctgccactcggcgcgtcgggcaagctcgaccgggcgcggctgccgcggcccgagacggcggccggccgccatccggcgcgcgatcccgcccgcgccctgccggccgaccggctggaagcggcactcctggcgctgtgggaagagctgctcggcaccgcgccgatcggggtggaggatgatttcttcgccctgggcggccattccctgctgggggtgcggctggtggccgaggtgaaggcgcggctgggcggcacggtgccgctggacctgctgatgcgcgcgggcagcgtgcgggcgatggccgtgcatcttaaggaggccggcgacctggcggacgacggcgagctggcggacgacggcgccgggacgggccgcctggtgccgctccgccgcgacggcagcggcgccccgctcttctgcctgccgccgggtggcggcacggtgttctgctacggcccgctggtcgaccggctggccccaggccgcccggtctggggcctgcaggcggcaggcgtcgagccgggcgagaccccgcatgaaagcctggaggagatggcggccgcctatctggcggcgatccgccgcatacaaccgaaaggaccgtatcacctgatcggctggtccttcggcgggcatgtcgcctatcagatggcggcgatgctggaggcggcgggtgaagaggtcgcgctgctggccctgctcgacaccttcccgcccgaacatgtgccgcgggtggatgaacgctaccggcgcgaggaagcctatctcgcctatctggccgggctggccgggcttgcggtcgcagaagacgagctggcaccgctcacctcgccggcgcgcctccgcctggtggcggaccgcgcggtcgcggccggcgccctgcccgcccgcgacgccgagggcacggtgcgccgcctgctggccctgacccagatctcgggccgcctggcgcgcgaggcgaccctgcccgcctatggcggcccgctcgccatgctgcgcgcggccgaggccctgaccccggccctggaagatctggcccgccgcgacccggcctgcggctggggccgccacgccaccggccggcttgccaccgcaaccgtgccgggccgccacgacacgatgatgaccgccccccatgtcgaccgcctggcaaccgtgattgaccatctgctgacgcagactgtcaccgagacggcggcagggtaa

SEQ ID NO: 52 - protein, 2123 aa, Tistrella mobilis
MTAPHFIAHQNIWLDERLNTGPGSYHIGGYVELRGPLDIDIFGAALKAVAAAHAGLHMQPVPEGDGFRLLAYQDTFSSPVSVDLSQEGNPAAAANAWMAADFRRMFPAGAPLFRWGLIRLTADRHFWTKTYHHLIVDGHAISRIVQDAAHAYTSLLAGRVPGLAGSDPLAIGDPLAGDGVSARHHWSTVLAAAPPVLNPVPPLPPPDLGPPDLTPPEPGMPGRRTRIGLERGVYDGLARLAAQAGAGLPQLLLVLASAALLRRAGRDALVAGLPVANRPTAAHKAAVGLFATMQPVIVAIDATDRPLDVAAALARRMRSAYRHRSIAFAEQAAMLAAVRGRGTPAFDLTLSFEPHDYDARFGPVTATAHTLSTGREPHPLSIFVRDYHDGAAVTVDLDWRSDVFAADDIPALIARFNRLCRRLLDQPQASLGRLDQPDTETLVRLRRLGCGRPPRPGDLAPLADTIAAQAAATPAALAVVDAATGDRLDYQTLVACAGRRAAALQRAGGGPESVIGLAHPSGIEAVISRLAVSMAGAAWLPLDPEDPPARRATMLDQARPLLVLDDQSARALDLTVAADARPAAWPVHPEQLAYLLFTSGSTGTPKPVAVPHRALAMHMAWMGRRYPLGPDDVVLQKTPAGFDASIWEFLAPLMAGARLVLAPAGSHRDPEMIGRLCADHGATILQATPTLIDALAAGGALARAGRLRRLFAGGEILGPATIAAARAALPADAVLINLYGPTECCIDASAADIPADLQGAAPLGDPVDGASLQVIDAAGDPVGPGVAGELAIGGLAVGRGYHGDPVRTAFAFRPDPEAKAPGARRYLTGDRVRRTERDALLALGRIDGQIKLAGRRIEPGEIEAALMVHPAIAQAGAALLPATDGAAPRLGACIVLRPGHPAPAPDELRRHLAARLPAVLHPAIVTSADRLPLSRSGKLDRRALGKAMADEVPATAARTRLDGPLQAEIAAIWAEVLDLPMPGSADDFFALGGHSLKAMQVATRLRAVFDVEIGLEELFDHPRLDDLAALVAARRRDAPADPGPVLDILPVPASGLCPLSSAQERIWFLAQWPDGAVAYNMAMAVRIDGPLDVAAFAEAAAVLPDRHPMLRTCFAAPDGVPLQRVDPEARLVLATRDLRDLDPAARDAAVTEAAARDAATPFDLTRAPLLRLTLLRLADDAHVLLVNLHHIAGDGWSGQIVLEELTALYAARIGAGPDLPPAPALTYADVADWQRRRLNEAEARRQLDHWRGVLTDPPVLDLPTDRPRPPVVSSDGGCLVRDLPDDLLVDLRRLAAGAGCTPFMAMTALFGLLLGRMAGQDEVVIGTPVTNRPDRRLEDLVGFFTNTLPLRLDLRGADLPALLSRTRATCLAAFDHPDLPFERLVDAFAPERSLAHTPLFQVMLAWQLAGASRLELPGLAVSRLAPAFTAAKFDLMLSVEETGRSMSWRFDYRAELFEPETIALIADRLIALIRAAARHPAARLPELFEVPVPTVPTPPAPASDVVDLILARLDADPGQIALVDAATGISLSAAELAARARRRAAGLVAAGIGPDRIVALAHPRGAELVVSMLAVAIAGGAWLALDEDEPEARRALILATAAPDLVLDADGAARIDAAAGDHPLPAGVRHPDRLAYLLFTSGSTGTPKPVAVPHRALARHMAWMNRSFPLDPADAVLQKTPTGFDASVWEFQAPLMTGARLVLAPAGSHRAPETLGRLVDAHGITILQATPTLVDALAATGALARGQQLRRLFIGGEALGTPTIRAARTVLPSGCAIINLYGPTECCIDATAWVADGLPAAGTAPLGAAIDGVHLMVLDRTGRPVPPGMPGELAIGGETVGRGYHGDPVRTALAFRPDPAAPRPGARCYLTGDRVLVDARGRLRYQGRIDAQMKLRGQRIEPGEIEAVLSAHPAIARAGVTVVSAEGGETLVAWLTCHPGSVLPAAEVLRRHVARHLPIHMIPARFVATDALPLTASGKLDRRALTARPLPDADRPAGSDAPASPVEILIAEIWAEVLDRPVIARSDDFFALGGHSLKAVRMLARLNEALPVEVPLRTVFENPTVATLAAALGALTDAALAGDDDLAALLAEIEALTGAEGPEVDGPGTDGPEAETFPDTAAQ

SEQ ID NO: 53 - protein, 1796 aa, Tistrella mobilis
MSTLPPDTPAGRSLLDRMAALSPAQRAALKQRLAARDGAPAAPATAVAAETWPEVGAQAPLSPAQMRFLFLAEDEAGDAQAMSLMLRIDGPLDADRLAAAVSDIVTAQAALRCRILKTARAPVQEVLPAPAPAEALPVVQIAPAEDADAALVAAGLALGHESFDLAVGPLARFRLFRCAPDLHGLGVVLHHIVADGWSAGLCLALIQDAYARRMAGRPPAPPPARSAFDEARRLADLAAGEAHRRRLDQWVDRLAGAPRRLMLDGGPGEPGPARHLPFRINPAQAEALAGLSRRVPGATVFTALLAAWGAVLGRFTDQGDTTIAVAVANRPDPALDRTIGEFADLVVLRLATADDPGVDALLTRTRDAVIDAQAHDGITLAQIMEAIDRRHGAGARPAIDAAFSFLNVPAPAADAHGLRFRPLPLPADRLDFALYLTAHEDPAGGLAGSLGFRPDLVPPALAAALADAFGLVVDAISLDGSLPVSRLALTTEPAGDDLPVVTGPDGRLHLAPVGLPGRLLPGPDRARRLSDGRLRLLPGIDGALRRGTARVHPAAVEAALRRLPGVLDAAVWTRIATDHEARLVAAVATGIPSIEPAGFAAGLVDALPLLLRPDAVLPVHAIPRDAEGRPDRAALDRLAVPAAPHRTDQAALVWVEAPAPALPRLPLDSLPGTAGAADDAGWLVPGDPPPRALADGGPLVLPADAPRTLDAALIATAARHPGRGILHDDGRGSPRLQDYAGLLAAARRTLGRLQAEGLRPGDRAVLVFADLPRHIEALWACILGGIRPVTVAVPHAAGDAVAAKLSGTHAHLGAPPVLTDTDTRDHLSRILPDARILVAAPDTDTPDGVPHPATPDDVAFIQLSSGSTGVPKCIQVTHGGVIAHVFGQVAAWGHGPDDVSMNWLPFDHVVPMLTCHLKDTVLGRQQIQAPTAAVLDRPLLWLDLIERHRVTLAWAPNFAFRLVADALSRETGRRRDLSSIRWFINAGEQVTAPVVADALAAMVPHGLRPGAVRNEFGMAELCTVMTGGIDFTADGACRHVTAGSLAGRLRAAATPGPGTVSFVDAGRPIPGVAIRIADPDGATCPEGVIGRLQARGAVTTPGYIDNAAANEAAFADAGWFDTGDLGFIADGRLVLTGRLKEMIVVCGANHYAHDVEDEAGRAAGVAATFVAATAVDRPDLGTEGIAVFYVPEACLAEIGSADDAGPRRAEIAEITARLARRLGIAPSVVVPLERADFPKTTSGKIQRTALRHRLEAGDFDARLAALGLTPGRDRGPGLPDWFLEPGDAPAPPLAGAPRLGLIEDRLPRGMALADAIDRRRALLARLAGQTVELVTVTPAGDVTAAAVDAFTAAAAEELPGLHLRRIVMADGTPEALITDEIARGTLPVVHLAAGGRTRPVLHPARLAPDTPAQGIAPGQSWLVTGGHGGLGRALIRHLLDRGVASVTVIGRHMATADDPRVHALSLDLAAADAGARLAVLGRFDGIAHLAGLYRERPAAEEDGRAVAELAAPKTGMLPALARLLRDDGLLIAFSSVVAHLPAAGTAAYAAANAALEAEAAALRRPGGPHLVTIAWTNWDGPGMGAAVTGAAGLARGRGLLPIPPADGLASLDVVLAAGLTRAVIGADRRHPMIAARCIDPELSPARARAVLLVAGETAAPATLRRAEDIFGTPAGPGLRHVDHLPESDDALVVLAAGGDTIAAVAPRTATETALAAIWSELLPAPVAGIDADFFAAGGHSLLAARIVTRINDHFGLHLTPAALFDAPTIRALAAHVDGVAAPGPAGADEDFEEGAL

SEQ ID NO: 54 - protein, 1330 aa, Tistrella mobilis
MTATDLLARVAGAGIQLWSENGELRFRAPKGALTPELRAEIGARRAELIALLAEAAAVAAADDRDPLPSFRPELDDEIPLAPGQARWWFLDRLGADPRAALITAALDLRGSLDIARLARAFADIARRHQPLRTAILDHQGTPRAVLRPVPTAWPLPVTDAADDATADAMAREIAARPIDLADGLNLRTALLRQAPDHHRLVVVLHHAAADGWSLGVLLHEVQVLYDGGTLPPLRRSYAEVMQDQARIRAADLDVWRKLLADLPPASDLVLPGHPEPAGDDPVIRRRLSPETSARLDALGRGLGVTPFIILTAAAQILIGRLSGSHDFALGTPVANRPDADAEALIGFVTNTLVLRAALGRARTVRELLTAIRGDTRDALAHQSLPFDRLVDALGIARTGTDNPLFRVLVAAGAADLPAPGLGGLDVAILPAPATSTRLDLEIHGHAGPEGFDLAVTFDPTRIGRTAATDLLDRLGLILDGMATRPDEAWADLPILTAAEAARIDAAARGAAIRHPRVLDEILARAAEAPTAPALIDAHGSLDRRRLIGRAAALAGQLGAVQGAPVGLMLGRGQAHGIGLLGAWLAGAGAMPLDPELPDARLATMIAIAEPAAIVADAAEIDRLRRLTDRPVLPLPEATAETRPVATSPDDLAYLLFTSGSTGTPKGVRVAWRTLDQLIGWHRARHPVPARTLGFAPLGFDVSMQEAALAWAEGGTLVTADEATRRDPAALAAFISRHDIARLFLPVVMLHALADHLADHPDRTPTSVQMIATAGEQLRITAPVRDWCRRQPFAIDNQYGPTETHVVAAELLPAANVDRWPDRPAIGRPIDGATLFVTDPAGHLLPDEVAGELLIGGTAPALGYAGDAARTAERFVTGPDGGRAYRTGDRVLRHRDGRLSYLGRADDQVKIRGFRVEPGEIEAALGSHPDVAQALVVVRTIAGQATLVAHVEPRARPADETGFAQALADHLRARLPEPMVPARWVISPALPRSANGKLDRRALPATDGMPLAAATAAPPATESERRLAAIWAEILALPVDAVSRGDDFFALGGHSLRATQLIARIGRDLGLEPGVAQVFETPRLADLAAALDALTPVARTAPIPRRTDDDDLPLSFAQERLWFIDQLSPARGAYNMPAALRLTGRLDHDALARAFATICRRHAVLRTAMIERDGRPVQRIHPAPETWPLPVEDLSDLADPEAEVVARAVEDAETPFDLTRPLKIRTRLLRLGESSHVLLATLHHIASDGWSIGVMVRELGALYAAFAAGRPDPMPPLAVDYADVALWQRARLSGAERDRLLDHWRSVLDGFTAPNRSSTAPGRRCRAIRAR

SEQ ID NO: 55 - protein, 3853 aa, Tistrella mobilis
MQSYQGALTRRPMPAALARHVDETARRHKATPFVVLLAAFQLLIGRISGTTDVAVGSPIANRTHPDTEALIGFFVNALVLRSRFNDDPDFAAFTDRVRQVVLDAQDHQDLPFEVLVEALEPDRALDRNPLFQIAFAVQNAEVPPLALDGLDIRAVEREVTRTRFDLELHVWPSETGYDLVAYYATDLFDAATIDRLLGRYETLLAAALARPEAPVSILPVATADETAALAALRAGPPAAAFRPVTAEIADRAAEAPAAPAILHQGAPLSRTDLDQAATRLARRLIAAGIGPEDRVGLLFDRSPAFVIAALAVLRAGAAYVPMVTDYPDERIRWQIADAGMRAVLAAADQAPRIGDAVPVLVPDDDTGDGDAAARLPDPAGIDADRLAYVVYTSGSTGRPKGVAITHGGLANLVAWHRRAYAPDQTTRMAQVAGLAFDAAGWEIWPALAAGAALVLPQPGAGRDPDLLLADFVTHRVTQAFVPTPLAAPLLSRPRPEGLKLDLLLTGGERLATAPEMPGVRLINHYGPTETAVVATAGPVDPAEIAAGRAPAIGRPIDGFTAHVLDRRMRPVPFGVAGELWLGGAGLARGYLGRAELTATAFLPDPFSTTPGARLYRTGDLVVRRADGSLDFRGRADAQVKLRGHRIEPGEIEAALRDDPAVAEAAVLLAPAGDAQAAARLIAFVVADTAADEADRAAREAERAEDWRRLYADTYGALDGDPVFRIAGWTSSYDRSPIPAPEMATWRDATVAAIERLGGETVWEIGCGSGLLLWKLAPRRRRYHATDFSAEAIAHLKADLARSGIDHVTLERRAADDMADRQAGPWDNRPAGPWDAIVINSVIQYFPGEDYLLRVLRGALDAIAPEGALFAGDIRAAHVERGFQTSIALHQAPAATPAEALSARIADALAAEKELLIDPAWFLTRAAALPGVAGMDIRLKRGRDRNEMTRFRYDVTLFKGAARAPLVPDRRMVWADGPDFPALCARVAAEGGRIEILDLPNARTAADMAAADRLDGRHATAGDIAAAAAEAARDAVDPETLWSIADEAGVALRITWAEDPALMHVLIEPAAVAEDPRPPLWAPWRSMPARSPINDPLAAGADRRMIRRLRDHLRRRLPEALVPAEIRLLDRLPLTPNGKLDRAALLARLATRQTAAPETTTAPAGATEATLSRIWCEVLGVAAIGRHENFFEAGGDSILSIQVASRARKAGLPLAVRDLFAHQTLAELAGALDARAETDAGRDACLPVDGPVPLTPVQAWFLDREPVDPHHFNQAILLTLPAGTEDAAIQAAVQTLAGRHDALRLRFSPDGSGRMMQQAGPVDGATRFDSIDARFDDWSAHAARVQAGLDLARGPLLRVVRYRTGAGADRLLIVAHHLVIDAVSWRLLLDELRELLAGGGGADPAPAPSFTRWAAALADRAARGAFDDEIPHWQAVAHAATSAAGLPVDDPAAPDLVERARTTHRALDEARTDRLLRAANRALRTEAAEIITAAVARALARLTATSLATAPGPVTLLIDREGHGREDLVPGLDPARITGWFTAIHPVALIVDPAEPPRASLARIKDTLRAVPRRGAGFGPLIRAGRIETPPPAPEIAFNYLGQVDAALDGGGLLAAAPEPVGPLQSPAATRLHALTIGAAVMAGRLRVEITWPGDRIAAARMERLADDVVAELGALVDVCMAADAAGLTPSDLPLAGLDQPGLDGLLARLPIPAEAVETAWPATALQHGLLLQGARGPAEGAALYVEQFAFRLRPPVDTGALVRAWDLVTARHQALRSLILHEGLERPLVVVARHHRPEIATSDHRVLAPAAAEAALDAALARDRATRFDAARACPWRLALHRLPGDAGSDEDVGAGDIVLVWSFHHALLDGWSTFRVLEEVLAAYTALTRRSTPDLAPAAPLARFAAWLAARDPLAEETYWRAALDNLPEPQPLPGGRPGGSATAERHHVTGRLPAPAAARIIEAARLLKVTPATIAQAAWAMVLARHGDRDDVVFGTTVSGRPEAVAEVERMVGLFINTVAVRVRIDPARRIGDWLAELQESRRAATAFEAAPLGLVQRWALPGEQRRPLFETILAFENYPVAEALKGDAATPPVLDVADTVYEGRTEYPLTVTVLPGDGFAVDIAYDPGLVDADAADRLLGQMLTALAGLTRDPLARLATVDVLDAAERRLIADWSQGRGAAAIAAGFAGDPAPVADDDRPLHLRLADHGAGEPALIQGDRRLDRAWLDTAARRVAARLVAAGVGKGDLVALLMPRCPELVAAMVGIHLAGAAYLPLDPVYPDARIAAVLGHARPRAVLADMAGLGRLHDLAGAPALRLDVAAVTGTGPLLHPLPQPAADWRDQPAYVIYTSGSTGTPKGVVVTLGNLARLIDATRPWFDFGPGDVWTLFHSPAFDFSVWEIWGPLATGGRLVIVDHDQARDPAGFHRLLAHEGVTVLNQTPSAFAALDAADALAAGVPAGPALDTLRLVIFGGEALDAASLAGWFARHGDDRPALVNMYGITETTVHVTHARIRAPHAAETGTAPIGVPIPDLTLQLLDHQGRPVPIGAAGEIHVGGRGLARGYLGRDDLTAERFITTADGTRLYRSGDLGRWRSDGRLDHLGRIDAQVKIRGFRIEPAEIRAALIAHPAIADAAVAARAGGADGELRLVAWILADEVPEDLRDHLKARLPDWMVPSAIMPVAALPLTRNGKLDLAALPDPSPVAGSGGAAPATATEARLARIWEELLGVPAPGRRDDFFALGGHSLLLARLAHRIAREFGVTLDWPTLFAATSLEAQADRIEGLAGSDGLPPLRPVPRDGRPLPLSAAQRRMLFLNEAAPGPAHTIPLLLGLTGPLDLARLQAAIDGLITRHEALRSRFPTVAGQPVQLVAPAEPQPLVVVEPEDAAEWIRAELARPFDLANEPAFRCTLLRRGRQDHVLVACLHHVAGDGWSVGLLARDLGALYQGDADLPPVVIGSADLGAAEADPRRMAAVDAALDRRAVALAGLPVLDLPTDRPRPDIRRGLGACHGFTLPAALAEAARSLATARGTTTAVVLAAAQAALLGGLAQADRFAIGLPAAERLAPETAETVGLLVETLVLAVDLGQVSGAGLIDRLAAEMRAALGARPLPLDRLIDRLAPPRDPARTPVFQTMFGHERLAAHGLDMGPDLAAELLPAPMAGARTDLTLILTDRADGGLDGLIEYDTDLFEAATIDRLATGYARLLAALIAAPDRLVAQLPLGDPAPAVPASAPRPAGPAAAFRAVVAARTQAIAISHADGTRIDYADLLDRADRLARGLTARGLRPGTHVGLYAERSVAGIVATLAIMLAGAAYVPIDPAYPAERQAILARDGGLEALILPRTAPLPDWAAGVGRIVRIDQDGRVDRHGSGDLRITGTPAPDGPVSPEAVAYLMFTSGSTGRPKPIAVPWRAVMVRAIAGGYAAIGPETVIPHISNPSFDAATFEIWGALFNGARLHLVDQPVLVDPGRLADELTTAGATLAFVTTSLFNRISEQAPSAFADFDRVLVGGEAVQMRWIRAAAAACPATRFANIYGPTETTTFATVFDIDDAAIDAAPIGRPIADTTAQILDHHLRPLPDGVPGELCLGGAGLAHGYPGDPVRTALAFVPDPFATTPGARLYRTGDRVVRDARGRLRYLGRRDGQIKLRGHRIEPGEIAAAAHTVPGVAQAHAMLRRDDDTPRLVLYATGTTTPAALATALRGLLPRWMVPSAVLVLDSLPVTANGKIDTARLPAPPAVAADTVAATGGGTIDRLAAIWAALLGHRTFGPADNFFDVGGHSLLLVDLRARIAEELGVTLAMTDFFAAPTLADLARRIDEGATPATPARPGAAADRLDGRSRLAARRRRP

SEQ ID NO: 56 - protein, 1705 aa, Tistrella mobilis
MIPADDHSMTNAGTAPSPTDIAIIGMACRVPGADGPEALARLLAEGREGIADLPADDGIDDPRWVRRKGLLADPFGFDAGLFGHAPREAALIDPQARLLLELGWEALERAGQPPRATEGQGRTAVYAGAGISTYLLTHLLNNPAAADLATPFEAVLANSGDSLVTRIAYELDLRGPAVDVQTACSTSLVAVHLAVQALIAGECRMALAGGASIDLPAPAGYWYAPGMILSPDGHCRAFAADAAGTVPASGGGMVVLKRLVDALEDGDHIHAVIRGSATNNDGAARIGFTAPGVEGQAEVIAEALTLAGIASEQIGMIEAHGTGTPIGDPIEVQALTRAFGPEVPRGQCLLGSIKSNLGHLNAAAGVVGLIKAVMAVEAGMVPPTLHADQPNPALDLAATPFRLATALSPWPAIPGPRRAGVSSFGMGGSNAHVVIEQAPPHPVRPAAPARLLCFAAATATALDRMSMAPIPATADAGFTLLAGRARLPHRRVLLQLPDGGMETIDGQAPDQPVTVALARPDAAVAAGLAALGLDLSPDGTLMLEVEGRDETALLRAVARAWTQGADIDAVRLYGPGRRRLPLPGYPFEHGHHEIPRPAAMPTAADPLALPPRLADPTDWFWLPVSREIPPPSVEAEAAGAVITGPVLILADALGVSAILADRLRAAGHGVTLVTPGSAFAAAGPDRFTLDPADPGQFRSLIAALDAEPRTILHAWALRGPRPPAAGVETIAAVQSRGLHALLHLLQALGSPGTGPERRLLVAADRLLPVTDNDLRPDHAPLLGAAKIVSQEYDRILCRMVDPGTAAPARLADILLAELTEGAEAPRVTSWRGGRRFVGEEAPRRLTGDGRARFVPGGVTVITGGLGGMGLAFAEEVAELAPGGALVLIGRSVFPDPEDWEDWLVENGETGRIARSIRRLQAIIARGTRLMVATADVADAGAVEAVLAEARRRFGPITALLHTAALADYEGVIHGRARARTDRVMAAKLQGTLVLDQATRNDPLTLFLLCSSLGTVLYHVKFGQVGYAAANEFIDAFARARAADPARPGATVAIRWSDWRDSGMSVAALARWAERTGIDESDYISDGLTDLEGRLAMRRAAGQAAPLIGVSQHDLRMLVAQDPLRAKAFLAETDRAHARPALAQDYVAPRTAAEREVARIWQRLLGIDRVGALDDFYDLGGHSLLATQVLSRITERLKVEVPLDAFLDDPTVEALAGLIDAAEAARAATTAAAGSLPAETADDDGPIPHAGRPAEGLPLSFAQARCWFLDQMEPGSAGYNMPMALEVTGPLDQVALAHSIDLILARHEGLRTLCVVRDGEPRQIVVPERRGVLEIRAAAEPSSLQALAEAEARKAFDLTRDIPFRAALVPVGPERHLLLITMHHIASDGWSMGVFLDELARFYAGFAAGQVPAPAPLPVQMPDVAAWQRQRYAGGRLEALTGWWRDRLAGLPDLVLPTDRPRPPVRSDAGGLIAVPLDPAAMARLRALGRAERASPFMVLLAIFRHLLGRYSGQEDFAIGTPVAARSRPELEPLIGFFANTLAIRSRIPSDASLRRAVAIVREDAGQAFARQDLPFDRLVEELGIARDPGRNPVFQVLFVLQNAGRATPRVAGLELTPLKADTATAKFDLTLSVVPGPVAEGAETEDYKQALFEFATDLFDPAGIEMMGACFAELVMRLSVEADAPMSSIALTAAGMAAAADDDGW

SEQ ID NO: 57 - protein, 1613 aa, Tistrella mobilis
MTRDTTDADLTARLAALDPARRALLERSLAARRAMPPADLAGAVARMLAGSPAARAMVFTLRELGVGKGGVVGVLLAETAKHGPEIAAMAISAGLATGADVLVAADGDRMPGDMITLPSADLPWPEVPANTPAVAAEPVGRVLIDGSDGYQPVDLAGRFARLAEIFAGARRVAVESGTDDPDAVAALMLAAAGGLGLTGIEAATTRPRAMLARLAASPAQAMAIRPGSLARLIEAAGGSDHPGLAGIAAIDFGGAAVPAALVALVAKLQGRRLFCHYADGSGAPLAGWEIDPALVTGETAPAGRPLAKGRIRIVDGSGAMAPAGMVGRIEIRAATEGDTAEGGAPWVATGDAGRRTRDGLLETLARPDGRLRRDGRLLDLAAVERRIARLPGVADAHLRLRRTEAGPVLLAALVPAGAPERAAAALAALPGWCRPEAVQLVDHLPLTAAGEIDTAALDQLPVPDEALLEAADAALAPAPAMKDPDAVDLARLAVLPPAPDRRAPPPETLVATGAPLPRPRFRTLPEILDHAADHAAARGIGIIRDGRGTMEQIDHAGFRDRVRLLAGGLARAGIGRGDRLLLVVAEIADYLTGFWAAQWLGAVPVPVSVAGSWTIEDGNAAKLLQTRRLLGHPPVLADRGRAGLIADFLAAHEDDMSAGPVLDPALLAEGGAIEEAVAADPDAPAILLLTSGSTGAPKAVVQTHRTLIARTTATIAHRDYGPQDLSFNWMPLDHVGAVVMFHLRDLAAGAGQIHAPIDLVLAEPLNWLRWMSRDRVTVSWAPNFAFGLIVAEAARPGALDGIDLSALRILINAGEAIVPRTARRFITALAPHGLGPAVMKPEWGMSETCSAVICSDGFTLEGTTDDDMAADLGGPVPGTAFRIVEASGMLPVGRLQVKGPTVTPGYLENPEANAEAFTADGWFDTGDLGTMTGGRLKITGRAKDAIIVNGRNLHAHEIEAVAEEVPGVAVSWTTAFANRPAGADTDRLVVTWVPEEPVIDRETVAGAIRARIARRLGVTPAAVVAVRREDVPKTAIGKIQRARVRADYEAGRFGGLVAAPAAGAPDQGVVDLPLARPVWRPAALRRPDPATRAVIHQSDGGDAVAAIAALRDRLAPLLTEGSGRLRVVLGVRGLEAIDPGDPTPEPATAALAAWAASLAQETARLELRVVDLDPGADAAAREAELAEEAGHADPEPVVARRGSRRLARRLEPLDMDLPAPRVLPITAGGIWLLAGGTGGLGVELAELLGRRFGARLLLVSRSDATADPMKAARLARLSAAGVEHLAMTADVTDRAALDAAIHAARSHWGAPLAGIVQMATDGALDAQWAEMADRGGLADSDAALAATIGPKLEGTRNLVAIARDHGDLPLIGFGTVNALFGAPTLGAYSAANAAMAAVLAGERSRRQAIATAATGPVTTIDWSMWDGLGLAQGAPEPARARTRALGYRIIGRSQGLRALLAALALDRPRVVAGVDAGSHPVMRRPRAAPPRPLLVPVTRGSVINATDRFGRRVTIGTGAAAPAGPGPVADPPRGPVETRIAALWCELLERPAIGRHENFFEIGGHSLLLARLRARMVPLAGREIGIVELFRHPTIRDLARLVAADTAEIEAGE

SEQ ID NO: 58 - protein, 1413 aa, Tistrella mobilis
MTVDTADTAQSFPVHTVPIAVTGLACRAIGVDGPDALRRVLLEGRDVLARHDAADAAALGVPAALARDPRYVGTAAMLPGQESFDHALFGLSLREAELLDPQHRLFLELCREALEDAAWLAPAAGRRVGVFGGCGSPIYLMTRLAGAGAALEAAGATALSFAAKPDFLSLRVAYRLDLRGPAMTVQTGCSTGMSVVQAAVAALAAGECEAALAGAACLTRLDPAGYLHHPGAIESPTGRCRPFDAAADGTVGGSGGAVVVLKRLADAERDGDHVHAVIRAVAITNDGGAKIGFTAPGEAAQAEAVARAFRASGIHPDTIGCVEAHGTATALGDPIEVAALTRGFRAAGGTRLAHAALGSVKGNLGHADAAAGMLSIAKAVLSVAHGEIYPTANTTRANPELRLAETPFRLPTAPEAWPVADHPRRMAVNCYGMGGTNLHAILEQAPARNPRAAAPAGPLVFVLSAADAEMLEALAARMAAAFRADDAPAALDAAFSLATGRPALAARRAVVARDVAEAARLLTMPAPALPVLRDRPVVIDGADAGWAALLPDLTDSPDARGLVDGVAPARLVFGPDNAPGGDPADPLIVDGRDRMQALARLWCLGVRVDWTAVFAGTSPRRVPLPVMPYRPTRCWIDLAPAEPATAAAAAPVALTPGFVEAPLAAGTAMPATIVTGCAAPTTGLGTTLPLAEAGAVTGRVLLVLPGALGLAGRRPADPEELRQARALHDRPGVELTIIDTAAAVDLPPAAAAALAARIRAEAAGDAPAVAFDGARRLVPVAEAVAADEAAPLTDDGWPAPETAGPETAGPELAEPAASAAAARLAALPVEPARGPALEAALDRLCAAHSVAMLRTRGIAPVPGATITRAELDRRIGLVQGQGQLGQGQGWRRMLDAALADLAADGLLTIAGDRLIWGPAVADLPAPDVAADRVRAIDPDHAGLVALINHCMAAHGEVFAGRRPATTVIAGREAGRLFAGAGPAIERHSSRARVLDAAADAVVAAVDAAAAAGRTARIVEVGGGTGAFTGPVLDRLAGRAVDYLFTDVSGEFVARARATLAARGLTGVRVARFDVSRDPADQGLETGGADLVLALDVIHATADLAVSLDNVARLLRPGGLLLLAELVIARRWVNAIWGLATGWWVMADDRTTSPLIDPAAWQRVLEGAGFATEAVLPDTDGADTRLFIARNTRTTLAELALYEGELPEPLPPAMRHVLIRPAAAGDLVAAALAGAEARALEWATGAEAVAWTGDGRPDARLRGLLRHTRAAVLMPPAAADAAGAAAAAAVDGDAAFALVAGLWHDLLGVMPEDAAADFYAAGGDSLIATRLLALLAERHGLELPASALFAATTAGEMAGLIRAAAPAAAEPAAMESDADLLDLLADIESMSDDEIAAAMARLEGQEPDGREVAE

SEQ ID NO: 59 - protein, 1286 aa, Tistrella mobilis
MTADISARLDRLSPAQRALFERMRGKRPDPAAAPETAPDTAPEAAPLSFAQARLWFLDRLQPGSPAYNIASAVEIRGEIDPAALDAALQQVIARHGVLRTRYEEGADGPRQIVDPAPPGPVLRLADAPDAAAAAALATAEARRPFDLATGPVFRLLLIRTAPARHVLAVTVHHIAADAWSLGILFDELMAAYRARLDGLPADLPVLTTSYAAYAAEQRAALDAAAEARLLDWWRHRLDGLPVLDWPAGPPRPPVQRFEGAARRFDVPAALTAAVEALGRHHGASTFQTLMAAAQVLIHHETGQRDFALGAPVANRRRREHEALIGFFVNTLPFRARFDDDPAFTTWLERLRDDARAVLAHQDLPFEKLVEALEDTRDPSRNPLVQVVLAFQNAPVGSGTAPGGLSLRGLETDQGIARFDLEIHLTRAPGGGLAGMILYDTALFDAARVDRLGRRFVRLLEMVAADPGQRIGDLVPLLDEDLAAIAAAAPAVPPAAELVPVRLARMVAARAAAPAVEDPGGGIDYAGLDAAAARLMQALARSGIGRGDVVAVILSPGRAAAAAAMGIWAAGAAYLPLDPRHPPARLAALIRRAGARAVVAPALPEGVELLPRLDVDVGPDNGGFGNGGAAARAARINTAEDAAYLIFTSGSTGEPKGVVVPHGALAGLVDWHVNAFGTGPATRASLVAGPGFDAAVWEIWPVLAAGGTAVAADPAMLADPAALAGWLVDRRITQAFMPTPLVGGLLGRAWPAETALRLMLAGGERLTDRPPQGLPFRLVNNYGPTEAAVVASSGTVSPGPAASIGLPDIGGAITGARLHVLNAASRPVGIDMPGELHVGGRGLARGYAGDPVRTALAFRPDATGDGVRLYATGDLVVLRADGRLDFLGRADDQVKLRGHRIEPAEIAAAIRALDGVQDAAVILREDGAEPRLCAYVVSTAAPARLARRLRDRLPGYMVPADWVQLDRLPLTTSGKLDRRALPAPEMAAATGAVAETAAERLIAGIWAEVLGRKLPPGRDDDFFALGGHSLAAARVAARLQAAGRPLPLATLFRATTLAALAAELEAAAAPEDDDSIDLPDFAPVVDGEVPLSPGQARWWFLDRLGADPAAAVISAALDLTGPLDVDRLAAAFGQIVARHLPLRTAILAVDEQPRAVPQPVPMPWPLPVLPVADEAEANLLARDLAARPFDLASGPFLRTHLLRFGAERHLFDCGSAPCRGRWLVDGGADPRAAGSLCRAGAGAAFGGLSRNRAAGCRADRPGSRLLAGSSGRAAAAASGAGAAGKPA

SEQ ID NO: 60 - protein, 873 aa, Tistrella mobilis
MPGRPENLPDAADPVVVVPLPEAASRGLDALARRAGVTPFMTLLTAAQILFARLWGTRDFALGTPVANRPDPASEALIGFLVNTVVLRSSLAQAEDSLDRLLARVKADTIAALAHQALPFDRLVEALDVTRSGTDNPLFRVLVAWQPGDLATPDLAGLEVTPRPSPLIGTRLDLEIHGQAGPGGWHLALTYAPARLARADATAIGTRLARVLTAMAAEPDQRWTALPILGDDEAARIDAAARGRAMTHPRVLDEILARAAEDPAAPALIDGRSSINRHSLTGRAAALAQQICKAHGRSVGLMLGRGQAHGMGLLGVWLAGAAAMPLDPDLPDARLKTMIEIGRPAAIIADPAQLARLRALTDLPVTVLPEGEAGPPPVTVGPDDPAYLLFTSGSTGTPKGVMVAWRTLDQLTGWHRARHPVPAPTLGFAPLGFDVSMQEAALAWAEGSPLVVTDETVRRDPAALIAFIRAHQVARLFLPVVMLHALADHLAAHPERIPTSVALIATAGEQLRITGPVRDWCRQSRFAIDNQYGPTETHVVAAELLPADAVDDWPDRPAIGRPVDGAVLFVTDPDGRVLPDEVAGELLIGGTAPAIGYAGDPLRTAERFVTGPDGSLVYRTGDRVVRGRDGRLTYLGRADDQVKIRGFRVEPGEIEAALGAHDDVAQVLVTVRHIAGAATLVAHVEPRVMPADPAGLAGRLAAWLQTRLPAPMVPARWVISPALPRSANGKLDRKALPAVDGIPPGQSVGAAPATETETALARIWTAILGVETVSRGDDFFALGGHSLRATQLVARIERELGIRVQLATVFEQPTLQGLAAAVDEARTDALADDLALLDDDELAALLGDDDLSALLGDDDLSALAGDDDPETAA

SEQ ID NO: 61 - protein, 2163 aa, Tistrella mobilis
MTDAPRPSAEALRAKLKTLSPEQRAALERRLAAAKAGAAATGTAIPRIPRDPAPAASFAQERLWFIDRLAPGTAAYNLPAVLRLAGALDHRALEDAIGRIVARHEALRTALVERDGRPVQLIAPPPAAWPIAVEDLSDCPAEMVTARVAAEAETPFDLAQPFKLRSRLLKLAADDHLLLITLHHVASDGWSLGVLTAEIGTHYAAARAGRETDLPPLACQYADFAAWQRGRLSGAALEREIDHWRRTLDGFVPGEFPTDRPRPAEQRFEGAVVSRRLPAALAAKVDAAARRHKATPFIILLAAFNALLARWSGEVDVSVGIPVANRTHPDLEALIGFFVNALVVRVPLDGDPTMDEIITRSRAAATTAYDHQDLPFERLVAELAPERDPSRPPLFRIAFAVQNAPRGSVTLAGLELRPFTAEITRTRMEMEWHVFERRDETGAAAGLDLVVAHATALFGRATVERLIDGFAVLLEAGLDRPETRLSALPVMTAAMERAVMTAGRGPAPEAIPAPDLSRVLAERLATDRVVVAEAGGPRLTGHQLQARVERMAAALAARGLAPETPVLLLMDRGIDQITATLAIWRAGLCQMPVDPAQPDARLAAMIAGGAPGLAISDPDGLARLSTLAPDLPRCGPADLNAEPRPLPAVHGDQLAWMIFTSGSTGTPKATLVTHGGALNTGFAQARMLGLGTEDRVAQLASPGFDAALSELLMALIAGAELMPVPAAVARDPLALGDFLAAERVTVATLTPTMLAAIGRDLPDLAVLLVAGEACPPELVRRFAPGRRMVNAYGPTECAVCATMAVGLDAEAGPPPIGSAIDGAELLILDPRGRPVPDGVAGELCIGGAGVGRGYAGRADLTAERFVPHPAPDRPGARLYRSGDLVRRRPDGALDYLGRIDTQIKLGGNRIEPGEIEAVLRADPDVADAVVDVIEMERPVAAAPADAGSGPAIALRPADALADGRRLELWPSIAEHFVYDETLYHAMTHDEARNAHYRAAIRAAVPGKVVVDIGTGADAILARLCVEAGAAKVYAVELLKASADAARATVRRLGLDDRIIVVEGDARRVTLPEPADICVSEIIGPIGGCEGSAVILNDVWRLLKPGAEMIPARTVSMVAGLELPAGFREAPGFSSLTAGYVRRIFEDRGGPFDLRLCLKGIGPDDLLTDAAVFEDLDHAGPVATESRHHVVLTTRRAGHLSGLTVWLKLEAARGRVMDTLGEICCWLPVFLPVFGEGRPVAAGSRIAMTITRTLHANGINPDFRLTGTIEMPDGTSEPFDWFSPNHGAEAGFRASPFYRRIFPETAVPDLPTPTASPATDRRLVAWVTPRGGADPEGDAALARDRVEEWRALYETAGPAAAETAADPTPETDPGDALFAGWNSSYTGRPIPVDEMRDWRDRTVAAIRRALPAGRPAHIAEIGCGAGLLLEPLAPAAASILGTDFSAATLAGLETRLAGHGWGHVRLERQEAADPLPIDRPVDLVVMNSVAQYFPAPAHLEKVLLRIGAALAGGGAAFLGDIRDHGLAEIFHASVLAFQSGGALPDRDSVARAVAADEELMLDPAWFHGLIGRIPGLAHVETLIKRGRGDNELVRYRYDVMAVFGPAPAAIRPEATLPWPGAEALAARLAGLTGALEVTDIPDARIADDTARGQRLGLVSATATGEPAHPDSLHEMGERLGRAVRLAPAASGIAGAMDALFDVPGLADDPLARGWMRSPVSRGRLANDPLARRRKSALADRLRRRAREVLPAAMVPQAVMVLDRLPLGASGKLDRARLPRPETAAGRHPARDPARALPADRLEAALLALWEELLGTAPIGVEDDFFALGGHSLLGVRLVAEVKARLGGTVPLDLLMRAGSVRAMAVHLKEAGDLADDGELADDGAGTGRLVPLRRDGSGAPLFCLPPGGGTVFCYGPLVDRLAPGRPVWGLQAAGVEPGETPHESLEEMAAAYLAAIRRIQPKGPYHLIGWSFGGHVAYQMAAMLEAAGEEVALLALLDTFPPEHVPRVDERYRREEAYLAYLAGLAGLAVAEDELAPLTSPARLRLVADRAVAAGALPARDAEGTVRRLLALTQISGRLAREATLPAYGGPLAMLRAAEALTPALEDLARRDPACGWGRHATGRLATATVPGRHDTMMTAPHVDRLATVIDHLLTQTVTETAAG

SEQ ID NO: 62 - DNA, 3919492 bp, Tistrella mobilis (residues 1-1,959,746 of 3,919,492)
atgaagccggacgacccccgccaactccgactgccgctgcccatgacctcggtttccgatcctgctgacttcgccgaatatgaggcacaatgggcccgtgtgcgcgactcgctccgtaccgagttcggtgatgccgccttctattcctggttgaagccgctggctctcgcttcggtcgccgatggccgggtgacgatccaggtgccgacccgcttcatgcgcgactgggtggtgtcgcattatgccgaccgcatccgcgtgctgtggtcatgggagaatccggcggtgcgccgggtcgacatcgccgtggccggcgtgaaacccgcggccgcggaggcgccggcacagccggccccccggcctgccgaggtggtggatctgccgccggtgccgatggccgcgccggcgcccatgacctccagatccgctgtcgccgttgccccggcccgggctgcggcaccgcgtgccgccacggcggcggcgcctgcgatcgtcatcgccgacggcgatgccgaggcggaagcgggcagccgtgcggcggagcggatcgatcagtggtcggccggactggacccgcgcttcaccttcgacaattttgtctgcggcaagcctaacgaactggcccatgcggcggcgcttcgcgtcgccgaaagcgaaacggtgcagttcaacccgctgttcctctatggcggcgtcggcctgggcaagacccatctcatgcatgccatcgcctggcatatccgtggccgcaatccgcggcgcaaggtcgtctacatgtcggccgaaaagttcatgtacgagttcatccgggcgctgcgctacaaggacaccatggcgttcaaggagcagttccgctccgtggacgtgctgatgatcgacgacgtgcagttcatcagcggcaaggactcgacccaggaggagttcttccacaccttcaatgcgctggtcgaccagaaccgtcagatcgtggtctcgggcgaccgctcgccgtccgatctggatggcatggaggagcggctccgttcccgcctcggctggggcatggtcgccgacatccatcccaccacctatgaactacgcctcggcatcctgcagcagaaggcggatcagcttggggcggcggtaccggtgaaggtgctggaattcctggcccataagatcgcctccaatgttcgcgaactggagggtgccctcaaccgcgttgtggcgcatgcgaccctggtcggccgggcgatcacgctggagaccacccaggaggtgctgcaggatctgctgcgcgccaatgagcgccggctgacgatcgaggacatccagaagcgggtggccgagcatttcaatatccgcacctcggacatgcattccgcccggcggtcgcgtgcgatcgcgcggccgcggcaggtggcgatgtatctggccaagcagctcacccagtccagcctgcccgagatcggtcgcaaattcggcggccgcgaccataccaccgtgatgcacgcggtcaaaaaagtggaggaactggccgctcaggacgccggtttctccgacgatatcgagctgctgcgccggatgctggagagctgagccggcggcatccgcgctgccctctccgtgtggtccgcatcccggtgacacctgccgttacactggcttcgcgcgcgcgcgggcggtatactcctagcccctgacggggccagagtccggaaccgtctccgggggtcgtcaccgccctctcagatctgccggccgggcatgccccaagccgatcgacagccctcaccgggagcgcacatgaagctgaccatcgaacgcgccgccctgctccgcgcgctgacccacgtgcagagcgtcgtcgagcgccgcaacacgattccgatcctggccaatgtgcaggtcgaggcggaagcctcgggccggctgcgcctgaccgccaccgatctggatctgtcggtggtggaggatgtgccggcgacggtgggacagccggggcggaccacggtgccggcgcacaccctgcacgacatcgtccgcaagctgcccgacggcgccgaggtcgaactggcgctggatgccgccaagggccaggtgaagctgaccgccggtcgctatgcgtcggcgctgtcggtgttgccggccgaggattttcccgagatcgccgagggcaacctgcccttcgccttctcgctgccggccgatgagctgaagcggctgatcgacaagacccgcttcgccatctcgaccgaagagacccgctattacctgaacggcatctatctgcatgtggccgaggggccggatggccggcggctgcgtgcggtcgcgaccgatggccatcgtctggcccgcgtcgaggcggatgtgcccgagggggccgccggcatgcccggcgtgatcgtgccccgcaaggcggtcggcgagctgcgcaagctggtcgacgaggtcgatgccgaggtgtcggtggccctgtcggaaaccaagatccgtttcgtcttcggcgacgtggtcctggtctcgaagctgatcgacggctcgttcccggattacgagcgggtgatcccggccggcaacgacaagatggtgcggatcgactgcaagcccttcgcggccgcagtggatcgtgtcgccacgatttcgagcgagaagtcgcgcgccgtgcggttctcgctcaccgacggccggctcgatcttgccgtgaccagcccggataacggctcggcgagcgaagagctgacggtcgactacgaaggccagcacatcgatatcggcttcaattcgcgctatgtgctcgatgtggccggccagatcgacggcgatctgatggagctggcgatcgctgacggggcctcgccggtggtgatccgcgatacggcggatgccggtgcgctctatgtgctgatgccgatgcggatttgatcacgctcgaccccaccgatttcccggagcccaccgccggcgctgcgtctctgcggccgggggtgatgcgaccggccattacccggctggtcctgaccggtttccgaaattacccgacgctgcgtctggcgctggacccggcaccggtggtgctgaccgggcccaacggcgccggcaagaccaatctgcttgaggccgtgtccatgctggccccgggacgcggcctgcgcggtgcgcgactgggagagatggaccggctgatcccgggcgtggagggacgaagcggcggcggctgggcggtggcggcgacggtcgagaccgccgacgggccggtcgaggtcggtaccggccttgccggcggcggcctggagcgcgagcgcaggatcgtccgggtcgacggccgcaatgcgagtgctgcggaactcgggcggcgctggtcggtcctctgggtgacgccggcgatggatcggctgttcgtcgaggcggcgggcaatcggcggcgattcttcgaccggctggtctatgggctggatcccgaccatgccgggcggatcgcggcctatgagcaggcgatgcgcgagcgggcgcggctgctccgcgacggccggcgggaccccgcctggctgggcacgctggaggcgaccatggccgccaagggtgttgcgatcgcggccgcgcggctgggcttcgcgagtcagctgaaatcggttctggcggcgggcggccacggctttcccaaggcccggatcgcgatcgagggcgaggttgaggcggccctggccggccagcccgcccttgcggtggaggacgggctggcccggcggctggccgaaaaccgggggatcgacgccgataccggaaccacccgggccggtgtccatcgcacggatctggccgtgacccacgagggcaacggcatgccggcggcgcgctgctccaccggcgaacagaaggcgctgctgctggccctggtgctggcggtggcacggctgaaacggacggtggaaggatcggcgccgatcctgctgctggacgaggtggccgcccatctcgatgccgagcggcgcgacgcgctctatgacgtgctcgtctcgctcggtgcccaggcctggcttaccggcaccgaccgcccgctcttcgccgggctcggcggcggacgggcgcagttcgtgcggatcaccgatgcctcggcgatccgcgaccagatcgtcgaccctgccggcactcccctgccggcggcgggcgaccatgaccgaggatgatggaaccggttcgatgacagagcagcccgcacactccccgtccgagactgccatcgcagccacgtcctatggcgccgactcgatcaaggtcctgcgtggcctggatgccgtgcgcaagcgtcccggcatgtatatcggcgacaccgacgacggctcgggcctgcaccacatggtctacgaggtggtcgacaatgccatcgacgaggcgctggccggctggtgcgacaccgtcgacgtggtgctgaacccggacggatcggtgaccgtgcgcgacaacggccgcggcattccggtggacatccacgaggaagagggcgtgtcggcggcccaggtcatcatgactcagctgcatgccggcggtaagttcgaccagaactcttacaaggtgtcgggcggtctgcacggcgtcggcgtgtcggtggtgaatgcactgtcggaatggctggagctgcgcatctggcgggcgggcaacgagcattttatgcgcttccgcatgggcgatgccgaggccccgctggagatcgtggggccggccggtgaccgcaccggcagcgagatcaccttcctgccctcgaccgacatcttcactaagaccgatttcgacgccgccactctggaacgccgcctgcgtgagctggccttcctgaattcgggcgtcacgatcgagtttaccgatctgcgagccgagacgccggccgtccaccgcatgcattacgaaggtggcatcgaggccttcgtccgctatctggaccgcagcaagtcgccgctgcattcgctgccgatcacggtctcgggcgagcgggccgggatcacggtcgaggtctcgatgcagtggaacgacagctatcacgagaacgttctctgcttcaccaacaacatcccgcagcgggatggcgggacccatctggccggattccgtgcggcgctgacccgcacgatcaacgcctatgcggcgtcttccggcctggccaagcgcgagaaggtcgcgatctcgggcgaggatgcgcgcgaggggctgacctgcgtgctgtcggtgaaggtgccggacccgaaattctcgtcgcagaccaaggacaagctggttagttccgaggtgaagccggcggtcgagaacctggtgagtgagcgtctggaccagtggttcgaagagcatccgcaggatgccaaggcgatcgtcggcaaggtggtcgaggcggcggtggcgcgcgaggcggcccgcaaggcccgcgaactcacccgacgcaagagcgcgctcgacatcaccagcctgcccggcaagctggccgattgtcaggagcgcgaccctgccaagtccgagattttcctggtcgagggtgactcggcaggcggctccgccaagcagggccgcaatcgtgccaatcaggccatcctgccgctgcgcggcaagatcctgaacgtggagcgcgcccgcttcgacaagatgctgagctcggccgaaatcggtacgctgatctcggcgctcggctgtggcatcggccgggacgatttcgacccagacaagctgcgctaccacaagatcatcatcatgaccgacgcggacgtggacggcagccacatccgcaccttgctgctgaccttcttctaccgtcagatgcccgagttgatcaaacgcggccatctgttcatcgcccagccgccgctctaccgcatcaagcgcgggtcgagcgaggtgtatctgaagggcgagctggagcttgagaaccacctgatcgctcaggcgctggaggataccgttctcaccctggcctcgggggcccagcatgccggcggcgacctgcgggtgatcgtggagcgctcacgcgatgtcgccaaccagctgaaggcgatcgcacggcgtgcgccgctctggctgctggaagaagcggccctcgccggtgcgctttccgaggcggcctttgccgaccgggccgcggcggaacgcgccggcgccgccctggtcagccggctggatgcccgtgccaacgagcatgaccgcggctggtccttcgcggtcgagaccggtgccgcggagggcgagatcggcccctcggccggtgccggccgggcgggcgaggtgcggcggatccgggtgcgccgcgaactgcgcggcatgcaggaaagctatgccatcgatgccagcctgtcgcgcggcggcgaggcgcggctgatcagccgccatctggccgaactcggtccggtcttcgacggcgtcgccaccatcgccttcgacaagggccgggaagtgcgcgtcgtcgccccgcgcgaattgttcgaggcggtgctggaggccggccgccgcggcattcaggtgcagcgctataagggcctgggtgagatgaatgccgaccagctgtgggagaccaccatggatcccaacagccgcaccctgcttcaggtccgcatcaaccatgccgacgaggcggatgaaatcttcaccaccctgatgggcgatgtggtcgagccacgccgcaacttcattcaggataacgcgctgaacgtttccaacctggacgtgtaaagcgccgtatcttgcttcgcctccattgcctcctcgcccggattgctcctatatttcagagtgatccgggcaaaagaggtcgggatgagcgtcaaactgaatctgatcctgtcggacgacctcggccgcgaaatcgatcaggcggcaagggagagcgagaccgaccggagtgaaattttccggaaggcgctccagctgtatctggcagcccgggagggcaagcggcgcggattaaagctcgggctcattgaacccggatctgagcgcgtcgagaccgagatcgtcggattgtgaacacgattgatctcgatcgtcctccgtcggggcacaggctcgacgtgaagatttctcctgacgaagcggccggtgagcgccaggtgcgtctgttcaaggacgtcaccctgtttttgatggccgcaggcttcgtcattctcatcatcgtcttttgctttttgacggtgacgtcggttgctgcgtctgtcgatgagaagaagtgggcgatgtcggttctttctgccgcagcagccgggttgatcggttatctgattcgcaaatgaggcgggccgcgggtgcggagctgctcacctgcgtcaatcgaaccggaacgccgaaaccgtcgtctccatcacccggtcggaaaagatcttccggccccgcccttcgggtgctgcacccgcggtgaccatgagcgggatcaggtgctcttccgcccggggcgggtggcagagccgtgccgccggggcatccgcccactccgtcagcaacttatggcgggtggcgggggccgcctccaccgcaccggtcagccaggcgtcgaagctgtcggagacgggcccgaagcggggatcgccatagccgcgcatgttgtggaagctcatgccgctgcccaggatcagcacaccctcgtcacgcaaggcggcaagggcgacaccggcggcgagatggctggccggatccagatcattgcggatcgacagctgaaccaccggcaggtcggcatcgggggccgcgagcagcagcgggatgaacatgccgtgatcgaagccgcgcgcagggtcgacccgggccgcgaggccggctgccccaagcaggtcgaccacccgggcggcgagcgcgggatcgccgggcgccggatagcgcagctggtaggtatgtggcggaaacccgtaatagtcgtagatcagctccggcgccgcggcaccggtgacggcaaaatcatcggtcatccagtgggctgagaccatcaggatcgcccgcggtcgcaccgcaagcccccggatcagcccgcgcagaaaatcgcccatgcgggtccaggtgtcgcggggcgtccagtccatgaagaagcaggggccgccgccatgggggatgtagatcgcgggcatgggcgcggtcgcggcctggctcatgggggcgtcctccggctggggttcaatgccgagtatgcgtccaccggctgatccggcaaagtcgcatgaaggtcacgacctggaacaggccgttccacgtagtgtcccgagctggtattcccgttccgttcagagacctgtcgttcatgcgccgagctgccattcccgtccgtcgtgatcccgtgctgtcatcggctgccgagaccccggccggggatggcccgcttctgatggccgagcgtcgcacatcgggtggtggcgccagggcatcgggcagtggcggcggtggcgggcgccgtggcgcgggcagggggggaaccggtggcgggggcagccggccgccgcggcgctggttccgccgggcaggcattgcgctcggcgtggttgccctgattttcgccggctatatcgcctgggtgctgcgggacctgccctcgctcgacgagctgaacaagcctgcggcggagccgggtatcaccgtgctggcccgcgacggaaccgcgatcgccgtctatggccggttgaccggccgccagatcacggtcaacgatctgccgccggccctggtcgaggctgtgctgtcgaccgaagaccggcggttctacgaccaccccggcatcgacatcttcggcatcggccgcgcggtctatgccaatctttcggccggccgggtggtgcagggcggcagcaccatcacccagcagctggccaagatgctgtttctgactccggaacgctctttcgagcgcaagctgcgcgaagcggtgatggcgctccgcctggaagcggtctacgacaagaacgagatcctggcccgctatctgaaccgcgcctatttcggcgccggggcctatggcatcgatgcggcggcccggcgctatttcgacaagccggtcgaggagcttgatgtcggccagtcggcgatgctcgcgggcctcctgcaggcgccgtcggcctatgcgccgacatcggcggccgagcgggccgagcggcggatgagggcggtggtccagaacctggtcgatgtcggctatctgacgccggaggcggcgaaagaggtgcgggtgccgaagcttgccccctcggcccgggcgacggtgggggccaccaaccggcgctggttcgccgattgggtgctggaccagctttcggcccatctggagcccaccacccgcgacatcgtggtccgcaccagcctggatgcggagttgcagagtgcggccgaatcggccgtgagcgaggttctggccgccgacggaccgaagcttaaggccggccagggggcctttgtggcggtggcgcccgatggcggcgtgctcgcgatggtcggtggccgggactatcgtgccagccagttcaaccgggcgacccaggcctggcgccagcccggatcgaccttcaagctgttcgcctttctggcggcgctggaggcgggctgggagccgaacactctggtgctggatgcaccggtgacggtggatggctggtcgccagcgaatttcgagccggactatgcgggcgaggtgcccctggtccaggcggccgtgcgctcgctcaacactgcgaccgtgcgggtggcggaagaggtcgggcgcgaccgggtgatcgcgaccgcccgccgtctgggcctgtcgggcgacctgccgcgggtcccgagcgtgaccctggggacggggtcggagaacctgctggagatgacggcggcctatgcggcgctagccaatcaggggcgcccggttcagccctgggcgatcgaggaggtgcgggcagccgacggaaccgtgctctatcagcgcgccgcgccggaaccggccgaaccggtgctgtctgcccatacggtccaggcgatcaacgccatgctggtcaaggcggtggagaccggcaccggccgtgccgcgcagctgcgcggcgccgtgatcgcgggtaagaccggcacgacccaggattaccgcgatgcctggttcatcggctataccggcgcggtcgcggcgggggtctgggtcggcaatgacgatgatgcgccgatgcgcggcgtaaccggcggccggttgccggccaagatctgggcacgcgcgatgtcggaagggggcggccggatgatgctggtaccgccgccggtcctggagatcaatgcgccggcgccggtggtgcccccgtcggacgacccgctctcgcgcctgctgcgcggcctgttcggcgaggagagtgccgcccctgcccggcccgggcagccgtcggcgcagcagccggcgcgcccggcaccctctcagccctcgcgtctgtccaatccgccggcctatcccggagagcgcttcgaccgctgacagcccgcggttcagaccgaccggttgggccggtggaccagcagccggttggcggtgagcgcgatggcggcgagcaccaggatggtgccggcgatcgggatcggcgtgccgtcggcaagcggtgccgtggccgccgcgacgatgccgcccgtggtcatctgggtgctgccgatcagtgcactggcggtaccggccatatggggatagggcaggatggccgcggtaaaggcctggggcagggcgaagccggcaccggcgagcaggaaggcggcgccggccgtgacaccgagggcggtgtcggtgccggtcaatgtctgggccagcatgaccaggccgccggtggccatcaggcagagcccgatggtcagcaggcgcagcgagccgagccgcatgaccagccgcccgccgatgcccgcgcccgccacatagccggcgaccgccagcccgaaatacagaccgaaacgttcgggccggatgccgtagccctcgatcagcagcaccgaggaattcgacacccaggcgaaaagggcgccgaaggccgaacaggtgcagatgccgagaccgacgaagcgccggtcgtggagcaactcgcccatcgctctcaggatcgcgaccggccggatccggctgagatcgcgattggtgatcggctccggcaggatggtgaccgcgcttgcgatcagcaggatgccgatcacaccgagggcggcgaaattgccgcgccagccgaacagcacctcgatctgaccgccgatcatcggcgccaccatgggggcgagtgcggtcgccgaggtgatcgaggcgaagaccgatcctgcgcgttcgggcggaaacagatcgcggaccagggcgcggccgatcacggccccggcacaggcgccggccccctgcagcacccgggccatgaccagctggtcgatggtcgcggaatagagacagagaaccgaagccaccacctgcaccgccatgccggcgatcagcaccggccggcggcccagcgcatccgagacggggccatagaccagctgggcaagggccagcccccacatatagccggtcagggtcagctgcgcggttgcggcatccgcgcccagatcccgccccatcgtcggcagcgagggaagataaagatcggtcgagagcggcccgagggcggtcagcgcgatcagaaccagggtgataccgcggctgggggcggcaccgcggccggggccggaggtggggaaggacattgcggcgatgccgatcggaagcgcgtggagacctgccagcttataggccgtcgggcggtgccggccaagggggacgcctcgatcgccaggatcgtcatagagtctcgctttgtgagacacatttcaccggacaggatttcacgtcttagcctgaagaatactcatgcatgacatgcggagctctgatgccagaataatgtcagcagtgctgacgtgtctgtccggaaataagagcgaaattacagtaggttgtggaatataagcgggaccacggccattcggggccgcctgggacaggttgttgcgtgatgagcgtgtccgtcattctatggtgacatgttgttccgcgataatcgcgaataaattgacggaccgctgcctgcggagttatatctcccccacatgttgaggcccggacgcaggggccccccggaaatccgacgtccgccccagcgggcggcgccggcagcgagggactccgccgacggagcgcgccccgtagctggagaggatttgagcgtgacgatcaatgcaggtctcgaagggattgtcgtcgccgagacggatctgtcgcttgtcgacggcaagaacggctatctggtctatcgcgggaactgggccaaggatctcgcgatctcccgcacctacgaagatgtggttcacctgctgtggcgcggccacctgcctgacgaacgcgagagcgaggccttccgcgccgaactggcggcccgccgcaagcttcccgactatctgaagacgatcatccgggcgctgccgcccgagaccgacaccatgagcgtgctgcgcacggcgacctcggcgatcggcgatcgcagcttcgcctggccccccactttcgagcaggcctcggagatcctcgccaaggcgccgacgatcatcgcctatcgcaatgcgctgaacaccggtcgcgacccgatcgagccggatgagagcctcggccatgccgagaactatctctatatgctccatggcgaaaagccgacccgcgtccacacccgtgcgctcgacgcctatatcatcctgaccgcggagcacgggctcaatgcctcgaccttcaccggccgggtgatcacctcgacccgctcggacatcgcgtctgcgatcaccggcgcgatcggtgcgctgaagggcccgcttcatggcggtgcgccctcggaagtcgacacgatgctcgaagagatcggcaccaaggagaatgccgagccctggctgcgccagcagatcgaggccggcgagcgtctgatgggcttcggccaccgggtctacaagaccatggatccgcgcgccgtggcactccgccaggtgtcggacagctttgccggcgaggatccctggttcgatctctcggtccatgtcgaggagaccgcggtccggctgctgtcggaatacaagcccggccgcaatctttatccgaatgtcgagttctgggcggcggcggtgctgcgcggcgtgcgcatcccgaccgacctttatactccgaccttcgggctggcgcgcatggccggctggtcggcgcatatcctggaacaggccgacaagaaccgcctgatccggcccgaatcgacctatgtcggcgagatgcccaaggcgtcctgatctccggcttctgatgcagaaaggccgaccgtcccggtccggggcggccggcctttcgtttgtgcagatccttgtcgtgactgatcagtcgtgcggcagagggctcacgcgccagtggccggggcgcttcggatctgccgccagcctgcgggcgcaccagtccagcagatcggccatgccctcttccaccggccaggcggggttgaccgcgatcagcccggtggtggtcatcccgtcggaggtgctgccggggggcaggatcgacaattcggcgcgcagaccttccacatggggcggcagggcgcgaccgatcctccgtgccagatcttcggcggcctcggcccgcttcaccgggtaccagatcagatagctgccgctggcccagcgttcgatcgcggcctccatggcgcgggccagacgatcgaactcgtccacctcttcgaaaggtgggtcgatgatggcgaggccgcgccgttcccccggcggcaggcaggctttcagcacgccgtagccgtcgtgacgcagcacttcgatccgcgggcccgggcgcggggcgcgggcgcccagcacccgttccagccgtgcacgcaccggatcgacggtctcggctgcgatcagccggtcgcctggacgcatggcaagggcggcaatgaggggagagccgggatagcgtcggcgcgtgccgacggcaccgcggccgtcatccaccgcatccagtgcccggcgcagcccggcaatcagcgccggttcgtccggggccggtcggtcggcgatgcggaagatgccgccgcgggcctcgccgctgcgcaggctttcgggggcctcgaggtcgtagagccctgaaccggcatgggtatcgatcaccacgaagggcttcgacttgcgggccagatgggcgaccgtggcggccagcgccgcgtgcttgacgatgtcggcaaaattgccggcgtggaagtcgtgggcgtagttcatgcctggggcgggcctgttctggaaatgccatgggcggtcaccggatggtgaccgccccggcgtctttcgacaaggcctgcctggccgggatcagccctgcatcgtctgggtcggcttcgagaagtgcacatcttcgggcttcagcccatagaagcgcatcgcattggggccgaagatcagatccttgtgcgcatcgggcacgtcgtcgcgctcgcggatcgagccgaaggcttcacccagcttgccgccggcataatgggtgtgcgggaagtccgcggcccccagaatgcgatcggcgccgatcagatcgacgaaggccggcaggttggcctcgtcaccctcgacggtgaagtagatctcgcgctcgcgcagatagtcgatcggggccttttccgccggccagacctcggccgcgggcgtcacccgccacttgtccatccggtcgagcacggtggggaaccagctggcgccaccttccaggaagccgaccttcagcgacttgaagcgatcgaggatgccgccacccaggaagctgaagaagccgaagacgatggtcatctcgaaattcaggatgaaggctgcggccgggctgtcgaggccttcgccgatgccgtcatgggcccagccgacatggacgcagatcggcaggccgacctcttccgccgccgcccagaccggatcgaaccgacgatcatgcagcagaaccgatccgaccgtgcccagcaccatcagcgaggttgctcccagagccttggcgcgatgcacttccttcaccgcctgatcgggcaggcgcatcggcagaagggccgcccatttcagccgggtcggcttcttgccgcaggtttcggccatccagctgttatacgaccgcatcagcgccgcctcgaacagcggatcgcgggtcagcggctggaggaaaagggtcgaatagatcgtcgccacgtccagctggatctcgtccatcttcgcacaataggcgtcgacgtcgagaatgccctggatagcggtgctgaccggcttcagcttcgcatagtcggtgacgatcgggctggcatgacaggacgcctgatagccctgcatcttgggccgcatctcgccgtcgatcagccaggcatagttgcgctgggtccgatgggcgatcatgtcgccgatatggacgatcttgggccgccggtgccagtaggcgcggtccagatgatcgaagatgccgtcatgatcctcgatatgagaatcggcatcgatgaaggggtgtttcttctcggccgacgcgaaagcgccacgccggttcggaacgggctgataggtcatcgggctgctccgccgtgctgcctgcctgaaatggcaaatgtctcattctgcgagacgatttcgggcgatccaccattgcgtgatattggccgccccgtcctagccaaaaatgagcaccgcaaaccggcttgtcaatttttgcgatctattcatcctgaaataatcaccggagccgcgatctcgcggactttcggcggcaaatgtctcgttctgtgatacttgtggggatgaattgctcgtagaggttgagaaaacgggttgccggttagatagcgatgttttagggtcatccaactgatggtagataatccgtcaggatagtcatcggtgggaacgatcgccagcagcatcgcaccggtacaaagccgggcgaggtcgcgccggaagggacggtggcaggcgacggaaccagggcaagtggcgcgggcgatgcggcgggcaagccggcttcgtctgcgaagcggggcagtcgcgaacggggggccggcggggccaagacctgccggcgtgaagacgcagaccggatgtgaagtgctgagcggcagccgccgccatgcgccgtgggtggcccattgcccgcaatccggtgtgaggatcagccctgacggcacgcgacctgttccttcgaagggagcatgtccgatgcatcatgatcttccgaccgtcgcggccagcgggttccggacagccagactggttgacgcctctctggccgacggccgcggtgcaacggcaccgacggcggagcggctggacattctgctggccctcgacgatctgggcatcgatgcggcgctgatcggctatccggcggcccggcccgcagatctggcgctggtggaggcgagccgcgcacgctgtcggcaactgacccgcatggtctgcacggcgcttgccgatgcgccggtcctggcggatctgctgggccggggcgagccgacggaaagcgggccgccgatcgaggtcgtgctggaatgcggcacggacccgcgtctggccgagggtgcggatccggtggcactgctgaccggcgcgatcatccgtctggcaccccgggcacccgtctgggtcgagcttgcggcgattgctgcagccgctcccgaaatgctgcggagcctggttcatgccgctcttgcggccggcgcccgggggctgatccttgccgataccaccggccggatgctgccggccgagacggcggccacgatcggcatgctgcgggcgatcaccggcccgacgatcccggtgatcgtggcaccggccgacgatctgggccttgctaccgcgaatgcgctggcaggccttgccgccggcgccgatggggtgctgggtgccatcggcggtttgggggagcgcgccggcctggtgccgatcgaggaggtcgcgaccgccatccgttatcgcccggatcacgtccgactggatcacgccatcgatctcgcggccctggtccgcacgggcatgacgatcgcggaaaggctttcggtcgatctggggcgcaataaggcgctgctcggcgactacgtcttcggaacggctgccgggctgcatcagcacgggctgctcaatcatccgatcacttacgaatatctcgacccggcggatttcggccgcgagcggcggatcctgatcggtcgccattcggggcgtgcagtgctgcgcgcccggctgaccgaggtcgggatcaatctggatccggcagggctggaggccgtctatcaggcggtgatgcgcagcgccgatcccgaacggttcaacgacacggccgagctggtcgcgctccaccgccggctctcggccggggatgcggtcgcaggccctgtcgcccacgtcagtcagggggcatgaggacgatggaagtagcgcttggcgtacccgatgacgaggtcgtcgacgatgccgaggtggagcatgtgctgggggtcatccgcggcggcggcctgaccctgctcaaagccaatatcggttacgggctgatcggccataccgaacggtcgatccgccggatgtacgaggtgaaggggcggccgctgaccaacccctgcatcaccatcggcagcatcgatgtgctgcgcgacctggtgatcatggaggatccccggctgctggactggattgccgaggtgtcggagatgacgacgctggcggtgatcaaccggctcaaccccgacagccggctgtttgccaagctgacgcctcatgtccgtcggcagtgcagcgagaacggcacggtcgcgaccttcatccggactggcgcgttcatcgagcagctggtcgagaaggcgctggccgaagacatcctgctggtcggatcctcgggcaacatctcatccacaggcaatcgctataccttcgccgacgtccagccgcaggttctggagggtgtggatttctggcacgagaaaggtgacgccaagtatctcaacgaccagaaactggcgaccagcatcgtcaacctgacgaacttcaccttccgccgcaagggcgtgaaccacgagtacatcgcggccagcctcgacgctttcagatcgcgaaccggcctctgaggtcgggccggcctctgacgtcggtcgtgcgacggcgacacgggatgcagtttccagggacatggacaagtcggcccgcccgcggcgggctttcggaaggacgatgacgcatgtcggaatattttgaggagttcgaccggatcatccaggccaacaagtattcacgccactccttcgtgaaggagatcgaggcgggccgggtgacgcgggaacagatgaagcgctgggcgatccagaagtatcatcaggtctatctgcagaacagctgctacagcggcattcatgccaacagctggcacgaggacgtccgcgccttcgaaatggagcagctgatcgccgaggaaaccgcgatcgccgatgggtcggacagccattacaacctgatgaagcgcttcgcgctggcgctaggggcgaccgaggccgagatccgggagaccccggtggcgccggaagtctgggatttcgtgacctatctggtcggccactgccggaacaatcatttcgtctatggcatcctggcgatttatgtgaacgaaagccagacctcggaaagcgcgatgaagatgtatcgggcgctcaaatccggcttccagttggatgatcgtgcgctcgaatggttcaccgttcatggtgaagccgatatcgagcattcgtcgcacgccaaggatctgatcgtgaaatacgctcatgaggcgccgaacttcgaatggcgcggccggcaggtggtcgagaccgggtcgaagatgtggaccaagctccacgacttctactacggggtcatcaccggctgagaccgggccgggttccgccgcggcggcgtcgggggaggccgccgcggcggatgccggatcgtcaggatgtcgccgggcttttgccccgccgcttcatcgccgccatggccagggcgaccaggatcgtgccgacgatgaagacgaaggccgcggcggcgatcgccgggctgatgttctcgcggatggtcgagaacatctgccgggcgagggtgcgctgattgggtccggcgacgaacagggtgagcaccacctcgtcgagcgaggtggcgaaggccagcaccgcgcccgaggcaaccccgggcatggccagcggcagggtcacccgccggaagacggtgaccggcgaggcgcccaggctgagagcggcgagttcgacccgccggtcgatgccggcgagcgcaccggtgacgctgactaccacgaaggggatcgccaccaccgcatgggcgacgatgacgcccagatagctgctggcgatgccgagccggacgaacagcacctgcatgccgacccccagcaccacggcaggcacgaccatgggcagcaggaacagcgtccgggcgatgccggcgaagggcaggcggcggttgcgcagaccgagcgaggcggcggtgccgagcaccgtggccagcagggtcgccccggtgccgatgatcaggctgttcacgatggagcgctgccagaccgccgccgtcgccagttcctcgaaccagcgggttgagaattccgggatcggataggtcaggaagacgctggaggtgaaggcgagcggcaggatcgccacaagcggcgccaccaggaagatcaccaccgcaagcgcatagagcagtttgaacgccttgggcatgggctgtcagctccttcccgtggcagggtcggccgaaagccggccatagaccgcatagagcagcagggtgaccaccagcagcaccaggccgagcgcgccggccatgccccaattggccgaacccgtggcatagaaggcgatgaccgagctgatcatctggtcgccggggccgccgatcagggccggggtgatgtagtagccgatggccgtcatgaacacgagcagcgcgcccgaggcgaggccgcggaaggcgagcgggaacaccacgcgcaggaaggcccggagcgggttggcacccagagaggctgcggccggcaccagatttctggggatggcgatcagcacgctgtagatcggcagcaccatgaagggcagcaggacgtgggtcatggcgatcaccacgcccaggcggttgaagatcatcggcaccggcgcgccgacgatgccgaggccgagcagcagatcgttgatcagccccttttcctgcaggatcacgaaccaggccgcagtgcgcaccagcagagaggtccagagcggcagcagcacggcggcgagcagcagattgcgcttccagccctcggccgccgcgatcagcatggcatagggaaagccgatcagggcgcaggcgatggtgaccagggctgcgatccagaaggtgcgcagcatgatcacccggttggccgaagcctcgtcggccatcgacaccacctcgcccgcggcgtcgcgcttcagatcgacggcggcgagcaggtgacgatccgtatagggggaaagcgcgccggcgatcgcctgccagtagcggggttgatcccatcggcggtcgacctcggccaggtcggccggcatgtcgccatcctcgatcgcccggatggtcttcgacatcagggtgcggaagcccgactgggcgctgttcagccggcggaccatgtcgccgaccgcctgggtatcggtcgccgccgtcagatcctcgacgatggccgccttcatctcgggcgtcggcggcgactgacgatcccagtcggcggcgacctcggcggtgcggggcagaatgcgcagcaccgccggatccgacaccgcctgcgacatcatcgtggccagcggccagaggaagaagatgcccaggaaaagcagcagcggcgccagcagcagcgctgcggcgcccttcgacccgccgccgctcatggggcgatgacccggcagtcggccgggcggaattcggcgaaaacctcggttccgggcgcccattcgcgcgatttgcggtcgagccggacggtgaagccatgcgccccgccgtccagttgcaccctcagatgatcgccctgatatatgcagtcggcgacccgggccgccaggctgttgccggtgccgcccgggcgctccgccagctcgatccgctcggggcggatcgacagcagaacctcctggccgcggacgaccggttcggcgaccgcggcgacgacatggccgccggcggccagggcgatgcgggcttcggcccccgcgctgtcttccacccggccctcggcgagattggtctcgccgatgaactcggccacgaagcgggtgcggggttcgtcgtagatttcgcgcggcgagccgatctgctcgatccggccgtggttgaacaccgcgatccggtcggacatcgtcaaggcttcggactggtcgtgggtcacgaagacgatggttagccccagccggttgtgcagggcgcggatgtcgagctgcatctgttcgcgcagctgcttgtcgagtgcacccagcggctcgtccatcagcaccacccggggttcgaagaccagcgcgcgggcaagggccacacgctgctgctgtcccccggaaagctgagacggcctgcgatcggccagcgccgagagctggaccatgtcgagcacccgtgccacccgctcggcgatctcggcgcggccggtgccgcgcatctgcagcggaaaggcgatgttctcgcccacggtcatgtgggggaacagggcatagctctggaacaccacgcccatattgcggcgatggggcggcaggtcgttgatcggctggccgtcgagcaggatggtgccggccgtggggttttcgaagccggccagcatcatgagcagggtggtcttgcccgagccggatggcccgagcaggctgacgaattctccctcggcaatatcgagggtcaggtcgttgacgaccgtcagggctccgtacgacttgctgatgccgtcgaagcggatgcgaacgttttccaacagcgtcctccagctctgaccgggtcggcgctgaggtgggcgaaggatcgtgcgggggaacgatgccgcgccgggcgggtgtcgccacccgcccctcgcgccggtcgcgggctcagcgcgccagccaggcgttgaagcgccgggtcagttcctcggaattgtcgatccagaaatcgacgtcgagcgggatggcatcggcgatattggccggcgccgtcggcaggtcggctgcgtatttgggatcgaccatggcggccgcttccttgttcggcagaccataggcaatcgtcgccggcagcttgatcatattctcgggcgcgcttgcgaaggcgatgaagtcctggccggccgccgcgttttcggcgcctttcagaaccacccagctgtcgatcgcatagatgctgcccggccagaccaccttgaactgcttgccctcggccttgttgatggcggtgatgcgcccgttataggccgtggtcatcgccacctcacccgaggcgagcagctgcagcggctgggcgccggcttcccaccagaccaggttgggcgaaagttcatccagcttcttgaaggcgcggtccaccccttcgggcgtgccgagcacatcgtagatctcgtccttcggcacgccgtcggcgagcagggcgaattcgagcgtatacttggcgcccttgcgcaggccccgcttgcccgggaacttctcgacattccagaaatcggcccaggtcttggggccgtcggcgagcttcgcgccgtcataggcgatggcggtgctccagacgatggcgcccacgccgcactcactgcccgactgggccaggaacttgtccttgccgccgagttttgcccagtcgatggtctcgtaaaggccgtcggcgcagcccagcgccagctcttcggcctcgacctggaccacgtcccagttgggcgcgccggccttcacctttgcctgcagcacgccatagccgccatcccacgattcgtccagcaagggcttgccggtcttggcggcgaagggcttgaaatagatctcgcgctgcgcgtcctgatagtttccaccccaggaaaccacggtcagatcccgggcgagtgccggttgacttgcggcgatgcagatgcccgccagaaatacaccaccggccccgatgttccggaatacgctcttcataggaacagcctcccctggcttccctggtcttgcccccttctcaggatgtcctcacaccagaatccccaacgtcgttgcgacgactgtgagtgcagcctgagcgtcataattgctgcatcttttccggcgcaccgcaacatcttttgatggcatgtcgacgagtggacatcctgccgcagcggtatgcagaggggccagcgccggccgggtcactctcccggtcgttctccggatcactctccggaggcgagcaggcggccgtcgcggcgggcggcgcgggtcgcgcgggtgaaggccaccgccgccatcacgaccagcacgccgtccagcgcgaaggcccaggccagatggcgccagggaatggtgccgtcgatcagcacctgacgcatgccttcgaagatatgcgcggagggcaggatccaggcgaccggctgcagccagccgggcagcacctcgatcgggtaatagatgcccgagatcggctgcagcacgaagatcgccgcccaggccagcccctcggcaccgagcccgacccggagcagcaggctggccaccatcagcccgatcgaccagcccatgatcatcagcgccgcgaggaagggcagcaatggccagccgagggtgaagatgtcgtaatggtagagcggccaggccagggcagccgcggcccctgtgccgatcgcgacccggataccggcgaccgtgagcatggccgcgatcatttcccaagggcggagcgggctgacgaagagggtggcgaggttgcgggcccagatctcttcgagcagggcgaggttgacccccagctgcgagcggtagagcacctcccagagcagcaggcccgaaagcagggtgccggcggcctgggccagccagtcggtgcgcgtggtgaggaagacggtgatgaagccccagagcagcatctgcatcgtcggccagtagacgatctcgacgagccgggcccacgaactgaacagcaggcgcagatggcgcagcaccagcgcctggatgcgctgcagggaagcagcggtgccggtgagccgctcgggcgcctcgctcaacgccgcctccatcgcggcggtgggtggcatcatccgttcgtggttcatgccccctccgcaggctgcatttcgggcgaccgggcgacgtcgaggaagacgtcttccaggctggcacggccgtagcgggtcaggagctccgcaggcgtgccgtcgtcgaccacccggccggtgcgcatcatcagcacccgatgggccagccgctccacctcgcccatattgtgcgaggcgagcagaatggcggcgcccgacaggtcgcggaaccgttccagcagcccgcgcagccggtcgccggtatcggggtcgagcgaggcggtcggctcgtcgagcagcagcaactccggccggttcagcatcgccttggcgagcgaaacccgggtcttctgcccggccgagagccgcccggtcgggcggtcgagcagggcgtcgaggtcgaaggcggccgagatctcgcgcacccgtcgcgccggatgggcaatgccgtaaagccgggcatagacatccagattctggcgcacggtcagccggtggggcaggtcgacatagggcgaggagaaattcatccgcggcagggcccgcttgcgatcgcgggtcatgtcctcgccgaacagccggatccggccggcggtcgggatcaccacacccaggatcatcgacatcgccgtggtcttcccggcgccgtttccgccgagaagtgcaacggtttcgccacgccggacggtgaaatcgaggccggcgaccgcttcgacggtgccgtaggtcttgcgcaggtgctcgacggcaaggacgatctcggtcatggatacgccgttcggccggtggggctcaggaaagggtgcaaaccctgtcgggcctgcaggctgttcgatcgaaggtggtccggtgccggccgggggtcaagcgcgacggccggcgacccgggccccgtccgcctgaactggagccatccgtgagccgtctcgacagtttcattcgccgcctgaccgcccagcgtgcctgcctggatcgtgccgcggagatcatccgcgatctcgacgggccggtgctggagctggggctcggcaatggccgcacctacgatcatctgcgcagcatcctgcccgaccgggaaatcttcgtgttcgagcgcaaggtcgcggcccatccggattgcatccccgacgacgcccatctgatttcgggggatctggcagagaccctgccgcgcgcggccgaacgcatcccggcgcccgccgccctcgcccatgccgatatcggcagtggcgatgccgaggcgacggcccggaacgccgcccgggtggcggcggcgctgccggttctgctggcgcccggtgcggtggttgcggccgatcagccgctcgacgatccaaggctccggccgatcgacctgcccgagggcgtggcacccgggcgctatcacctctatctcagggtcgaggtgccggaatgagtgcggccggccccacgcttccgccggccgccagcctgccgccgggcatgggatcccccgatggcgggcgggtgcgtgcccataccctggtcaccatccgctggctggcgatcgccgggcagctggcggcgatcatgctggtgtcgcaggggctgcgcttcccgctgcctttgctcgaatgcgtggccgcggtgggggcctcggccctgctcaaccttgccaccaccctggcacggccggccaatgcccggctgaccgacggccaggcggcgctgttcctggccttcgacgtctgtcagctggcggtgttgctgcagctcaccggcggcctggccaatcccttctcggtgctggtgctggcgccggccacgatcagcgcgaccatcctgtcggtgcgttccaccgtggtgctggccggcatgtcgctgattgcggtgaccatgctggcggtctggcatcatccgctgccctgggacggcgagggcggacctctcgccctgccgccgctctatgtcgccggggtctgggcggcgctggtcctgagcctgctgttcctgaccgtgtatgccgcccgggtcgcggccgaggcccggcggatgtcggatgcgctttccgccacccagatcgccctgtcgcgggagcagcagctttcagcggtgggggcgcttgcggcggcggcggcccatgaactcggcacgccgctcggcaccatcgccatcgtcgcccgcgaactggagcgcgatctgggccccgacggtccgcaggccgaggatctggcgctgctggtttcggaaagcgcccgctgtcgcgagatcctggcccggctggcgcgtgcccccgaacaggcgagccccgccttcaagcgcctgggcctgccagaactgctggagagtgcggcagcaccctatcggcgcagttccggccccgagatcgtggtcgagatcgaccccggatccgatcctgcgcagatgcccgatgcggcgcccgtgcccgaactgctccacggcctgggcaatctggtcgagaacgcctctcagttcgccaccggccgggtaacgctttggctgggctgggatccgcgctatatcacgatcgaggtgcgcgacgacggcccgggcttcccggcggatctgctgccctggatcggcgagccctacatgtccacccgccgcgaggcggggcgcatggggctcggcgtgttcatcgccaagaccctgctggcccgcaccggcgctgatgtccgtttcgccaaccggcccgagggcggggcggtggtcagcctgcgctggtcgcgttctgccctggcgggcggcagtaagggtgccgcccggccggtgtcgttctgaatgcagcctgctccactgctgcgggtccgtatcgcaagaggaaatgccgtcccatgtccacgccgccacatgtcgatgcggaagatgccgatctgatcgacctcgccgccgcagcccccgaagaccgcgtgctgatgatcctggatgacgatgcgccgttccggcagcgcctggcccgggcgatggagcgccgcggtttcgacgtccatgccgccggctcggtcgccgaagcgcgcgacctgctcaccagcctgcggcccgcctttgccgtgctcgacatgcggctggacgatggcagcggcctggatctggtgccggccctgcgggaccggcgcgaggacgcccggatcgtgatgctgaccggctatggcaacatcgcgaccgcggtggcggcggtgaaggccggtgcgctcgactatctggccaaacccgccgacccggacgatctggagcgggcgctgctgtcgcgctcgggggttctgccgccgccgcccgagcatccgatgtcggccgatcgcgtgcggtgggagcatatccagcgggtgttcgagcagtgcgaccgcaacgtctccgagaccgcccggcggctgaacatgcatcgccggaccctgcagcgcatcctggccaagcgctcgccgcaataggccccttgaccgccggaccctggcggcgccggattgtgatgcgggctggccgcccggatcggtaagcgatagtcttttgggcatggatcaattccggcgcgaacccgtcgccggcctgccccgaaggccgccatcgccatgaccacgtccgagaccctgccgccctatacggccgatgacctgctgatcgataccgtgccgccgccgaccgatccggcagccatcggccccggtgccggtcgcttccggctctggatccccgagcgtatccgcttcggcgagaccgatatgctggggcatgtgaacaacgcggtctatgcccgctggctggagctgggacgcacccggctgttcgatctctgcggtctcgccacccgctatgatcaggatgctccgacggtgatggtccaggccgagcttcggatcggctacaaggccgagctgcgctatccggggctggtgatgatcgcgaccggggttcagcgcatcggccgcagctcgatcgccattccgcaggcgctttatgccggcggcgtgctgatcgccgacagcgacagcatctgtgtcgccatcgatcgcgacagccggcgccccgcagaagtgccggcggatctgcgccgggcgctggagcgctatgcgacccgcgaacctgcggcgggatgacgggtgacggccggcctcagcgtcggccttccgcctcgcgacgcccttctgcttcgcgacggctttcctcgaattcgcgcagggccagcggctcgaacgggccggtgccgttctcggcctcgccggcttcgcggcggccggcggtgcgaccggatttgaaggtgcgctcgttgacatattcgaccagcgccgaaatcagcttgtcgccctgggccttgtcgacgatgccggtatcgcgcagtgccgcgcggagatattcgtcgaagcgccgtttcacctctggcatgcgctgggcccagaactcgaccgagccggtgagatagcccagcatgaagacctgatcggcatggctgttgccgaaatccgggctggcgagcgcgcgggcgagggcgacgatccggctcaccttcagcagaacgtcgtcgttctgaatggtgggcgccgagccctcagccagcttcaactgccgggtagtgagctcggcctgcggcttggccagcgcgtcgcgcgcgctggtcagcacctcgcggcgacgctcgcgggcatggggcgttttcgggcgggtccagaactccacccgttccaccagcttggcgagactttccgacttgatgatgtagtcgtcgccgcccgcttccaggcaggcccgcacggtttcgcgcgtgtcgagcgaggacaggaagatgatcggcacggccgagcccaggatccggcggatccgcccgcaggcctcgataccgtccatgcccggcatcatgatgtcgagcacgaccagtttcggtgtgttcgaggtgcacagctggatggcctgctcgccgttattggcggtaaaaaccgaaaagccatgcgcctccagcacgtctcggtagagcttgcggagactgtcctgatcctcggcgaggacgatgagaccacggctggtgacggtcatgttctgcctgtacgcgggccgacccgttgccgggtggtcatctgacgtccggagcggacgcgggccattgaattccgacggggtcggtaccgccgtcacgggaatccacacccatcggatacgcctccgaaggtacaccgggccgcaggcgcacaccaaggaaatccgccgcttgccgcctgtgctgcgcgattgacagcacaggttccacgccggatactcgcccctttccagcgtgtccgtcgccgttatgacgggtgcggacacccaaccgccacgaggagcgagggacaatgatcccggccgtgatgccgacctatgcgcggaccgatctgacgttcgacaagggcgaaggcgcgtatctgtatacggcggacgggcgacgattcctcgatttcgccagcggcatcgccgtgaatgccctcgggcattcccacccccatctggtctctgcgctgacggagcaggtggggaagctctggcacgtgtcgaacctgtatcagagccccggtcaggaaaaggctgcggaacggctggtggccgccaccttcgccgacaccgtgttcttctccaattcgggcgccgaggcgatcgaatgcggcatcaagatggtgcggcgctatttcgacctgtcggaccagcctggccgctatcgcatcatcaccgtccagggcgcctttcacggccgcacgctggcgacgctcgccgccgccggcaacaagaagtacctggacggctatgatccggtggtcgacggtttcgatcacgtgcccttcggcgacctcgcggccgccgaggcggcggtgactgaggaaaccgcggcgatcctgatcgagccggttcagggcgaaggcggcatgcggccggcggcgctcgactatctgcgcggcctgcgcaagctctgcgatcagcatggcctgcttctgttcctggacgaggttcagtgcggcttcggccggaccggccggctgttcgcccatgaatgggcgggcatcaccccggacatcatggcggtcgccaagggcatcggctcgggcttccccatgggcgcatgccttgcgaccgaaaaggtggcggcggtgatgggacccgggacccatggctctaccttcggcggcaatgcgctcgccatggcggcgtgcaatgcggtgctggacgtgatgctcgaagacgggtttctcgaccgggtccgccaggcgtccgaacggctgtggggggagctgtcgcagctgatccccaactatccgggcgtgctggaagagatccgcggcgccgggctgatgctgggattgaaatgcgtggtggccaacgggcgcatggtcgatgccttccgggcaaacggcctgctgaccgttcctgcgggcgacaatgtggtgcgtctgctgccgccgctgatcatcggtgatgccgagatcgaccaagccatcgacgcgatccgtcgggcctgcgacagcgtcgcatccgagatcgccacagaggaggccgccggatgacggccctggacctgaccatcgacgcgccgctcactgcggcgcggacgccccgccatttcctggatctggacgcgctgccgacggctgagctgcggcgcattctggatttcgcccatgcgctgaaggcccgccgtgcggcaggcgagcgcccgccgctgctgggcggccggaccctggcgatgatcttcgagaagccgtcgacccggacccgcgtgtcgttcgaggtgggcatgaacgagctgggcggctcggcgttgatcctgaacccgcaggacagccagctgggccgcggcgaaaccatcgccgacacggcgcgcgtcctgtcgcgctatgtcgacgcgatcatgatccgctgccacgcgcacgagacgctgaccgaactggcggcacatgccagcgtgccggtgatcaacggcctgacccgccgctcgcatccctgccagctgatggccgacctcatgaccctggaagagcaggtgggggccgggcaatctggccggccgtcgcatcgcctgggtcggtgacggcaacaatatgtgcgtgaccttcgtacaggcggccgtgcatttcggcttcgatctggcgatcgcctgtcctgcggcctatcagccggatcccgacgcggtgacggcggccctggctgccggtgcccgtgtgacggtgggcgaggatgtcggtgccgccgtggccggcgccgattgcgtggtcaccgacacctgggtgtcgatggacagcaaggacgccgaagcccgccagcgcgacttcccggcctatcaggtgaatgatgcggtgatggcgaaggcagcgcccggggcggtgttcatgcattgcctgccggcccatcgcggcgaggaagtcaccgacgcggtcatggacggcccggcctcggtcgtgttcgacgaggcggagaaccggcttcatgcccagaaggcggtgctcgcctggtgcctgggtgtcatggagaccaagtgatgacgacgacgccgacccacggcgccggaacccctgccgagcggtcgaccctggtcgaccgctcgttgccgttccggctcccttgggccgaggcccgcggccgtgttgcacggctcggcccggcgctggacgagatcctggggcgccatgcctatccggcggcggtctctgccgtgctggccgagacggtgacgctggccgccatggtcgcccattcgctgaagaccgacggtgtgtttacggtgcagatccgcggtgacggcccggtctcgctgatggtcgccgatgcgaccgcgtcgggcgcattgcggggttatgcccagttcgatgccgacgccgtggcggcgctggacacggccgttgccggcgtgcgccatcagggcgcaccctcgatgccgcgcctgttcggccgggcctatctggcgctgacgctggacccggggcagggtatggagcgctatcagggtatcgtcgaactcgatggcgagcgtctggccgatgcggttcacgcctatttccggatgtcggagcagatcgaaagcgccgtgcggtttgcggtgatgccgcccgagggcgaccggggctggcgggccggcgggctgctgcttcagcgcatgccgcccgagggcggcacggcgaccgcggccgaggatgccgaggacggctggcaccgtgcggtggtgctggcctccagcgtccgcgaccaggagctgaccgacccggatctgccgctcgagaccctgctgcttcgcctctatcacgaggatggcgccgtcgcctacgaggcgctgccgctcggtttcgcctgccgctgctcgcccgagcgtgtcgaggggctgatccgcagcctgcccgtcgacgatctggccgagctgaccgtcgacggccgggtcgacgtggtttgcgagttctgcggcacatcctatgtctatgacgatgcagacatcgcccggctgcgggcgaatgatgcccaccggcactgacgggccgccggatcacgtcgaggacgccggccatatcgagggagactgaccgacgatgaccacctccccgttccatccgacgcgccttcatccgatgcgcccccatgcgggcgtcggacccacccgtcgccgggtgttgggcctggccgccggtcttgccgcggcaggccttctggccggctgcgcctcggagccgctgcccgaggggccgaagccgatccgcttcgacgacaagccgaaattccggctgaatgtggcccgggtgcagctgctggacaattaccagccgccgcgcaaggcccccaatgtcgagcatcttttcccgacctcaccggcacgggctgccggcgactgggcgcgggaccggctggaggcggcgggtgtgtcggggacggcgcgtctcgttatccgcgacgcgagtgtgatcgagaagccgctcccccagaccggcggcattcgcggcacgttcacccaggaacccaccgacgaatacgccgcgacgctgatcgcgacgctcgagatcttgtcggagaccggcgagcggcaggcctatgtcgatgtcgaatcacgcctggtgcgcgccatcgatgccagcggctctccgctcgcccgtgaagtcgccttcgatcgcatgacccgcgacctgctggcaggattcgatcaaaggttgagtgagaatctgaatacaaccctcaaggactatgttctttgattgctcgcgtctgatcgccgcagacctcccttttcggcttaagcaaaacccatggtggtttgacaggggtcatcatatcgcctaggttctttcgaccgtcggccgcgattgcgcgggctgcggtcggaatggaggaccggggcatgaaccggatgtcgggtgtcgaggagctgccgcgggttgcccgcggtgagggtggccatcggggggacgcggcgccgacggtgcgacgttcgaccgatgccggcaatgtgcagagtgtggcgcgtgccgcggcaatcctccgcgttctcgccggccatgtgggtgaaggggcgcggctgtccgagattgcgggcgcgaccgggctgcacaaggcaacggcccatcgtctgctcgctgccctgaaggaacaggggctggtcgacaaggcggccgacacccatcgctaccatctcgggctggagctgtttctgctcgggtcttccgcatccaaccgtttcagcattcgtgatattgcgcggccgtcgctccagcgtctggccgagcagaccggtgacacgatctatctgttcgtgcgcagcggcatggatgcgctgtgcgtcgaccgcgtggaaggggccttccccatccgcaccctcagccttgatgtcggcggtcgccggcccctgggagtttcggcggggtcgcttgccctgcttgcggcgctgggcgatgaggaggtcggccaggtgattgcagccaatgccgagcgcttcgcccgcttcgactgcgcccctgaggaggtcggccggatggtcgaggccacgcggcgggccggccatgccgtcagtgacggcatgatcgtgcccggcatgtgcgccgtggcggtgccgatcaatgatcgtacggggatgccggtggcagcgatcagcattggtgcgatcagccagcgcatggacgcgacgcgtcgcgcccgtatcgtgggcctgatggccgccgaggcacggcggatcgagcagggcctgcagccggccgccacccccggccggcgccggcgcagtgcgcgcagcgccggcgcatcggcctgatcggccctcagtccccgatcccccctcagtccccgatcctcagaatccgggtcgtgacccgggcaagctgcaccgggtccggttcggtgccgaggcccggcgcatccagcggagcgaccagcccccgcccggtcaacgcgaccggaagggtggtgatgtcgggggcgaaatagcgggcgctttctgcgacatccgacggataggtcataccgggcagggtggcgagcgcgatattcgtccagcggcctatgccggtctcgaatttggccccggtgaaacagccgatgccctctgccgcaagccggtcgtggatcgctcttgcccggatcagccccccgacccggccgactttaatgttgacggcgcgggccgcgcgacgttccaggaggtcgtcgacgtcctccatcgtgtggatgctttcgtccaggcagaccgtggtgtccagccgggactgaagggctgcataggccttccagttgtgcgcggccatcggctgttccagcagcatcagcccgaaccggtcgaagcccgccagatgatccagatcctcagggccataggcgccgtttgcgtcggccagcaccggcatatggggcagttcggtacgcagcgccgacagcggctccacgtcccagccgggcttgatcttcaccttgatccggtgatagccgccatcttccgcccgccgggccgccgccagcagatcggcgacgcttccggtcacgccgatcgtggcgctggccttgaccggcctgacgtcgccgccgatacgcaccgccagcggcacgccatcgcgccgggccagcagatcgtgcagcgcgacctccagcgctgcgaccgtttcgacatggccggccacatcgcggaaccggtcgagcatgtcttccggcccctcaatctcatggccgacgagcatcggtgccagatggcgctcgatgatgtgccatgcggtctcgatggtttcgtaatggtagaagggcgattccatggccgtgcattcgccccatcccgacagcccgtcggatcggatctcgacgatcagcttggtccagcgttccatgcgctgccagcgattggcgaagggcgccaccatcttcggcgtcacgaaacgcagcacgatctcgtcgatccgcatcggggagtctccctggggttgagatgatccagggatgatagcggtaggaaaatatcaatccaacgttgaatatcgaggtaagaaagaccgcggggcccaagggcaccgcggccttgcggttcagcgtgtcatggcgccatagacgccctggcgaacgatcagccgatagggctcacgttgcgagacgctctgcatcatgtagaccaccagcagcttctcgcgcgggtcgatccagaaataggtaccggcatagccgccccaatagagatcgccggtgctgcccggccaggcaccgtcctcgccacgacgcacggcgaagcccaggccgaaaccatagcccagggggcccaacccaccggtatcgatctcgggtgtcagatgatcggcggtcatcagccgcacgctggccgggctcaggatccgggtgccctccagctcgccgccattcaggatcatgcgcaggaagcgcagatagtcgcgggtgctgccatacatgccgccgccgcccgagaggaaggtatcggggcgcgcagggtcgagcagctcgggcggcttgttgccgaaagcggcctcgggatcggcggctgccacccggctgcgcagggcctcgggcacgtggaagaacgtctcggtcatgccgagcggcttcagcaccagcccggccacgacctcatccagcggtttgccggcggcgacttccagcacccggccaagcaggtccgtcgagcggccatattcccaaagcgtgcccggttccgccaccaggggcagcttcgccagcttggctgcatactgctcgttggtgtcggtccagagatgggtgccggcagccagatagcggctcttgatcgccgacttgccaaacacgccataggtcaggccgctggtgtggcgaagaagatcacgcaccgtcatcttgtgcgtggcgagggtggtctcgaccgtcggcttgccgtcggcgccagcgacctcccggccgacctccagcctggcgaaatccggcagataggccgatacgggggccgccagcagcagccgcccgtcttcgatcaggcggatggccgcgaccgatacgatcggtttggtcatggaatagagccggaacaggctgtcctcggtcattttcgtgccggcggcccggtcctgccagccgacggcacgcagtgtgaccagctgcccgtcacgttcgacggcaagcacggcgcccggaatgcggccggcttcggcatccgctgccagccggtcgccaagggcggtgagccgggcggcatcgaagcccgcgcccgcggcatccgtgacagtggtttccgcagcccgggcagccggaaggccgggtatcgtcgtcagcagggctgcggccagaagggcggcgtgcaacgaccggcgtcggccgaccgccgatccggcaagggatgtgagacagatcatctgggtcttcctccctccgtcgcccgatgcgttgccgggcgatcatggtcggcccggatgcgacatccagacctgtcatgatcaggcggggccggtgcccttctgtcaacgtagacgggagaaaaatccgctatgcgaaacccgttatcccggcagccgtcgggccgggcgggtggccgtcaccagggcctcgacgtctcggcaaagcggctggggcagattatcgggatcagcccatatggcgtcgcgggcgtcgtcggccgcccgcaacccggcggatccggtcacggcaagacggatggccaccagcacgaaatgatggtccggccgatccgcggcaccttccgcgacctccagtaccgcgacaggttccggtgcgggcgaggcatcggcccggaccttcaggccggtttcctcggccagttcacgggtggccgcgtcgacgagcccctctccccaatgcacccggccgccggggaagccccaatggccggcctggggcgggtttgcgcgcagcaccagggcgacgcgcccgtcatgccaggcgatggcaataacgccgaccccgggcatggccggatgcggaagagcgggggctgtctcggtcacgggcgggaagctccggtcatggcctccccgcccggccggcggtcaatgcggtgcgaggcggcggagcaggtcggcggtgtagcggtcgagcatcgcctcggcattgctgccgagtgcgcggagccgatgggtgcaatcgcagatcaacaggcccatcagatagctgaacacctgacagagttccatacgccgggcatccgcgtccagaccggcataggcggcaagcgcgtctccgatcacgtccagcgcctgggagagcttgcgattcagccggcggtcaagctcgggcgtcaggcccgccggcttcagcccgtgatagagatagaggcccaggctcaactcgtcggggcggctgcggtaataggcgaaatagctgcgcaaggcgatttcaacccgttcgcgcggatccgtcgcattgccgctggccgtcgccagatgctcgtgaaggctggtcagcccgtccgagaggactgcggcataaagctcttccttgttgcgaaaatacggataaatcgcgccggtggtgcagccggcggccgctgcgatgccgcgcatcgacgcggcttccagacccatctcggcaaagaccgatcgggcggcatcgacgatgatctggcgtttcagggcgcgaaccgcctggtcgcgcgccatgcgcggtctcacggccggtgcagggccccgggcgggcagttgggtcgcggtggtggtctgcgtatggctaagcatcatggtcaggatcccccctgtgccgcccggcccctgtgtctggcggacggccgcggacccggaaattggcgggcatggttggtccatgctccgtccggggcgcatgttctcggcatggcgccgtagatggtcgagcccctcttctcgcggatgcgatacagatccggtacgccagatcccgcaggctcgttccgatatgaggaaaagcctaaccgaatcgcaattttctgttcctcggtgcgttgacagatggtgcgacgtgaatcatgctactatagcagtagtctataaacctctatggtgcatcccgaggcaggcggagaaggccggggggcgctccgatcgcctgcctgtaccggatggcgatcagccgggacagccgccagcgccggagttatctttgatgggtcagttgacggccggccggccgaccgatgctccaccggacaagggatgccatgctctctgaagcgaagttcatgaccgtcgctcactgggcaaaggatctgaatgaggaggatcgcgaactcgcccggcgcaacatgaccgagaagctgctgcccaaaggcgcctacctgcttcacgagcacgaccatgtcgacgcctggttcggcgtcatcgacggactgctcaagatcagtgtggtggctgaaagcggtgaaatggtcagtctggccggcatctccagcagcggttgggttggcgaaggttcggtgatcaagaacgaaccccggcgctatgatgtcgtggcgctgcgtgataccagcatagccctgctcaatggccgcaccttccgctggctgatggacaacagcccccccttcaacaaatttctggtccggcaactgaatgagcgtctgggccagtacattgcgttcgtcggctatggccgcctgctcgatccgactgcgcggctcgcccggtcgatcgcctggatgttcaacccggtgctcagcccgaacaaccagcttcagctcgggatttcgcaggaagaaatcggcctgctctcgggcatgtcgcgccagaccgcaagcaaggcgctgcgccagcttcaggcggagggcttgctcaggctgcaacacgggcagatcgagatcctcaatctggagcggctcagccgttacggcaccaagctttgaaccctgcctggaaccgggtcaatcagccttgagcctgccagcatcagaagcaggcccggcagttatgaggatggaaacgcacccatgcctgtcaccgacaccgcgccccgcgtggcgctggttaccaatgcgaccaaatatgccggcgcccccacggtggcggcgcttgccagccagggctggcagatcatcgcccatgacgcatccttcaccgacgtggcggcccgtgccgcctgggaggcggacaaccagggcatgaccgccgccgaggctcaggatccggccgggttgatcgccgaagtgcgcgaccggatgggcgggctgcacggtatcgtttccaacgacgcctatcccgcgatccgtcgccgtatcgaagagaccgaggcggaggcgctgcgcgagatgctggaggcgctgaccgtcttccccttcgcgctcgcctcggcagtgaccccacacctgaaggcgcagggcgccggcgccatcgtgatggtcacctccgcatcgccgcgccgtccctacccggggttcgcgatgtacgcaaccgcccgctcggcctcgaccgggcttgccaaggcactggcgaacgagctggcgccccatggcatccgggtgaatgccgtggcgccgaacttcctctacagcgagacctattacccgcgcgccaaatggatcgacgatcccgccggtgccgcccgggtgcgcgagatggtaccgctcggccgtctgggccggcccgaggagatcggtgaactgattgctttcctgctgtccgacaaggccggctttgtggtcggcgagaccgtgggcttcaccggcggctggccgtaagacggggctgacaaggcaccggacatggaaaagcggcctgcaccgggtgcaggccgctttttgaatctggtgccggcggtaggaattgaacctacgacctactgattacgaattagccgacatttaatgaaatcaagggactgcgcactatttttaggcggaagcccttcattcttcggataaagtcggacgcggctacggccgcgccttatggtcatccttgatcatgtcgatcaggccgacaacgccggcggcaacgccgacgatctgcgccgcgacggccgggtccagctgcacgcctgcgaacgtcgcgacccagaccaggccgcgcgcggtggacggctgaagcagccgccccttcatccacgaccacaggccgtccttttcctcgtccatttctctgccctccttcctattgttccgcggcgaggaccatccccgcccgcatcatgcgcagcgcccgccgggtccagccgccggcgttgtgcccccaattgctcaggctcgccagatactggatccgccgcgccgtcatctcctcgatcagatcggccgcattcgcggcctggaccgcggccagcgtccgcgggccgatgatcccgtccgccgtcacccccgccgcctgctgaagcagccgccgggcgctggcccccccctgcaggaacgccatatcggccgtgaccaggtccacgccggccggcagatcgtcgccccggaccggcccccagaaatgccgctcgaacaggcccagcgccaccggctcggtgaccagcaggatatccgcccgtgtcgtcacgccgtcgccgtcgaggtccagcccgatcgcgtcagcgaagcgcagcgagatcccccagcgggtggtgccgcccggatcggctgccgccgaccggtcggacacggccgacccgccttccgccagggcgatcgccgcccaggccgtcgatcgattgtccttcacactccccccttccgggcggccagcagccgccccaccaggtcttccaggccccgcgggccgagataggcaatcgccacgatcgccgcggtacgcggcgcgccgaccagcccgagatgtgtcgccatcccgtcagcgacgagacctatcccgatcgccgccaggagctcccacaataggtgagtgctgaaaaaacggcgccggccgcgctgtacctcgccgacatgccataggaggcggcccacataggcgagcaggcatgccagcccgatggcatcgcaggcttgccgcgcggcggcccagatatccgagagcatcagaccccatcacgatacggatagacatctcgcggtccgcgcccgacagcgcgcagggcactgatgtcgacggatcgcagggcgccgccctgagaccagacgaccgcggtccccaaaagcatcgtctggaacagggctccgccacggactgtaatgctgtccccgacagcaaaatcgctggcgacatcgtatggcacctgtattgccgaaccgccggatccgataatcttatgtgaagaagacgatgtatagacccatcgtcccgtatattcgttttcaggaaaaactgcagatgtgatgatgttcgtcacgccggaagaatatgacgcggacaggaccgtcatatttgctatctgtatgaagaaaggtagatttgactcaatccttgctcccatggtaatatcaagatcgtggctcggcgaatattcaacataaacatagtctccaatgctgtattcggagacttcagatgttgaatatagatttacgccatagttataataagtgtttatttttgagcgccgcgtcaatccatttccgcgacctgcaatatgatgttttgcccacggcgttccggttgtgaggctcgtcccgaagctgatcgagttcccacttttgcccgccacctgggccacacctttgatcggtgttgacattttgccgtcgaaaatcgcaggcgtggagctggacacatcggggtgagtccgctcgatgctcccggcccatgaaaaagccgggccggtcggccggataccttccggcgtctggcccgtcaccccgtagctaccgtcaatgagcacgtgcacggccccaccaccgccgccgagggtacagccatcgtcagccgacaccttgccttgtccgtggatggcgattttcgggctgccgatgaagccggaaaagagatatgcgctcagtctcaggcggccttcgatccacataccacagacttctggcgatccacccgaggcaaaaccgcaatcaatctttccttcctggatatatatctctgcctttgcggccacaaatactccgcaatattttggctgttctatgcgaagtccgtttatcgctatattattgacgccatttccgaatataacggcggaatctgtatagggatacactacgcggtcattccgcgacatgggctggaatatgtcaatgtcagtccatcccatgtcatatgggccagacactctaatgtgcggcccccggcacgcggtgaaccacaggttgtttagcgaccatccattagcccctgattctggtggtgcacccgccgcaatatccatcacaataagacctgcggaagtgcagttcttaaacccaatatgacttataactacattattttggctgtcaccatagaagcaatatctgtcaggatttgtcatttttatccatgatactgttctatgtgcaccaattattgatgtatttccgttgacattaatccgcctggtcatgaggtattcgccctgagggacgaagaccgccccccacctgacggccgcctccatagcgtcgctatcgtcagtgaccccatcgcctttcgctccccagcatttgagggagagacgctccctgccggctgtcacccggcgccagagacctggaccgcttgactgtccggtcgggacaagccgcgtcccgccgtcgtccggtgtcaggcggccaggaataatttcggacggtatccagggggacgggtcccaaacgtacacaccgccagccccgtcggtcgacgcgtagtatccgatcgcccttatatagataaggctttcattactgctcttcatttcctcgaaattatacgaccttatttcgtcaacagatgaaaccgtcatcgtgttgctgaatgagggcatttgaatataggtcagcgtcccggctgacgtcatcgccagtattttatttgcccgcgccgcgacgccttcgagcggcggctgcgggccgtccgcatcaggaaatcggaccgactgcgctatctgacgctcgatttcctgcgaccacatgacgatgcgatccagctcttgattcatcgcccgcgcggtgaaatcaccgctctcgatgtagtctgtgagccgtctgatcggcatcgcgccgacaatcgcgatcaaatctccagccagcgccggcagagacagcgtcacagtggcggtcgcagccccgataccggatacgctgtaatcggtatcgagcaccagcgtcacatccgcgccactgcgccggcgcaccacgcggatatcaccggccccgaagactggccagctgaggggaagcgatgtctccccgccggtcatctcgtagcgctcgactcgggtcgagggggtgacaggaaagtcggccatgggatcaccctccgtccggagatgtcggccagccgccgccgcgcgggatcacgcgggacgggggcagcaggtatttctgattgttctcccgggccaggcgccgttcgtggcgctggagatagcccggggacatggcttcctggagattgaacaggacgagatagtcaatcgcccaccgggtgtaggccaggttcaggaagggcgtgttcgccgtgaccagccgcagcgcggccgcggacgggtcttcgccctctcggatcccgtagatgacgttcatgaagtcggaggcggtcgggaagaaagggccggccagcgtttccagcgcggtattgccggtgcggctataggccccgaacagaaaatcgccgtagataccggcgccgccgccctgtgccatggctgccacccaggttcccggattggccgggtcgcgcggctcgcggccgcgggacatctccttgaggctctgggcgacatagcccagcaggatcgaggcggtcagctgatggatgacggccgcgaccttcgccggccgggccgtctcgccatagagcgtgcggccccacgacttattgaggacagcggccgggaacgacttgaactgcgtgatcagccgcagcgcctcgccccattccgtgcccggcagggtgccgccggtgaggatggcccgctcgtcgacacctgcctgcagaacggcatagtcgacccggtcggcatacatcgcgtccagcttcagcgccagctcttcacgcgcgcggatccggccgtcagccagggccttttcaagccgctccggcgcccgctcgatgcgctccagccgctcgaccagggcgtcacgcaccccgtcgatagcctgcgccgccgcgtcctgcgcagcctcgccgcgcgcccgtttcgatttcagcgcggccagctgccgggcgaatttctcgccgatctgccgttcggcgcgcgcgagagtattcacctcgcgggccatcctctccagcgccttgctgggcgacaacttctttcccgcttccccataccgcagcttcataacatcttgcccgagctgggcagtcgtcttttgatagcgccgcatcgcgtcgacagtggcgcggatgtccagcttttcggcgtcgcgatctccgggcaacatcttgtcgagcacggcttgcagcttttcgatccgacgcgccagcttatctgcctgcccgacatcgaccgacagccggtcaagatgcgcatcaatcgtccgctgcacctctgccgcccgcagctcgtcgagggcgtcatccccgatctgccgcgcccgctccggcgtcaggaaaacgcggccttcctcgtccgtggtccagggcagcttacgcagcgcctcccattccgccggcgtgatgccggcgccggtcagaagccgccgactttcgggcttcaaggtgccccacgctcgatcctgctgtttgcccagctggtgcgccatcagctgtacggcgccggtgcgctgcgcatcggtccagtaggaaatccccgtcagctcgaaaaacaggttttcccagcgcgacagcttccccaacaccgacggatcgtcggcgtcatagcgggcgtgcagcgcggaaatcatgccctcgacgccaaggccaagttctgcggccagctcggggttctggccccggcggccgcgcacggtcgagaggacgccatcgctatacgcctggagcaatggcaacccctggtaccgcaactctgacgccttgccggccaggtcggtgaccgcagaaatgacaatcccgcccagcttcgccgtccgctgctgcatgcggatcagctggccgacgcgcgcgagggtccgattgaccggctgctgcgctgtcccgtccagcacgtcgaaccggcgggtcagcgccacttctcgcgatttattgtggtccatccgcctggtcgcgcggatgtattcaagatcggcctggaagccatagcgggggttcgtcccgaacacctccatcagcgccgcattccggctcccgctgtccatctcgcccagccaggccgcgatcagattttcggcgccgaatttctgctgatagtcaaaccagccatcggcatcgcgccagtgcagcacccgttcatgcgacagcctcttggccagattgcccggccctttgaaggccggcgccttgtcgaagcccttccattcctgcgtcaggtgcacgccgctcaccagcgcttcccaggccgatcgcaggaaggcgtcccgatcggtcacgccctcgaaggtccgctcgtccagccgcggcaggatgtaatcccgccagctctcgaagccggcgcgtctgatccgatccggatcgtgagccgtccgcgcaatccggccttcatactgcccgatccaggcgccggcgcgattctggatctcgcgcgcccgatcgaggtatttcaccccgatctctgcaatctggccggcgctcttgttcttcgtgatcccggtctttccaccctcgcgattcaattcgaaaacctcgcgggcgaccagccgcccgaattccgggctcgccagctccttagaggtgacaccggtctgccggatctcggtcgccatgccccgcagcagcgtggtccgcagccctttcgcccgggcctcgacgctatagcgatgccccgcgaatggggtattcacgccggtcagaagcgctttgaggcccatataggcccccggggtgtcgccgaccttcggcgcggtatcgatcagcccccgccgcgccgcctgccgttgcaggtcaagccgcttattccgggcttccacagccgccgccgcccgggcctgtgccgccagctcttccgccgccacccggcgcagctccgcgtccgccagatcggcgcgggtcgcccggatgctgtcggcccgggcctgaatgcggtccatcaggtccagcgcttcagccggcgtcacctcgcggcccatcgccgccccgatatccgccgcgcattgctcgaagctcatgccgaccgcctccccatgcagaaggccgcggcagcccagcccgaagcctccgcgtccgcctcggcatcgagcgcggcgatttcggcccgtgccgcctgcacctcgtcggccgacagcgcgccgacccgaacggcttcgtccagctcggcatcaagggtcggatcgtcggccggcatctcaatccccgcctcgctgcggcgcggcagcgggtcatcggccggcgccaggcgttccgccgcctcgatcgccgcccggtcctcgatctcgcccgcctgtgcgacccggcggacaccggccaggatctcgtccgccgtcgccggcgccgtgccgaacatgtcgggcacgggcgaggttttgacggccgcatccacataggcgcgcagatggcgggtgatcgcctcgcccgatctggtggtcacggtcccgtccggccgctcgaccagcatcccggccaggaacgccgacgtcgccggcgtcggtgggtcgaaggcgtcgtactggtccatcacctcggccagcggccggccggcggcccgctggtcgcggatcatccgcacggcccgcaccaggtccgtggtggcatcggcgccggccgaaatctgcccggaagccgcttccgcccgcatccgcgcccaggcgggcgccaccgcttccagcgcattccccagcgaccggctggacgggtcggccgcctcggtgatccgggccaccagatccgcatcgccgaaggcgcgcgccaaaagtccggccttgattcgccgcagcccgtcggccgacagatcgcccgtcgccgtcgccagccggccgcgctccgattgcggcagcgcctccagataggcgcggacgaaacgggcattcgcggccgcgtccagctccgcggcctcgtccagataggcaagggcgcggtcgatcgcgccggcatcggccatcgcccgctcggtcgccgacagctccagcgtccccgacgactgcgccgcgaccgtgaagcgccggcggtcttctggcgtcaagtcagagacccggcgccgcaccagcaccggcgccgtcatgccctcgatctggtagccctcccgggcgaggaatgcgcgatagtcggcgtccaggccgcgggcataggcctcgcggatcgcaagcacccggccatttccgctttccacgacaccttccgccgacaccaccggcgcaccggtcgcggcatcggccgatgcgcccaggcgcgccggctgaaggtcggccgccatcgccgatatctgctcgcggctggccatgcggtcgcgctggcggggctgaagatccgccggaaaggccggattgatcgtgccatcagccagattgctggtgaccaggctgtcggcctcgaccacctcgtatcgcgtctgtatccgccgctgctcactgtcatagacttcctggatgctcgaccggcgcgccgggcgccggggcggcatggcggctcgtaccgccgcgccgatttccggcggcaccggccggccttcggcgacggcgcccaccgcggccgacatcagcccctcatgcacatccgcccggccggattgcgtcaggctgtcgacggcttcggtcgcgggcgaccggtagcggcccagggcggcatcacccgcgaagccggcgccggcatgcaggccgccgcccatgacaccgccgaaggcgacgttgaggatgctatcggccaggctataatcggcccgctcttcggccgtcatgcccaggatggccggctccagcacggccgcaccggccgcgccctcgatggcgcccagccgtgtccgtaccagcgcccggccggccgcactgccggcgccttccagcgccgtggcatagcgcgcctggcccacgaaggggataaagcttgccgcgatcccgatcgggtcgagcagcgatcgccacagcccgacgcccagggcctgcgtgccttcccagatgccgccctgcgcgcgggccagcacggattgacgattgatttccgcctgcttcaggtcgcgcagctcccgcgcgatcccctcggcgaccggctcggtccacgacagctgtccatcgatcccatagaggctattcgcctcttcgggatcgagggtgcggccctggtcttccagccgtcgggacagccagcgccgggtcagcggcgtgatattggtcgccgaggtctcttcggccgtggcgtcgagcacggccgatgtcgaggcgggcagggtcgcgtagccaagcgcctcaaggcgcctgttcggggcggtgggttgcgtgtagatgccgagaccggtcatcgcccggtctcctgcttatacagccgcacatcgggatgccgccgcgcccaggtcttcaggccggcgggatcgccccggaagcgctgtagcacctcgaaaatccgcggctcgaaattgctgggattggccgggtcgaaggtgtcggggtcggcgatcagctcgtcaatccgatcggccgccagcatgttcacgaagggctgcccctccgcgaaataccagctatcgacctcgcggcccgcgctgtcgagctgcacgaagagacggcggggcgtgcctgcgctgtcattatctttggtcagctgctccgtctcttcgccccaatagccactcattcccggatagagggtcacgattttcggccgatcgccgaccagcatctggcgcgcctgctcgtcggtcacccgcatttgccgggcacggccttcaaggtcgggcggatccggccaggctggcgcactcgggacgtccccaaacgacaactgcatgatactgccgtcagccaggcgcaccggctggccgcgcgcgtccagccgcacccagccatcggaggtgtcgttgatcacccaccgtcctgcccgggccgcgtccagcgccgccgcgcgccgggtggcttcatcggccggcagggcgccagggctcgggcccgggtccgccacatccgccggcgtgagcgcggtcacaagctggctgccataggcttccgtgcgcccgccccagccgcgcggcgccagcgccgtggccgccccctggcggacgatgtccatccggctggtcagcgcttccacggcgccgctggccgccgcatccggcgccgcgccgccctgcatccgcctcagcgccaggcgcagcgcggccgcctccatttccgccgcccgctgcgggccgtcgggcgcatgcgccagcgcctgatcgatcggcgccatctgggatcgcacactttccttcaccgccttcagatcgccggcggtcggcgccagccgttccagatcgcgcatgggggtgtccagcaccccgcccagctccgcccgggccaccggctcgtcgaccatggcgagaacgcgatattccgccggcagcccggccgcggccagctggcccatgacacgcggccagtcggcgccgtattcgccttccagcgcctggatggcatcggcgcggccctcgccgcgcgccgtgctcaggcgtcccacgatttccgccgcctgcgccttggtcaacaggcgctcttgaccggccgggatgccgaggcgccgctgccattccatcagctcgtcgccggccacggggccgacagtgcgcacgacatagccggccgggtccgcctggatcgcctcggcctggtccttcagggccgcgaccacccggccataaacatcggcatcggccgcatagctgccggcgccgcccttgggcgcgatcgccgccgcgatcgcggcccggtcttcgggggatgcggtcttgccggcggtcaccgcctgatactggcgctctgccgccgccacggcctggcgatacgccgccgccggcgccgcgcccagaatgctgcgcaccgtctcgggcgtcaccccgtccacgccctggccggtcgtggtccggctctccagatcagaggccaccagcccgcgaaaggcctcttcctgcggcgccagacgctgcgccgcccgggcggctgccgaggcatcatcggcaaaggtcgcagcgcccggcttcggcttgatgccttccagcagcgcggccagctcgtcgggcgtcgccgtcgccgcctgtgtgacgacgtcgtgcacccggcgcgagcgcgcttctgccgccgccagatccgcagcggccgccggccccagaacggccgcgaccgtcgccggcgtcacgccgtcgacaccaacgccggtcgcctccaggctggccagatggctggcgatccggtcgcgcaggatggccttgcccacggctgcgccggcatcgaccttcgcccgatcggcttccatgcgtcgtgtcagctggtcgatctgctcttcggtcagcccggagcccttcggtccaagctcgcgtttccgccagctgtcgatccggccttgcgtcttcggcccggtttcccaccagcccatcaccgcgttttcgcggacctcggcgtcataggcgttcacccgctcctggatcgcggccagggtgagcgcgccggcgcgggtcgggtcggccggatactcgacaccgccgaacacaaatgccgatttcgggccaagcgcgatcaagtcggcttccagcgccgtcatcgccccttccagggccacattcgcatcggcgtcgcccgcggcagcctcgcgcgccaggcgctgcaccagcgacaggcgcttgggctctgccgccgtccaggtcgctatacgctcatccgcgacccgggcgtcagcctggcgccgggcggcattcacataggggcggacgagtgtcccgaaagaggcgctgaaaatcgcccgcccttcctgagacgggatgccctccgccgcccctttggcccaggcatccgcggccgcggccaggttctgcggcgcggcctcatgttcctgcgccaggcggtccagggtgtcgagcgcgtcggcttcgaggcgcctggaataggtctccagcgccgccctgttataggcagcgccgcggatcgtctccgggtccatctcggcatactggccggccgcgccggcggcggcacccgctgcggcgccctgccgcgccgcgctctgtgcctcgcgttccaggcgccggcccaggaagacgtccaggcgctccgacagcgtgcccaggccgcgggccaccccatcgctctggagcgtctgcaccggcccggtcgggcggatgccgagcggctgataatcggggatcagcggtcccgggcgccgcgccatcagccgatcgccaatcggcggtcgacgaaatcaaacaggctgccgccggcacgggccgcgccgccaatcacggcgccggtcgcatcggccctgagcgcacgtgcattcatccggcgggtgccggatgcgatgatggtgttgtcgcggttcaccctcaattcgcggtcggcatccgccgccgcgcccatctgcgcggtctggatcgagccggcattcagatcggctccggctgcgccggcggcggcagtgccagcagccagagaggcgatcaggcgacggcgggtttcattctccgcttctcgccccctgataagctcttgctgcgcattgaaattttccatcttggcttgactccggagtgcggaggcctggccaagggccgacgcgaagccaagaccggccgaggccagagacaggccgccggtgatcagcccggccgtggtgacggcgccgccggcgccgaacagccccgccgtggccgccgtcgcggccgtcgtcgcggtcgcggcagtgcccgccgatccgacggcaagcgcggtcagggtctcgaccatcagatttgcacctccgccaccagcccgatcacctcgaaaggccccggcgccgtctgggtgatcgtcaccacggtctgccgatcccagccgctgaagccgtcgaccaggatgtcaccggtcagcaccgggggcgcgcgatcgagcggcgagccggcgccgatgccgaagcgccgcgccttcaccggctcgccggcgacggtgacgttctgtacctcgacggtccgcagcatcacgcggaccaggcgcgacaggcgccccatagccggcccgtccggcaggctgggttccagcggatgggtctgcaccagcgggatcgcccatagcccgacttcgacccgatcggccggccgggccagggtgaccgcaccgcccatcaccacctgcgacggctgaaggctgccatcggcgatgatcatcaccgtggccccttccagccagtcgagcccggtcacgctggtgatcccgtcaccggtcgcgaccgcggcgccgtccagcctgacggcctggtcccagcgctcgatcagatagcgggtggtgccggcgatcacccggcggatcagccaatagatcgtcccgtccacgacggcgatgtccagcacctggcccgccggctcgaccagcgtccagccggtgacctgctggtcgcgcagggtattgatcacggccacggtcccgtcggtattgacgcagaggacatagtccgtgtcgtcgtcgcgcgacgtcttccgcacggcgagccgcaccgggtcgcggaccaggtgctgggccagcagggacagcggcgatgtcgtgtaggcctgggcgacttcctggtacacggcttcatggagcgtgcggccgccgcgctccgcaaagatccatccgcggtcgatctcgaccggacgcggcggcttgctcggcgccagcccgcgccgcgtctgttccgccagtgcgaatgtcttcggcgtcagggcagggctgccgccccgcagcgccatatagagcgcgcccgtggtccagacgagcaggtcagatccggaggcgatcgccatcaccgcgttgacctggtcgctgtcgatcgcggcatcgatgccctgatcgtcgagcgcgtcccccaagtcgaaattgaagaaatcccccacgacgctgccgaaaatcgacgatggtcggcgcgccatccgccccaaccacaaccgcccctcgtggaaggtcactgccccgggccagccgcgggcggtgctgatcaccggctcttccaggtgccagtcgtccgcggggatcgcgtcggtatccgaaaaagcgacgcgggttttcgccttgacgctggtcgcggaggtgaattcggtgatgcgcgcgatcccgccattgcccttgaattcccagccgttcaccatcgcggctgtgaagaccggatcggtcgcggtcagcgtcaccgtatcctcttccgccgacggcgtgaccgtgccggtcggcgtgacggcgccataatcataggtcggaagccggctcatcggcatcgcgccgatggtccagtcggcatgcgtcgcaccccgcatcagccgctgcggcgccatgctctggtgcacggcaatcagggtgtcggccgactgcgcatagtccagttcggcgaccacggtcgcatcccagggcgtcgcgatatccgcgacgacggcatcatcccggtagacccgcagccgattggctgtcagcacgagaaggtaatcctgctcggtattgaaggcgaaggggatcagccgggcgccgccggcggcatcatcgagcgcgtcgaccaccacccgccccggcgccgcgcgaaagccgccctgcgggaaggtcaccacattccgggccatcctgacggacccgtaatattgcttcagatcgatccgcgcgccgacctgaggcgccagttcgccttgggtgaaattgacctgcgccgtccggacacggggcattgctcaccccccgaaacgcgcggaaatcagcgggaaatcggtgatcaccgccggcggctgctgctggctgtcgatcgtccgggccacccgggcatagccccccgtccgattttcggacggcgtgccccaggtcttcccctcccagaaatccgctttcgtcgtctgttccgtgaccgggatcgccagcatggcggtcagcgcgaagacgaacagctgccgcacatgggctggccacaacgcctccggtatccgcgcctgataatcggcccagacctgcaccgcctgggtgtgcacctggtccccgtacagctcataatccggcgccgcggcaaagagactgtcgctcgaccagatcccccgcagcaccagcagatcggccggcagggcataggcataggaccattcggcaatggggcgctccgcaaggcgagggaggcgcgccttgcggagcgtgctacgccacggatacgacgagaggacgtcatcccgtaccgtgccgtagagggtcgacacgatcgacgccagaccgctcccctcgtccagcgcctggatcgatcgcgatcccagcagggcgagggcctgattggccagacggacgtcgagcgcggcgacggacatggggtcagtccgtgtcggtgacggtcatcgccgtcgcatcggtgacgtcgatcacccgcgtggccgcgttgacgctgttcacgatcatgatgccggcggcggtgaccgcgccgccggtaatcgtggtgacaaaaatccagtcgccgaggttgaaaagcccgaacgcgtcgttgaagtatccgctggcccgcacggtggccaggggatcttccgagacgtaggaatgcaccatggggccgcctttcacgacggcccccgatgccatgtaggtcgatgcggactggccgccgatcgcgttcaagcgcttcagggaaaaggccatggtctcgtttcctctcaggccacgggcggtgcagtttcggtgtgctctatgcggatcacacccagcggatcgatgaccgcggccccggccttgatcatgccctgcaccaggtacgcccccttttcagggacccagtcgaccatcgtccgcccctcgaagcgccaggccatgccgatcgctccatcagcgccgccatggaaggcgaacgacgtgcagatgttgccgacgcgcggcagaccaccctccgggcgccggccgatcgtcttgaagcggaagcccaggaagtaatcgaccttgccatcgaccagcgccttggcgttggcgtagtcggccgacgtcacctcgacctgccccagcaggctttcgatcgccatggcatgggtcagcatgtaccggtccgtctccggcacttcgaggtgatcgaaatacgccttcgcccggcgcagcttggcgagattcaggccggtgccggccccaccgacatcggtatcgatctgcacgctgggctggccggtgaccagcgcatcgatgcccacctgatcttcgcggcgccccatggcgccaccgaccttccgggcgatctgggcgcgatcgtcgatgttggtgttgttgacatcagtggtcttgatgtaatcgcccgcgcgccatccccgcgtgctggtcctcacgacatcctgaccgctgttcgcagccttgatgtcctgcaccccgttatcatcgggataggcgacgatttcatcgcccaggcgaaattcgacttcagtcccgacccaatcggtcttcagccgggcggtggggcgcagcaccccacccttggatccgtaggcggctttgaccctcatgtcgtaatcgacctgggtcgccagcgaggcaggaacggacatatgcacctctcggcgctgcgatatcgcagcgtgcgatcatccatcttcgacgatcgcgaccgatcggcccggtgctcgcgggtcagtcctggcactgccagctgataagccgccctgacgcggggtcctgtcgcttggcggatgcgtgccgccctgtcacgtgacgcatccggcgccagcgggtccggtcccaataacgggataggcggacgcactatttacacgatcaaggcgggtgcatgtcaagttgacatgacccgcctttatgcattcaggcattttgtggaaaaaagtttcctcgtttcatctgatcgtgccgttggcgatcaagcggttgatcatctcctgcgccttccgctgcttctccggggatgtgtcaaagtccttttccttgtacagggcttcgacctcggccatggatccgacgcttgacgacatgctcatcgggtccatcgggatcgacttttcgccagccagatcccgcagcttcgacagcatgcgcacgccggcggcagtccctgccgccagctggaattcctcccattcatcggccgtcagggcctctttctggaagaggcctcttccccactgcccgacggctttcaccaggccggcgccgccggtgcccagcttctgcagttccgccttataggcggcctgtctcgtttccggggtctccgccggcggcatggcttccgccagtgtcgccaggaccggggcgatcagggcatcgaactgcccctgcgaaagcccctgcgcgtgtgccgcgtcgcggaaagccttcaacgccggatcgtcggccggcacgtcgagaatcggcttttcacccagctgcggcagcttgtaggcatccgccgttgccggcggcttatgatcgcccttgcccagctggcgccgcagatcctggtgggactgcgccagcttttcccactgcgcttcgcccttcgttgcgtcccaaaactgctccggcagccactccggccgctgctttccagcggcatcggcgggcttcccggcatccgccgccggtgcggccgtggtatccgtcttctgatccaccatgtcaaacaggctggacggcactttcggcgccgcatcctgccccgcggccggtgccgccggcgccggcgcatcaccgccggcaccttcaccttccggcgcccgcagcagcgccgacttcatccaagatttcacccgcatttcacgcgcccctcttcccgcgttcggcccgcttgatgatctggcggacgatttcattctggccttcgcgcatatacccgtggtcagcaggctgaccgggcacccaggacggctgatcgatcgtcaccgaccgcaggtattcgatgacctttttcccggcccgtgtgccgaaggtcatcgcaaagaccctgtccagctcatccgattcagcctgaagccctttcagccgctgcacttcggcaacggccgccgggccaagattgtccatgtcttcccatcccggaatcatgctgcccccttgttctgcgcgcctgccggcgccggcttggtcagattgtccgccacccgcgccgccacggggctggtggccagcatctgcgcttcagccccctggcgcgcatcctcgcgccccttctgcctctccgtgacggtcggcagaagcttctgaggcacgcccagcttgtcggcgagccagtcatagaagtcgtcgcgtttgacagcctcctgaacaacttcagggccatatatctgcgccagtatttgcagatattgcgtgaccgtctggacgtcggccaggttctggacctgagccaacgggctcgttgctttgatcgcgatttcccgcccgttgaccttcagggggagggcgacttcccccgcctcactcaggatatcgaggaagcgggcaatcgccggctctgccccatcactgatcaggcgcccgaaggccgccccgatatcgcgctgaagctcgcgggtccgctccatgatttccgtcggagagcggaccggcccggtctccggcggcagctggcgatcaaagagcgcgtccttgatgttctgccgcagatcagacagcacgatctgcgacattcgcacgtcgccgactgacggcaggggctgcagggatgccccgcggccgccgccattcgatccgaccgggatcaaggccccggggcggatctgaatggtattgaggttgaggacgccatcatccacggccgtgaaagccggcacgatcgcgagcgatgccgcctgaagcacgagccggaccacggcgttggccgtcttgatgtccggcaacacttggatgaccggcccacggccatagacctcgcccggcgctttgagccagcggaagcagatccagggcatcgtgttgtgcattcgggcgaccagccgggccggcgggctgccgcgccacagcacgtcgaagcggtatccatcgtcctcggcgtcgtaataggtcgcggtctccagctcgatttcggcgttctcatcttccaaccgccgccgctccagctcgggcggcagatcggcatccgggtacagacgcaggatgtcccggaccaccaccttctgtttccagaagacgccctcaacgatcccgaatgggccttcttccagggcagccagtggcgccggaaccgcctggcattgaatcttcgcgcctgagttccttctcaaggcgtgcgccgactgcaccaggatcagcccggtactgacgctcagatcgtgcagcgcctcattgagggcgacgtcccaattcgagagatgcacctccctccacagcacttgctcgacctcatcgagcgctttctgcacctcgtcccggtcagcctccgggacatccgatccggcatcaagcgtcgcccagcgctggcgggctgggaacgccacgtcctgaatgcgattggcgaagcggctcacggagccaatcgccgtgctgtcatagaccgcatccgacttccgcgccccttccgccgtcgtcgtgatcgggtcacgctcgggcagcgcatagcggtaggcctcctggtgcaggcttcgccaggccgcgttcctttcccacgcccgatccgcccgtttgatgagcgtcggcacgtccatcgctgccatgtcagcctcccgtcgtcgtggtcacaccacgttcgtcattcgacagcagcagcgcccggccctttgaccgggaggtgatcgaccgccgccgggcgtcctcttcggccttcaggctggcggactgccgctccgcggcctccgcctgccgcttctgggccgccaccaattccgggtccggacccttcggtttcgaaagaagcgcagacatcccctcacccttcccctttcaactcgacgcccccgggcgtgggggcggacaggatcggccgggcaccctcgcggcgcagccggcggtagagctgtcggggggtcagcacccgccaggaccgcagcccgacaaggtgcgccatcaccccggcgcaggtatagatcggccggtagaccggcgcctgggccaggccggccggcaccggcaccgccagcgcccagccgccggccgccagctcgtcccgcaccgcgtcgcccagcggccgcgggtcgatcctgaccagcattcggcccgccacggggtcgaccaccatggtcagcggcctgtcctctgcgccgatcgcggccagcgcgagcacgtgccgccagcccgggcgggtgaacagccgccaccaccgccgccggccgtcgtcgggcaccaccccgcccacgacgacgtcgcccttgaagatcaggatccacagctgcgggtccgacagcgcccacagccgcgccagctccgacggcggcagcagcttccccggcgccggcgtcgcggcggcgggggtggcccgggcgctggtcatgtgctcggtcatcgcagcccctcaccagacgctgaagtcgtgcggagcgacaaccggccggccgccggcgtggcccatcagccggtcccgctggtcctggcggcggcgggtcgcctcgacccactcgccgccgcccagaagcaggtactgcagcgcatcggcaatgtgcgagtgctcggacttcgccggcacgtcctcgtaccgctcgccgccgccgggcaggcgctggcgcttgtaggcatagccggacagcagcgcccgacgcagggtccggcacctcgggctgatcaggatcccgggccggccgtcgatcatccgccccagcggtgcacggacggcctccagccgcggcagcagcccgttcgtcaccgtcccgcggaagcgcacgccgctcgctgcggaaatcgcgtccatccagctctcttcgtcggtgctggcccggctggtgccggccggatcggcccaggcctgccccacctggtgccccgggtaccgatcccgcagcagccgcgccagcgcctcgccgaagcgcacggcgccgataccgcccaggtctccgaccagctcatcaaggatcacccactgccccgtcggcagctgctgcgcgatcaggacggcaggggtgaggcccgcatcggcgcccagccggagcggcacgccgggggccggctcgatcggcgccggcgccatgtgctgggcctccgagaactcggggaacaccggctttccgtcacggctcgccccccaccgattgtggatcatccgccggacgtaccactcatcgtgccccgcggccgcgcgctcgtagtagtccggcggaagattttcgacgttctcggcgccgggatcggtgccaccgggctggacgaaaagccgatatcccggcttcggatcgtcgacgaaatcggcgcgcagatagtgatccgtgtccggcgcgttgaaatcgcagatgatcccgcggaaggtcgggccgccgtgccgtctggacggatagcgcgtccggcccggcaggaaggtcaggacgtcccggctcagaaggtcgacctcattaagccagccgcccgtgatttcgaaaccgcgggtgaacggctcgacatcgttgtcaccgatcgcggcgaacatgacctcgctgtcgacgacggacccgtccggcagctggtagcgcaggtggtgcgccgatggcgcattgtccccgccgctcttgaagacaccgaaatcatgaggcacccacccgaaccagctcggcagcaccgtccgattgatccggcgatacgtatcgcggagcaccacccaccggctgtagcgcactccatcgacagggctacgcccctgttcgcaggccagggccagcagcttcgccacgcaggcgcccgtcttgccggagccgatcggccccatgatcgctgacacggggcttcgatcggccacgaacgcgcctgcgatcggccccggtggagaccattggaagacctgcggtgtcctcacactactaatccctaatcagtggtatcgctggcattttcgccagcaatatcaatgggttgatcagtcacgttcaactcgctcgcgttcaactcgcggcgagcgtcgccgctaagctgttgatattgctcacttgtcagatccacgacatgaacggccccgtcgcccggcgccgcggccgcgctcggcatctgaaggaccatcattggcagggcgtcgcccgtgatttcgacggcctgcggcaggcgctggtgcaggtacggcgcgacgtcgcgggctgcggtcatctggatcttgatcgcctcgatccggtcgcagtgcagcctcgcggccagctcttcgaccggcatcgagtagatgtccgccagcaccagcagcggtgaccggtgcgtcgacagcaacagcttgcgccattcctcggtcgacctgttccgcgcccccttcggccggccggccgaacggcgcggcgtgccccggccggcgccgaaatcggccagggcctggtcgagtggccccgcccccgtggtgaggacgtcggacatatcgccctccgcgtccccctctggctcaacttcagcgggcaggagcggcagctgcgcagccggcgccggccgcgcgcgcgcgggatccatcgcccccgccgcctctgccgcctccatcgccgctttcagcccctctttccgctcactcactgcataaaccactgatatttaatccctttttcccgccgggcccgcccggcccctgccgcgttcggctgtcgttaggtgtgcgttaggtctgtcgttaggtctattattctttattttcaataagttagaagaatacctaacaacctaacgcacctaacggcatgtcttcacacgcatgcgcacacccacatgcattatgtgagtgtgcgttaggtccgttaggtgcgttaggttcctattattttcctttgttttcagatgcttggcacctaacgccctgcctaacatctgcctaacgtctcgccgtccccagccccggcgctgcgttctttctgaacgccccgtcctgggtctgggcggggccaccaaaaaaaccggagggcggggccaccgggtcgaagggtcggggcgaggtgaggacgtcgaaagcggccggccgcgcccctctgcggccggtgatcagctggctacgccggcgagggcgcggccgaagtcggtgtgaagcgagccctttcgggctcgggcaggcagagggcgaggggaatttccgaccccctgcacgtggccccgatccagatcgtctttttcggcacccgggcgccctccaggcgccgcaggctctggacccagacgccatccgcggcggcgcgctgctgccagtgcgtgccctggaaaatcctggcaagcccttgatgctgattggcgacccgcagccatgccgaccgtgtcggcggcggctcgaaatggacggcgagccctgcttcctggagcaggcggcgcgccaggcgcaggcgctcgtccccctgatagtcggggtgcgtccccgcggcgatccggatccagtcgccaatcgtccgtcgctggcggtcgtgcgggctgtccagggtcgagctgagcaggtgggtaaggcacgacgcctcgtcgctcgcctcgccgtccggtgtcatctccgacttcgccaacatctcgacccagccgtcgagtgcccccggctcgggaatcaggtcgtggaacagcaggtccgcggccgcgagcatcgtcccatagacgtcctggccgcgggcatcgtgccctgcctggcgcatggcggcgcggtatgcctcgacggtctcgggccagcgccaccagccgtccatcagacgacgcagaagctgcgatccccgatcgcgcgcccagcgctcggtaatcttgggctcgggcctatcgcccagcggcaaaaggtcaaggatcgcaatccggctgcgatcctgcggcaaaagaggtgggatcagaacagacgaaaattgaacagaagaccgcaagataaaatgctcggcgccaccatcattacccgcacgcatgctcaaggcaccggtcgcagcattccgcgcaagcttgacaagcttatgcatctgcctgttgtcttcttcgctttccgcctcgtcgattgcgacgggcaagctatcatacttgagcgtgcgccgcaggctcggttcggttgcatcggcgctcttcaacagcgcatgctcgtcgaacagcattttgatgaagttctggagcgtgctcttgccggtgcccttgccaccggtgagccagatgatggcgcgccaggcgatcgcaccgcccagccaggcggatgcgatccatcccagggtgagatacgggtccagctccggccggcgccaggaccaggtcttgaggatgtccagcacttcgccggccggccccttttctccccccggctgcgcgaccgggtgtggccgcagaatacagggcgccgtcggatagacccgccccagcacttcgcccggctcttgctggcgccaggcctcgcccttttcgggcggcacgaccatcagcgtatcgccgaggtgcatcaccaactcgccatccgcgccggaccaggcgccccggccgcgcaccttttcacggggcgaccacacgccccgcatactcgcgtcatggatcagggcttcggccaccagctccggtttccacccggaaatattccaggcaccggtttctttgtcctgcaccatccggggccaatactcgtagagctgtcccagctgacggccccaaagactttgcaaattgaggcgcgaatgatcctttgccttcagggggatcaactcccccaattcattgaggtaataaaatgtctccccctctttaccgagggggattactggtaccccttcgggcagcataggttcgccaccgccaccgcccgatttcttcttaccttccgcttccgccggcgtcgccggcgatatcaccggccctgccgccgcccggagcgcgcgcacattatccgccccgtcagccatgacgctcttccttcagcttttttgacgcgatgagcatgtcattcacgtccttgtattccgccggcggccgggcgaccttgaccgacgcatgccgctcgcccagcgccgccgccgcggccgcgaaggccttcgccgcgtccgacccgggcgggtcgttttgcgcccaaagcaccaggccagcgctctcgggcagccgcagattggccagattgccgccggacaccgacgcgatcacccgcagggccgggtcactgaccaccaccgacagcccgtcctcgatcccctcggtgatgtcgatctcgatcgggcctttgacccggctgatcggtgcggccttccgcaggcgcccgtcggcgccggcgatcgcccccttccagagcgaaatccacccaccgcggaagccgccgagggtctttttcggctcgtcaagcggcgccttccgcacgcgcccgtcccgctgcacctccagccacgtccggtgcgtggacatctgtttgccgtccggccccacgatcgacgtcaccatggccggccatttctgcccggtctcggcattccacagcccggggtgataccggatcgccccgggcagccagggcaggcgcgccagctcgatcgcccggccggccagatagcgatcgaccggcgtgcccagcagctcgctagaggcggacatccagatgcgcacggccgattcgcgcgctcggcgtgcttcctcttcagcttccgctttccgggccgcggctttcttttccgcgatccgccgccggcgctcgaattcggccgggtcgccgtcctcgactcccagccaccgccgtgcccacttgatcgcctgcgtcttatccccgccgcagcacacacccgcgaccaggtcgagcgcgtcgccgctttcgccgctcgaaaaatccgcccacacgcccgtgcgtgccttgaggttgacagccagcgactgcccgggctcgccggccagcgatccgcaccgccactcgtggccgtggcggctgccatggggcagcagctcgcggaccagcggctctatctgagcggtgagcaggtcgacgatcgtcgaaatcggcatcagggcggggcgctggctcatgtcgttgcccccgaaaaaatcgtgaatgtcataaaaaatatgacttgcgcagccgcaaagaatgtcatattttttatgacatgaggcgaggcaatgacgccccgcatatcacccgaagggctgacgccatgtacacgatcgagatccagggcgacgcgaccaccgccacccgcaccgagaccttcgcgaccccggaagatgtcctccagtatctgcgcgatcgccgcaccggcactttcgtctactcgatcagcgaggacaatggtgtgctcgaaatgcgcggccgcgccaaagccctgacctatttcctggacgacttcgcccccctgcatgtgcaggtgccgcggcggatcaagatcatccgctgcgcaggctggcccttcacgcaccacgtggaggggttgtgcctcgggctggacctggatctggcctgacaggtgacggcagaccaggaaggggggcgggctcatacctgccccccttcctcgtcgtcgtcctcgtagtcctcgtcccactcacaatcgccctcgtcgggccaagggtcgccggtgtgctccagtatcacaccggcggcccagtccagattgctgtccgaaagctccaggccggcatccgccagcgccgcccgaacctccggatcgcggcgaacgatccacaaccactcgccggcgtcatagaagtcgtcgtccggctcccatccccagctgtccgcccacgcgcacagctgctcgcacagccgctcacggatgtgcagcatcaggtcagagggggaggcgagcggcgccggcatcagaacgggatatccgaggtatcatccatgccacccagcagcaggatggcgaacgccgcgtaattgatagcgcccagaagctcgacgcgggcgacggcattttcgccctgcccatgcagcagggctgcctcttgcacctttttcacaacctgcccgaggcaatgccccggaccgaccatcgcgccgatctgcatcaccggctgctgcatcaggtcaagcgcgataccatgccgcgcctgtcccttgccacgggcgacgtcatcaaacgccgtcaaatacgtgtgagcgaggcttttgaacccgggcaggggctgggggccgatgacgctgatgagccagtcccgatgcttgtcgcactgttcttcccagatcttgcgaagtgccgcttgatctatctgggacatttcatcgagcagccgttgaatggccccgattttgtttttgattgcccgatcggctgccctggcttcgcgctcccgttcggcacgcttggcctccccgacgcaccattccagggcctcttccggggtcgtctgcccccgcttatccgtgctcccgtcactcatcgcgtcccacctccatcacccacaccgccgcggcctgaagccgccgcacgatccaccacttcaccgccccgcaccgctcaccggtgcggaggatcaccagcaccaggtgcagcagggccgaagcgacccagatccgcacccgcagccgcagccggacggggccctccagcgaataggcactgaccagcagccgcaccacgcgcgtgtactcgctcatgccgtccctcccagccgccggcgcagctcgtcgattgtctggccgacatcctcgatcgcctgcgcgatccgccggcgctcggcatcccgggtggcttcgggcatcagcacctcggcgaccagctggggcccgtgaagcaccgcgcccagcgccagcgcatcggcccgcggcgcctggccggccagccacgaccgcgcggttcgaacctcgcagccgaaatcccgcgcgatcgccttcgcggcgtcggccggataccggcgccgcagcgcctccgcccagcgctgcccgatcaccgtcgcatcggtgcgggcggctgccgcccgcaaatccctggtcaccgccgtcatggttcccctgttcctttcccgcgaaagttgctcgcggaaggaggggggcacactacggtcgcagatcaggtgcagaacgccttgcacggccggggctgccaccccggccgttcgcgtctcgggaacccaggctgggaagagcggccgcgtcatcgcaccaccctccccggtcgcggaacaccgtcgggccaggccgcgccctcgggccagtggtccgccagccagcaggtggcgcgccaccacgtcgtcaggcggcatgttccgccggcggccagccggcgggccagccgcgcatcccccgccgcccgcatcgccagcgtcgccggcgtcacgccctgcgcagccgcggccgcagccagggccgcggccaggtgggcggtcagggcggatggggaggggcgggggacgggggcggtcatcaatggcgggccgctggatcgccgatcagcaccgcgaaaggcgtcggatgactccctttgggcgcgatcgcaagattagcctccagcccgtccaggctgacattcgcggctgccggctgatatcccggtgtcagccccaagaactgaaactgcaggccacagtcagagcagtggatgcgcacttcggcccggtactggcctatgtcttccagccgcgcgaccgtcaccgtggcgtcaaaggtcaggtgtttgcagctcacgcggcctccttgccgccggcggcggcggcccgggcgacatgcgcccgatacatatcggcctcggtcaccgctccgccggtgacctgcacgatgcgcgccatgatggccggccgcggcacccgctggccggcttcatatcgcgcgtaagcgggctggctcacgccgatacggtcggcgagggcttcctgcgtcagcttatgggtgcggcgataggtgatcagatccatgaccacgacaataccaatttggcattacgcgtcaacaggcgatcgaaatcggcatgccaccttggtgttgggcacagatataccgcatcggtataatatatacatgtccaggttgcgtgaaatccgagagaaacaggggctttcgcaggcagagcttgcggagcgtgccggcacgtctcaatcccagattgacaggctggagaaggggcatcgccggctgaccgtcgactggctcaatcggctgtcccaggcgctccgatgcacgccgaccgaaattctcgaagcgccgaagcccgggctcgcccccgacgagcaagcaatccttgatttgtatcgggcgcttagtgcgccgaataaagagaatgttattagaattgctggtgcgctggcggaacaacagccacatacaaacggagccacaaaaaacggcacttcttaatctcaccaaggagcggaaatgcaatgacacctcgtgaagccggattatttatcgatggattttacggacttatcatcccagccgctgccttaatattcatgcattcctcgcttgccatgatacggtgggcgccaaaatcagatcacgtcgaaacgcaggttatttattacgagagagagccgcattattctatttgcattctgttttcattcgcgatttatggatggctgttcacatttcaacccgcctggattgcgcctgtatactttatcggcatcagctttttgtccggatattactggtcgagtggcggccctgaaatgaccgacatgcgcatatccgacagccgaaagttgataaagccgatgatatacgccggttcggctgcggctgcgggcctctggctggtcggcgcccgggccttgcgctggatctaataccaaaatggcattaattcgcgattgacggcttataccaaattggcatgatgaaggcatctcaaccctgagaggctaaatctcatgtccttttccgacttgcccgcagcctacctgtgcgaacaggtggtgcgggccatcgccgcgcggcgcgtcgccgccggcagctgcacccgcgcggatctggccgcgcgcttcgcccccgacatcctcgaccgctggtacgacacggccgaccgcatcgtcgacagccgcctgcgctccccgtcgcaggccctggagctgctggaggtggtcaatggctgacacccccacgcagtatcacgccacgatcatgatcatccgcgatcaccggatgaccgcctcggcgtgcatgccgggcgacagccccgaagccgccattcaggccgtgcaggggtggatcatgtcgatgtatccgacgcctgtttccgccctgtcggtgcctctgcgcgcggaggcctccgcagccgtgcaggcctgcgtgggcgtggcacgacagattgataagcttctgtccagcacggtgttcccggccgacaagatgacggccctgaccatcggctacgccgacaaagtcgacggcgttccggccgcgacggcggccatgtggatcaacgacgcgtcgctctcgtgcatcaccgacaagctgctggtgcccgctttgctgcgggcactgacggagggggtgtgatggacagccctgcggcatatagcgcatgcctgatgatctggaatgaattcggcgtctacggtcacgtccgcagagacggcgccacacctcagaccgcagctaaggaggtctgggaagacatcatggatggcatgactcctccgtgtcgatatccatcaccacagcatcagcaacggtctctcgctatcgcgcacatcaccgcccgcgcctatcttgatgccgtgagtaaggcggcttctctgagcagtcaccaaattacgatcgccgccggcttctgcgctcgcgacgaattgaagtgcgcaattgccgtgactcattatgaaatgatgcccatcaattctgtgacccgacgggcgctgatgaagcgacttcttgatgaaaacttcgcggggaaggattgatgtcatgcgcgtgaacgtctacgccgaagagatgaccgacaagatcgagatcatctcgaagaccatcgacggccaggatttcaccggcctgcgcttctggcttcatctgcccgtgaccctgccgtcgggagaccaggtccgcggccccttcatgcaccatccgggcgacgatgacagctcggcggtgaccttctggggcaagcgggatctgcggtccctactggctcaggcgctgaaggcgctggaccagcactatggcgcgacaccggaagaaatgatctgcgtcgacctgatgcagcaggtcaggcagcgcctcactgcgtccggccgcaccggctggcataatccttttgaatgtccgacatcgcatctggtgcaacggctgatcgccaatctgcgcagcgacagggaatattcgcttcttgatgtcatcgcatatgcgatctttttgcatcatcgcgaaagataccccttctccggctgcgacctgctgaaagagcggatcttcgccgcctacgacgaagtctggacggcggccgatgatattctggacgcgctccgcgctttgctgacggcccatgccgatttcgccgctgaggtgaatttcacgcaatcggcgatccccgccgatgtcatccacgagatggatgccgccgtccagcaggcttccgaggtccttcggaagctggacgcggcggatgaaggggaggccaccccatgaccatcacccccgatcagctgaagccctgccctttctgcggggcgcgcgccgttatggacgaggacgatttcggcgggtatcacacggcccgctgtgtccgatgtctcgctgaaggccccgttgatctgctgctcaacaagggcgcctatcggggccccgacgcgctgctccacgcctggaacagccgccccgaagccacggcgctcgaaatcgccatctccgccctcgccttcatcgccgagggctacgcccgaggcgacgtgaatcaccaggactaccgcgtcaaggcggccgcggccgcagacgacgcgctggtcaagatccgcgcgcagctgcccgggctgaccatgccgccgctgcccgatcgcacatggggcggcttcatgccgggcagccaggaggacgatccctcatgactcagatcatcgatctggcagccgcccgcgccgcgcgcggcctgccgtcctgcgccgcgcgtctgctgctcgccgatcgcgcccgcgccttcgccgccgccatccggccggccccgtcgccggcgatccgggccggaactcgggtccgctggatcggcgccgacggtctgccccatgtcgaccaggccaccaccatcgccggggggctggcgatggtgacggaagccggccggcgccggtggatcagccttcgggaagtggaggtgatccatggctaagggcctccctgccggcactgtgcccggcctgcgctacctgatcggcaagatcagcggcaagatcaataacattgacgcacgcatcaagtcccggagtactcacgatctggctgaccagatcgaacagacgaagtacagagaaacggagatgaggcggttcctgcaaggcatcatcgcagatgttcccgcggcacgcatgactgaaggccatcacgcgatgacgctttttgtcctgggcgcgcggaccacctgcaccagcggctattatcagctcgccaagaactggatccgcgccgcggaacgtcggattttcacgctcacaggggagcgcagccatgaatcgctctgaaatcgaagcctggaccagcgcccacgccgctgacctggccaaggccgcggagcaccccgaggcgattcatcaccttctctcccagccctccgccggccagctcgcctatcgggccatcggcttcgcggccgaagcggaaggcgccatcgccgccggcgccgacgacgtcgcccgccgcaagctgctgacgtgcagcctgctgtgcgcggtctcgctcaagctcctgcgggagggcaagcgctgatggctgacgacgtcccgccccagctgctgaccatggcggacctggcgcagatcttcagggtccgcccggacaccatctatcggcggctgccgaagctccaggccgacggcttcccgccgccggtctggggccggctctgggatccccgcgccgtcgaccgctggctgcgggagcggcagggccttcccgccgcccccgctgccacgccggcagcccctgaagccgccccggccgacgcggaccgcgcccggcgcctgagcgagcgcgcggcccgcgtggccggccaggtcggccggcggcggaaggccctgcactgatggccacggtcaaggtgccctatctgcggcggcgccagtacaagaccagcacggtctattactggcagccgtcagccagcctggccgcagccggctggccgctggtgcggctgcggctgcccgacggcacgccgtgcaccacggaacacgacgcagccgccgcggccggccggatcaatgccgaagtggcccgctggcgccggggcgaaaccccggcgccgcaggccggccggcagccggcggcctacaagaccaccaccagcctcgccgccctggcggatcactatcaagcgagcctgcgcttcaagcggctcgcccccaaaacgcggtacgaatacggcctgtgcctgcgggtgatcgtcgattgggcggggcgcgagccggcccgatcgatcacccggggcatggtcgccgacttctacgcccagctctatcaggcgagccacagccgcgcgaatgccatcctccgcgtgctgcgcctgctctacagctatgcgtgcagcctggaccggacacacctgctgtggtgcccggaaaatccggccagcgccccggaaatgatttccaccccgccgcgcgtccgcgtatttacgcgcgaggaagaggcggccttgatcaccgcggccgatgccgccggtgagccatccatcgccgatgcgctgctgatcgggatctatgtcggccagcgccaggccgatatcctgtcgctgaccctgcgccagctgatcgagaccccggaaggtctgcgggtccggatccagcaggcgaagaccaaggcgcaggtcgacatcccgctgcacccccgccttgccgatcgcgtgcgccgggccatggcccgcgcgcggctgcttcggtcagagcgggtcatcctcgatcgcgccggccggccgtggacggccgaccatttccggcggatcttccagggcctccgcgacggcccggccgcgcggctggcgccgaccgtcgtcaccgcgcgtttccaggacgcgcgcgacacggcggtcacccggctggcggaggccagcgccacgatcccggaaatctgcgcggtcaccggccacgacctggagcacgcgacccgcatcctgcaccactatatggccctcaccggccagatggcggacagcgccatcgccaagctggtgacccatgaagcccgcgagaccaagacaccgccgccgcaggccgaagccgccggcgccgaataaaaagggcggccccgcaagggagccgcccttcttgattggccgtgagccacgatgtggcagtcggcctttgcatgcttacaaaagcatcagtttcaatccaacaccagccagcgggctggtgaccacaccgtcggcgatccccgatggtgcttcgtcgcgccgaactgacgcttacaaaagtgccagtttcaacccaacgacaccggcgccgaagccccggtgcgacagaaacatcatccgtcctgactgatattattgtcaaccataaattgctcaatttcggcagccgcggctgcggcagcggctgcgcgccgcgcggccgcatcccgcagcatcaggacatcgtcaggcaatagctcaccctcgacctgccatcggcgcactgtccgataggtgacgcccgcatcccgggcgaaagcgctctgccatcgcgccgtcccgtacacgcgctcagcgaggcgattgaatgcagtcagattgatcgtggtcatggcggggcctcctttgtcatatagattatgacaatcttgccgcgttcgccaccgcattttcctgttgacgggcgttcgatgatgtcataaaaattatgacatgacgaagcggggcgcccaacagaaaggggcggcccgaagaccgcccctcaccattaccggtcgcccggcctacctgtcgaagctgaaagagaaatagggtctatccccggtagcccgggggaacattcggcttcttcaccaggtagggtccatccccggtggcccgggggaaccaagcgatcatacaggatcggaaaggcctgtcaaatgcccgagaacgcgaagctctatgagcgcatttattttgccccgtccgccgccaatctgcatcgcctcttcgaccagctcggcgccgacgcttcgtatctcatgctccaccgctacgggcggaatcactgggccgtgcagcgccacggcaccatcgtcaccgaaggcgactggcaggacgtcaagcgctggtgcgcggaatatctcgccggttgagggcatagctatgaatagcatcgcgaaattcaagcccatcgatccggcgcttgcccgggcacttctcgaattcgtagatcggcgtaatcttggaaagaccgtggacatcgacggacaggattatgtcctgtcctacatttcccagaacagcaatgcattctttcagtcgcgcgggctgtccatctacttcaagaccgcgcgttcgattatccgcatttcggatcactggtcgaaaagcctcggcaacgagcgcagccgaaagctgaactgcggatcgatatcaggcaagacctggatcctggatggtgcgaccgatcgtatcagcttcgaccgctatgccggtaaatatccatgggtgatgctcgccggaaaatgcgggctggcgagcctgaacaaaacctgtgaccactggtcggagtgatacagatgaatgtctatccggtacccgatgcccttcagcatcactacaaggggcgagggattgccctcggcgccaccaggaatggcgagctggtcgctctggtctatgtgcgcgacctgatccccgacttcgccgataccgtcgaggcggccccctcgatcggcgacaacgcccgggtggcacaggtcgcccgggcgctcgaaaaagatttcggcttcgtccgggtcggtatcgtttccagctgggaattctgcgagctgtaatctgacaagggacaggccgcatgcgcatcattgcatgcggcctgttttttgaagttgaacgttcaactcttcagagttgaacgcacccgcctgaacaggcgctaaccccttgaaatctggtgccggcggtaggaattgaacctacgacctactgattacgaatcagttgctctacccctgagctacgccggcgcggtgcggagatgggcgagcctctccggacggcgcggacgatagcgccggaagccgggtttggcaagcggttaagctgcggccgcaaagccggctgccgccgcggctgcggcaagcagaagggcgatcgctacgggcagcggagtggccgcccggcggatggccgcttcgtcggcgggatatgcgccggcaagggctgcggccatggcaagacgcatgggcgagatcatggtggcgataccgcctgcggccagcagggcggcggtgataccaaggggcaggggtcccgtggtcgtggcggcatcgagcccgggcagggcgccgatgagcggggcgatcatggcggcgaccgcgacattgctgccggtcaggaagcccgcgatcccggccagcggtggcacgatggccggggcggctgccccggtcgcgccggcccaggcctcggccaggagtgcaggcgcgccgcctgcggcccagagccccgccagcagcacgaaggcgaaggtggctgcggccgggcgcaggctgcgcagaaggccggtgcgcgccgcgccgatgatgcccttccggcgggcatggagggcaacgccgaaaccggtcgcgagcagccagagggagggatgatgcagcggtgcccagcccggcaggtcggcgaagggccggatcatcggtccgcggagcagcccggccagcgggtcgatcagccgcgtggcgagcagcaccagggtcagcaccagatagggggtaagtgccgtgatggtggcatcctgcccgcccgactgccgccggcgaagcagcagatcgacggcaatcggcaggccgagtgctgcgagtgccgccgtttcgggcccgatcagcagattggcgccggcgagcagcaggatggtgagggcgatcagcagtggatcggccaaccggtcacgcccccgcgggcggatgccggacgccgcggtctgaaggcgcagcaatatcagtgcgccggcatagaccggggcggagagcagcgccgttgcggcgcccagcagatgcgggtcgtggtcgagcagggcggccgtgacctgggttccgatggcgagtgcgccccagggcaccagcagctgactcaacagcgacagcaccgcgatccggatcggcggcagcccttcaaggcggagcagggcggccgtcaccacggcaccgacgccgaaaccggtggcgctttcggcgaaggggccgatcagcatgcaggcggtgaagatgcggcgatagcgcgccggatcggcggcgaccgtgcgctccccgccaagggcggcggcaggcgaggccacggcatcgaaaaccagcccggcgaggatgaccgatacggccgtccaggcgatccagccggcgcggagccccgcatcgatcagggaggcgacatccaccccgctgccgagcgcgatcagcaccgccaccccggcaccggcgagccctgcttccagcgaactgcgtcgcaacgccagcagggccatggcgagcagaaccggcagcggagcgagcaacagggcggggacagagggtgacatcagcgttccggttgcaaagggggcgggcccgcgcatcacagccgatcatcccccgctgcggcaactgattacgaatcagtggggccaggaattgcgggccatgatattgccacgggggcgggcttgacctgccttggtccccgtggccgactgtcggtcagccgcatctgccagacggatatgccctgcccatgaccttgtgcccatctgcccgccggcttgcggttctggccatgctgttgcctgcggggggctgtgcgccgctgctgcaaccgctggtgccgccccgctatgggttgatggccgaatggcagtctccggtgcggatcgactggccggcgctgcagcgccagccgtcgcgcttcgtggttcagccctacggcatctatgaccgggcgattgccgattacggcgacctctatggtgccgtgccacgggggcaggtgcgtctgcaacgcctgacaccggaaagccggtcagcgttgctggcaccgccgcccgttgcccctgaggagaagacggccgtagatgcgggccccatcgccagcgaggccgtgaccgaggcggcaccgtcggggcagccggcaacctccaccgtgaaaacgtcggaaggtcagcctgccaccgttccggtgcgggcggccgatccgcgcctggccggactggacctctcggcacctgccgaagatgaggcggacaccagggtcgatcccgcaggtgccaaagcgttttcggtggtgagcgggctcctgaacggggtcggaggtggtggtaaccgtaccgctgaaccggccgtcgtgtctgcggcggcccccccggagaatgcagcaggggccgatggaccaccggaccctgtggcggcactcgaagaggcgctgccgctttatttccagcgcttcgcctatacggtcggcagcggtggcagtctcgatgtggcgttgaatgacggcccgcgcgcgcggctggactgggtgcgggcggaaacggcgaatgcgcattgcgttctgtttgcgaccagcctgcctgaccaggcattgatcgatgctgcggccgaagccgatgcccgggccgcagcggacgaggttgccgaggtcgatgcggtgaaaacaacgccggcaccggcacggggccggcgcgcgccggatcccgatgcaccgccggtcgtcgataccgcgatcggcgagatcgacggcgagaccggcattggtgctgtgtttgccgggatcgggcgctggttcgacagccaggctgacgagacgccgcaaaccgccgagccgcccgccccgaaggccgtgccggcggaacccgccgatcaagcgccggccaaagccgaggcgcctgccgaggagcagggggatcccgtgggtgccttcttctcgcggctgttcggaggggatgaggccgcggagcccgaggcggtgcctgcccccgaaccggaggcccaacccgaaccggagccccaaccccaggcaaggcccgcagccggccctcagccgcaggcggcaccgcggcccgaaccggtctccgtgcctgcaaagccggcgccgctgcccgccagcctcagctccatccgcctcgacggccatatctgcgtggccttggacgagccgctcgatcaggcgcggatcgtggatcttctaaaccgcatccgggtgaaatgacgggccgctcctgaaaggcccgggccggatacacgacgggcggcatcggagatccgatgccgcccgtggcgtctcctcccgcctgccgacggggtcgttccgctgcgtgatggctcaggcgctggggccgatcatcagcttcggatcgacataacgatcgaactcgtcctcggtgagcaggccgagcttgaccaccgcttccttgaggctggtgccttccttatgggcggtcttggccgccttggcggcgttgtcatagccgatataggggttcagcgccgtcaccagcatcagcgagttgcgcatcagctcgtcgatgcgacgggtgttcgcctcgatgccgaccacgcagttgtcggcgaagctgaccgcggcgtcgcccagcaggcggatcgactgcaggacgttgtagatgatgaccggcttgaagacgttcagctcgaaatggccgttcgagccggcgacggtcaccgtcacatggttgcccatcacctgggcggcgaccatggtcagcgcctcgcactgggtggggttcaccttgcccggcatgatcgacgagccgggctcgttctcgggcagcagcagctcacccaggcccgagcgcgggcccgagcccaggaagcggatgtcgttggcgatcttcatcacgctggcggcaagcacgttcagggcgcccgacagctcgaccagcgcgtcgttcgcggccagcgcctcgaacttgttcggcgcggtgatgaagggcaggccggtgatcttcgccacctcgtcggcgaaggcctcggcgaagccgatcttggcattcaggccggtgccgaccgcggtgccgccctgggccagctcgtagacgcgggccagcgaggcctcgacgcgggcgatgccgtattcgatctggcgggcatagccgccgaattcctgaccgagggtcagcggcgtcgcatcctgggtgtgggtgcggccgatcttgatgatctcggcgaaggcctcggccttgtcggccagcgccttgtgcagatggcgcaggctcgggatcagatggccggtcgcttccaccgcggccgcgatatgcatcacggtcgggaaggtgtcgttcgacgactggccgcagttcacgtgatcgttcggatgaaccgggctcttcgagccgatctctcccccgagcatctcgatcgcgcggttcgagatcacctcgttggcgttcatgttggtctgggtgcccgagccggtctgccagaccaccagcgggaagtgatcgtcgagcttgccgtcggcaacctcgcgggcggcggcgacgatggcctcaccgaccttcgcgtccagtgcgcccagcgccatgttcacccgggccgcggccagcttctgcacgcccagcgcgcgcaccagcggcaccggcatcttctcgccgccgatcttgaagttctgcagcgaccgctgggtctgggcaccccagtagcggtcggctggcacgtcgagcgaccccatcgtgtccttctcgacgcgcgtcttcggcgtggtctcggtcatcgcgtcctaggctccatcggcaagtggtccgcgggagggccggagatggcgcggccgcccgcgtccgggcttatccatccgcccggtatatgcgcccctcgcggcgcccgcgtcaaacattccggggggttgaccgaccttggtcgcgaggttgcagcccccggggcccggtctcaggccgcagcgggtggtcgacctggggcggcgggatccatcggcggggtcgcggcggcgctgccgaccaccggtgccgggccggtggttgcgggcatggcggcggggaccgtggcggggcggctccagctgacggtgtcgaagctgccgcagctgccgcagacggcgtgccagcgggtgtgcaccgtgttgcagcggctgcagatccagcccggcgccgggcgggcatcggcggcgcggtgccaggcctgggcggcggattgccagtcgccatcggcttcggcggcccgtgcggcaatgcgctccgcacgggtgtcgcgatcggcgaccgcgatcttgttggccgagtcgcgggcgacacccaggatgccggcttcaagcgcggtttccgcgaccagcagccggctttcggcctgggttggcgcgatctgggccaggtcgcgggcgcgctgcacccgctcggtcggcgtggtgttgccgccgagcagggtgacataaagccgccccagctccggatgggccgcggcgccccagttctgttcgatcagcttgcgggcgaccggcagcttgccggccgcgatcgcgacctcgacctgggtgatggcggcctcgggccggccgggggccagcttgaccgcggtgcgcgcacgagtggtggcgtcatcgtgatggccggccgcgctgtcggcgcgggcacgttcgatctccagcgccgattgccggcgccggctttcctcgcggtccagatgcttgtggcgttcaagcgcggtcaatgcggcttcggcctcggcccagtcgccttcggcaagcttcacctcgaacaccgtttccagcgcccagcgggtgccggggcgcttcgccagcgcctcgcgggcgcgggcgaccgcggcggcaccgtcgccctggcggcgggccatcaccgcgaggccgcgcaggcccagttcggcggtttcttcatgctccagcatccgggtccagcggcgctcggcctcggccggatcctcggccagctgggccgactgggcggcgagcatatcggcgagcggctgggcatcgagcaggcgttccgcccgggccgacagcttgcgggcgtcgcgggcatcgccggcggcgaccgcggcaagaccgcgggtcatggcctccagcccccggcggcggcggcgttcggcgcgacggcgcaggaagcttttcgggccggtcacgaggcccgagagcaggcggacgacgatcgcgagcgccaccagccccaccaccagcacggcgagcgccacggcgaagctggtctccacccgccagcccagccagtcgaccgagaagctgccgggatggtcggcgatccaggcgccgcccaggctgagggcaatgatgaccaggacgagcaggatgacgcggatcattgggcagcctcaccagcattccgggaaccggcctcgccggcggcggggacggcggcagtctcgcgggcgccggcctcgaaacgggcggcgaccgcatcgccgagggctgcagcggccttttcgaccgccagccgtgccctggcggcctcggtccaggcggcggcacgctctgccgcagccggcggcaattcttcggcccgggcgacggcaccggcgaggtcacctgccttcagccgccgctcgatcgcggccacggtcaggtcggcatcgccttcaggcgcgcccgcggccggcgtggtctgttcctggccggtgcgccgcaccgtcaccaggccgcgcagttcggccagcaccccgcccaccacgtcgccctcggcgggtttggtttccgccgcctgaaggatggtcggcaccagggcctggaagcgtgcgatcaactcgtcacgggtcgacacgccgtcggccgcatgcggcgccagctgcccgaccgcgtcggtgatctcgccatcgccgcggcccagggcgcggatcgcgcccaacgggccttcgaagctgcggccggcatcgagcgcgtccgacagctgggcatcggccagcgccagcgcggtcaggcgcatggcatcggcggtgggggtatccgccagccggctttcggcgatcgcggcgcgatccgaaaggttgcgggccgcaccttcgacattggccagccggttctccagcggtccgatccgcgccacggtctcgttggtgcgcgacagctccgcttccagcttcgagacggtttcggtcagggcctcgagccgcgcgaccgcgtcttccagggcgccgatgcgctctcccagccggtcgtcttccaggctgccgaggccgctttcgacggcacccagccgccgctcgatttcggcggtgtcgggcgggccctggtcgagccgctgctccagcgccgcaatacggtccgagagggtgggctcgacggtggccggggcggcacccagcatggtccggaccctgtcgggggccgcggtcaccaccacgccgcccaccaccaccagcaccagcgccaggatcgagacgccgagggcggcacggccgacccggtcgcgcggctgggcgcactggtcggtgggggtaacgatgcgggcagccggcggggcgtcgtcggcggccggcgcagccttgggcgtctcgggctttgcaggctccgccttcgggatgtcagccttcgatgcgtctgccttcgggggggtggccttcgaaggcgccgcctttgcaggctcgggcttcggcgccccggccttgccggcggcatccgcgcctccggcaggtgaggacgtggcgtcgtcggcgccggtccgggcagcaggcgtcggctccgcaggcgtcgacgccgcacccttcggtgcggcggtgccttcggtttcggccgtggcagcgtcgggccgaccggcctcggggccggtcttcttcccggagggcggcgtccggctttcggtcatcgggcggtctccgtctggtcggcttgcaccctttgtcgcccatcgggcacccataggcaagccgcgaggggccgacggtgttcccgcccgacgcgttgttcccccgtttcgcgaaagggtcagccctgcggcatggcggattgagggggcgtggcctgcgggttgggcgcctgagaattggggccggcctgatcgagcagcgccagcatcgcatcccctgcgggttcggcggcgaccagcagccgccgccagggcaggccggcggccatctctgccacggccgggctcaggcacagcgcatcgatgcgacagaaggacgcgccgatgcccaggcgttcgatctcgtccaggaacagccgggccgtgcggggcgagaacagcatcaccaccggcagctggccctgtgccagcccctctgcaaccggcggcggcagctcgccgatcgcggcggcgtcatagccgacccggcgctcgacggtgaagcccagcgcgcccagctgctctcccagccgcccggtgaccacgctgccggcgatatgggcaagcgggccgtcttcgggtttgtaggaattggcacagagttccgccagccggtcggcgtcgccgccggcgacatcgatgcgggtgaagccggcacgcttcgccgcctcggcggtggcgcggccgacggtggccagtttcagatcgcgacggtcggtcgcccgtgccagcgcccgggcgccgttggcgctggtcagcagcacccgctgcgcccggtccagcacccgttcaagatcggggatcggccggtagcggacggtcatcaggggtgcgatcaccgcctggtgtcccaggcgatgcaactgttccgcgagcgtctgtgcgtcgtctatcggacgggtcaccaggatgcgcatggcggggcgggctccgatctcgggcggaagggcaggcgacgatgtgggcggcggggcgtgtcaggtggcgccggggacccattgaccggtcaccccggcggcccagcgggcgatgtcttctcccgcccgctctcgcagggccgtgccgacccggcggcccagggcctcggcggcggcgcggtctgccgcaccgacatcggccatgccggcctcttccagcagcgtgccgccatccgggctggcgacccggccggtcagggccaggcggccgtcgtcgtcgcggcgggcgagggcggcgatcggcgtgcggcaggagccgtcgagcacggcgagcagcgcccgctcggcgatcaccgccagggcggtctcgccgtcgtcgagcgcgcccacccaggcattggtgcggtcgtcggcactgcgggtctcgatgccgatggcgccctgggccaccgccggcagcatcaccgccggatcgatcgggctgcggtcgacctcggtcagtttcagccggttgagcccggccatggcgagcagggtggcgtcgatgcgtccctcgcgcaggcgcgacagccgggtctggacattgccgcgcagcggcacgaccgtcagatcggggcgggcggcgagcagctgggcctgacggcgcaggctggcggtgccgatcacggccccggccggcaggtcgtcgaggcggcgggccttgagcgacaggaaggcgtcgcgcggatcctcgcgcggcagcagggcggtgatcgtcaggccttccggcagctcggtcggcatgtccttcatggaatggaccgcaagatcgatggcgccggtaatcagtgcctcttcgatctctttggtgaacaggcccttgccgcccagttcgaccagggtccggtcctggacctgatcgccggtggtgcggatgatgacgatctcgaccgcgccggctgcggcgagggccggatcgagtgcagccagccgtccgcgaacctcgttcgcctgtgcgagggcgagcgggctgccacgggtgccgatgcggaggagcggatgcgtgaccatgatggccctgtgttagtgcctgacgtgcggtttgggaagtggtaatcggcggcccgagccgctacctcttgccgcggtcccacccgcgaaccggaaccctgcccgatgaccgcgtccgccgccagcctttccgatcccgccgccgcccgacgtccccgcatctgtctcggtatcgagaccagctgcgacgagacggcggcggccgtggtcgtgtccgatccggccgcgcagccggggcaggggcggccgctcggcaccatccgcgcccatctggtgctctcgcagatcgacgagcatcagggcttcggcggggtggtgccagagatcgcggcacgcgcccatatcgaccatctggaccggctggttgcggcgacgctggacgaggcgaagctggggctgggcgatctggatgccatcgccgtcacctcgggcccggggctgatcggcggggtgatggtcggtctgatgaccgccaaggggctggcgctgggcgcgggcgtaccgctgctcggcatcaatcatctggaggcgcatgcgttgaccgcccgcctcacccatggcgtcgcctttcccttcctgctgctgctggtctcgggcggccattgcctgatcgccgaggtcaccggcctcgggcagtatcgccgtctgggcgccaccatcgacgatgcggtgggcgaggccttcgacaagaccgcccgcctgctgggcctcggctatcccggcgggccggcggtcgaagcggccgcccgcgacggcgatcccgcccgttttgcctttccgcggccgatgatcggccggccggattgcgacttctcgttctcgggcctcaagaccgcggtccgtcaggaggcggagcggatccgggtgctgagccggcaggacgtcgccgatctggcggcgagctttcaggccgcggtgtccgacagcgtcgccgaccgggtcggccgcgcggccgaggcattcgtggccagccatggccgcggccatgcgctggtggtggccggcggtgtcgccgcgaacactgcgttgcgcacccggctgggcgatgtcgccacccggcgcggcctgcatctggtggcgccgccggtcaggctgtgcaccgacaacggggcgatgatcgcctgggccggtctggagcatctggcggcgggtggcgacctgtccgccgatgacggcctggccctgatcccccgcgctcgctggccgctcgacccccatgccgagcagatcgtggccggcgggcggggacgccatcggggctaggaagccagtgttcagacgggatagcccaacgcctccagccccggccggcaggcttcggtgagggcggcgtagacgtccggcggcaggtcggcggcgcgggagcgggcggggcgcgggatggccgagacctcgtcgagccaggccggatcgtcgaggccgggatcgatgaagcggatcatggcctgaagctgttcacggggcgcgcgctgaacgtcttcgaaggcgacggtcagcaggcggtcgggcggcagcgggtccagaacctcgcgggcgaggccgatcatcaggctccagaaggcgccgagttcgggcagggtgacgccctccgccagccggcgggcattgatgaacgggaagatcatccgctgggagaggacatcgatctgccggccccgatcgcgggtgaagtcgcgggtcgcatccacgcccaatcggcgggccgccttcattgccccgaccagcaccttgaaattgtgatgcttctccatcgacatcgcggtgtcgcggccgtcgcgatggacatggatcacgcgggcgtcggggaaaaggcgcagcagcttggccgccagcatcagcgacccgccggaacgctcgatccagaccctgcggccgaggcggccggcgagctcttcgaagagggcccggtactgatcggcaagcggcatcgccggccgcgcccgcaccacgggttccagtgcatcgtagagcgcttcgggggcgtcggtcagatgcggcagggtgaccatcatcatcggcggcagatccgccaggccgtagcgcatgcccggccgatcataggggtagagcatttcatcgacgacgatgccgtcgcggagcatggcgcggagcgccgggctctggcgggagaggatccgccagaagccgtcgccgtcgatgctgtcacgggcgaaggcctcggggccgagcggcacgaagaattccgacaggctgagcaccgccggatgccgggagagcaggtccgagatcatggtggatccgcatcgcccggtgctcagcaccagcaccggcgggatgtcggtggtccggggcacggtcacgacgggcggtccttttcggcatggagatgggcgggcatgcggtagtcgttgccggccccgtccgaaaaggagaggtcgatcatctgcgcgaactggaaggcgcggcggcggcgatcccaggcggggacgtggcgccgcagcacccggtcggcccggttgcgcaggcgcagggccgccagggcaccgaaattgcgcgcgggcgggtagttcagcgcatcggccagctgatcgccgatcatgccccgcgacaccgaatagatcaggcggaccagcttgcggcgctggcccgcatcggtgatgccggcgaccaccggtgccgaattgatcagaccgttggcgagcaggatcgcctccagatccggcggtggctctgccgccatgcccaggcggaagagacgcatggcggcggcttcgtccaccgcctgcagctcgggcgccacccccatcagatggccggaatagcgccagatcatcatgaaagagcggcgctcgtcctcggtgggctcgacgccgagtttgcgggcgcgatccagcaatccgcccgagaaggcggcggtggcgaaagcgatatgggccgaactgagtggcacgccccaggcgggggtgtcccattcctcggccgtggccagcagtacgcgcagccgggcatgcatcagccggatgcggaccgacatcttccagccgtcgccatggcggtcgagcccgccgggcagaaaaatctccgagatgtggcggttgttctgcttcagccggcgcacgccctggtccaccagccggccggtgatcgagaaggacttgctgatcagggtggagaacccctcgacgagcacggcgcccacgaaggccgcaatgagcatctcggaattgccatggaaagcccggcagcccgggccggtgaagccgggatcgaaccagtccggcacccgctcggtttcggccaggaaatcgcgccaggcggcaggggcatcggctacggccatcgggccgccatccatgccccggtgcatccagtcgcgctggaccggagccggtacgtcacggaaggccgccatcaccgcatccgccagaggatcaccgatcatggtatgacggagatatgtttcggtcagtgcaggatcgatgcggcgggcgtggaccatgccgtcctggtaggcactcgggatctgcatgcgtggctccgggcagacgtcaggtcaggcggggagttcgtcctccgccgccgcttggggaaggccggtgtccagcccttcgaaagagagatcgagcagctgggtgaactggccggcacggcggcggcggtcatagaaaccgatatgccggcgcagcagcagatcggcccggttgcgcagccggatcgcggtcagggtatccatgccgcgggtctcggggaagtgcagggcggttgcgagatcgccaccgattaacccgcgcgagattccgtagagctgccgtaccagcctgcggcgcaggtcgggatcatcgaccccggcggccatcggggcggaattgatcaggccgttggcgagcacgatgccttcgatctcgggcggcggttccatcatccggccgatccggaacagctgctgggcctcgatttcatggcgcggcagcagctcggccggcacgccggtcagatggccggccatgcgccagatcatcatgaaggcgcggcgctcttcagggaacagctccacacccagcacccgggcgcgttccagcagccggcccgagagagcggcattcatgaaggcgatatgggcggcgctgagcggcgtgccccagtcttcgtggttccagtcggcggaacgcgcggtcagcaggcgcaggcgggcatgcatcagccggatgcgcagcgccattttccaaccttcgccgaactcgccgagcccgcccggcaggaagatttcggacagcaactggttgttctggcggaagcgccggccggcctgatcccccagccgaccgctggtgatgaaggccttggcgatcagggtcgaataggcttcgaccagcgagcccgcgacgaaggccgcgagaaacatgcgggaattgccgtgaaaggcccggcagccgggcagggtccggctctgggtgaaccagtaggggacgtccgtggcatgcgcgaagaggtcgcgcagcgcctgtggcgcgtcatccagcccggccagaccttggtcaagcccgatccggatccacgggcgttgtcgtgcggtggcggcagccgcaaccgccgcatcggcgagcgggtcgcccaggctcagatgacgggcatagcgctccgccagcccggcatcgagaagccgggcccgggcgaagccgtcccggaaggcggcgggtatgtccacgacctgggtcatgtggcggcagaggctcccgtgacctgcgggctggatcgggctgcggaatcttaggcgcagccgacccgtcgggtccaggggcgcaaagccctgccgctcatgaacgtatccggtgggtcactccgtggcgaggttttctgcgctcacggccggtggcggcggtgccgcatcggcgcggtattcggtccaggccaggcgtgccgagagtgccagacaggtgcagaccagcagcggtttcacgatccgggtgccgcgggcgatcaccaggacggccccgatacgggcgccgatgattgcacccgtggccatcaccgcccccagcatccagtcgatatggccgccgagcgcgaagaccgcgagggccgagagattgctggtcaggttgagcagcttggtctcggccacggcccggcgcatgccgcggccatcgagggcgaccagcgccagcatgaagaaggagccggtcccgggcccgaagaagccgtcatagaagccgatcagcggcgccacgatccagccggtgacccagcccggcacgcgggcctcggcatcgatgtcgcccacccgtggcgagagcaggaaataggcggccatcacacccagcagcaccggcaggatacggcccagtgccgaggggtcgatcgactggacggcgagcgaccccagggccgccccggccagcacggtcaggatccgcggcaccacctcgcgcacccgtacctggcccgagcggacataggtgatcgccgccatggccgtgcccatcgaggactgcaccttgttggtggcgatcgcggtggcaggtgccacgccggctgcgagcatggcgggcagggtgatcagcccgccgccgccggcaatggcgtcgatggcggcggccacgaccgcggctgcgaacagggccagcagcagatccgggccgacgggatgggtgaggaaggccgacaggatgtccatgacgcgcagaagccggaataggggcgggggtaccttggggtgtacgccccgcccgcctgccggtcacccgaatttccctcgcgcccgacgcagggccgccctgcatctgccgtcagttccgcatctgccgtcaaccttgggccgggcgcacatcctgtgcatgggcggccatggtggccgcaatcgcgcgctcgggcgccgtcggccggaaatcgggcaccagcacctgaagacgattgccggtgagcacgaccggatcgtcgaacagatagcgcagctccagcagctcgcgggcgaccggatcggtcagggctgccaggcgcagcagccaccagggcaggcgcttcgggccgagccgggggtggcctgcggcagccgccgccatctccatgaagcggcgctgcgtgtcgaacagctgggccgtcagatgaacatgctccacgggggccaggcgttccggcgcctcgagcaggtcggcagtgagccgggcgaggtcgggcacgaagcaccactggtgcggcaggtcgagcggccccggccagcgcggcgcctgtcccttcgccagcctggcgaagatcatgtcggtcagcccgttacgcaccgtcgggccgtagaaatcgccggcgcgcaggatcaacaccggtgccgcgccctcgcggcccagcgtctcgatggcggcctcgagatcggcgcgcaaccggcccttgaccgtatcggggcggcgttccgcctcttcatgcagcggccgggcatcctgacggccgaaggcatagacattgccggggaagaccaggcgggcaccgcttgcgcgggcgccctcgatcgcggccgcggtgatgcggcgcatcgccgggtcccattgcggatagggcaggttcacggcatggacgatcgcatccatgccctgcgcggcatgggcgacgagcgccgggtcgcgggcgtcgccgaccacgatatcggcgtcttccggcaggcccagccggccgagccgggccggatcacggaccagaagccgcagataccagccgcgccggcccagctcctgcgccatcgcgccgccgaacccgcccgccgccccaaggatcagggcctgcctgttgccgctgtcgaccatgcgcgtctcccgctccggaccgatatcgccaaaggtagggggcgcggggccggcctgccaatgtcatgatgtgtgaaggacaaccgacggcaaccatggcgcgttccgcgggccaccgctccggggagggagagggtgaaagacccccttggaacgcggtcctggcggtcgcggccgtcccggacttgccgcacaggacgtcatcggcgcagaatggcgacgcccgaaccatcctgctgccgaggagtaaggcccccatgctgttcgccatcatctgtatcgacaagcccggccacgaggccgtacgccttgagaaccgccccgaccatgtggcctttctcaaggaagagggcgagcaggtggtcttggccggacctttcctctccgacgacggtgccacgatgatcggcagcctgctgatctatgacgccgaaacgctggaggaggcgaaggagttcgctgccggtgatccttacgcaaaggccgggctgttcgaaagcgtcacgatccgtccgtggcgcaaggttttcgacaatcgctgaccggccgggagacgcgacgcgatggcccgctggctggtgaaatcggaaccgttcaagtattcctgggaccggatggtcgcggatggccgtacccattgggatggcgtgcgcaatcatcaggcctcggccaatctgaaggcgatgaagaccggcgatcgcgccttcttctatcattcgaacgagggcaaggagatcgtgggcattgtcgagatcgtccgcgaatattatccggatccgtcggacgaaaagggccgtttcggcatggtcgacgtggcgccggtgacggcggtcaagcggccggtgacgctggccgagatcaaggccgatccggcgctggaaggcattgcgctggtgcgccagtcccggctgtcggtgatgccggtctcggacgagcactgggaccatatctgccgtctggccggcatcgagcccggtgtctgagatgcaggatgacggggggcgccggctgcggctctgcccggcggcagaggtgccggaaggcggcggccggggcttcgtgttcgggcgcatgcccgaggaattccgggtcttcgtgatccgctggcagggggagcttcgggcgtatgagaatgcctgcccccatgccggcgtctcgctggactggacgcctgaccggttcttcgaccggacgggcgacctgctgatctgcgcgctccacggcgcgcggttccgtcccgatgacgggctctgtgtcgccggcccctgccgggggctgcggctgccggcgctggcgctggagtgcgacggggacggggtgttgcatgcaatccggccggactgacggccgcattgccacgtgtaagtgtgacgtccggatttcaaccgggcgctgagtgacgctgccgcgcctgaccgcggccgcgagggatccgaccgagggggaaacccagcccatgtcagacgacaagaccgcagagccgaagacgctctatcccgttccggaggccttcgcgcgtgaggccctgatcgacaaggcccgctacgacgagatgtacgcgcgctcgatttcggatccggaaggcttctgggccgagcaggccgaagcactggactggatcaggcgctgggaccgggtcaagaacaccgacttcaccggcgatgtgtcgatccgctggttcgagggcgggcagatcaacgtggcctggaactgcctggaccgccacgaggcgacccgcggcgccaagacggcgatcatctgggagccggatgatccgaaggcgccgaaccgcctgatcacctatgccgaactggccgccgatgtccgccgcttcgccaatgtgctgaaggcacagggcgtgaagaagggcgaccgggtgacgatctatctgccgatgatcccggaagccgcggtggcgatgctcgcctgcgcccggatcggggcggtccattccgtggtctttgccggtttctcacccgacagcctggccggccgcattgaggattgcggttccaccgtgttgatcacggccgacgagggcctgcgcggcggccgcaaggtgccgctgaaggccaatgccgacaaggcgctggaccacgcgggcggcgtcggcaccgtgatcgtggtccgccataccggcggcactgtcgcgatgaaggacggccgcgacgtctggtggcacgaggcggtggccggtgtctccgacgactgcccgccggagccgatggagtccgaggatccgctgttcatcctctatacctcgggatcgaccggcaagcccaagggcgtgctgcacaccaccgccggctatctgctctacgcctcgctgacccacaagaccgtcttcgacctgaaggaggacgatgtctactggtgcacggccgatgtgggctgggtgaccgggcattcctacatcctctacgggccgctcgccaacggcgccaccacgctgatgttcgagggcgtgcccacctggcccgatgccggccgccattgggaggtggtcgacaaatacggcgtcaccatctactacaccgcacccaccgccatccgcgccctgatgcgcgagggcgaggcgccggtgaagcggtcgtcgcgcaagtcgctgcgcctgctgggctcggtgggcgagccgatcaatccggaagcctggcgctggtactatgacgtggtcggcgacggccgctgcccgatcaccgacacctggtggcagaccgagaccggtggtctgatgatcgcgccgctgcccggcgccaccgacctcaagccgggatcggcgaccctgccgctgttcggcgtgaagccgctgatcgtcgacaatgaaggcaagccgctggacggcgcctgcgagggcaatctctgcattgccgacagctggcccggccagatgcgcacggtctatggtgatcacgagcgcttcgcccagacctatttcagcaccttccccggcctctatttcaccggtgacggctgccggcgcgacgaggacggctattactggatcaccggccgggtcgacgacgtgatcaacgtctcgggccaccggatgggcaccgccgagatcgagagcgcgctcgtcgcccatgccaaggtcgccgaggcggccgtggtcggctacccgcacgagctgaagggccagggcatctatgcctatgtcaccctgatcgccggcgaggcgccgtcggaagagctgcgcaaggagctggtggcctgggtgcgcaacgaaatcggcccgatcgcgacgccggatctgatccagtgggcgccgggtctgcccaagacccgctcgggcaagatcatgcgtcgcatcctgcgcaagatcgccgccaacgagcatgacgggctgggcgatacctcgacgctggcggacccgacggtggtcgacgatctggtcggcaaccgcatgaacaagtgacaggcggtatgacgggaccagaggtttctcctgtggtcccgtcattctgaaggcctgatcagctcatcaggttatcagtgcttgcagccgacggtcgatgcggcttgaaaagtgggacgaaaaatatccggtccaatagctatgaatatcagcgagaaattgattgcaggtaggttgacacgtcagaggcttcttctttcgtcagtgggctgagagccatcttggtgccggggacgacgccaatcggatccatgataaaacgggtaatttcatcaggagtccatgtgataccggaagatttcattccttccgaatagtcgtaatttcgcacctgaccagcttttctgccaatcaccccagagagggtggggccgaccatatttgctgtgccgctcaaagcatggcaggcagtgcagttttctgcaatgcgcttgcctcgatctactgcggcttgatccagttcaggcgcgtcatcaccacacgctgtgagtgtcaaagccagaacaggcagaaccatccatttcttcatttcaggttgcctccggcagttatcgggcgatggcgggactggagcgccccgccagaagggaaaggaggagtgcgtgaaggattgcgagcccgtagatggccaagcccgggccggcatagaagccaaagaagacggtgatacctgcgacagccaaaataaaattagctgcgacgccaagcccagggccgcgccagagcagcacggacaaaggaggtatcaagggcgccaggacgatggcaagcagacgtttcatcatgatgtcttcaccctgagagctgtcaggcagcaagctgcttttcgatatgttcggccagacggatggtgaagccgacgatcatcatagtcggtcccgagtagccggcagtcgggaagacggagctgccacctatgtaaagattgccgacgccatggacgcgctggtttcggtccaccacgccatcttcggggacatcgctcatccgggttgtgccgatctggtgatagtggccggcgatacgggactccaccaggtctctggtgatttcctctagttccacccgtccataaccaagagcggcaaactcggaagcaatgcgttcctggccaatcttgaacgaccggacatcttcatcgaggatgcgccagtcgaggtccgcaataaggcttccgagagcatctcgccgatccgagataaccacgcgggagtccgggttcggcgcctgctcgaggcgatgttccagctcgtaataatcgggctgaatgtggcggaggttggtgcgagagaggctgaagcgggtcactcctccaacttcgccgagcattgtcgcgacatctcggaggtatgcgaagtcaccaggagccataaacccgtcgcggacgtaccccatagcttcgcgagtgcgggggtccatgtatacgggattgaagcgacaataatactggagcaacttctccttacggatgaaatcatccgtaaagccgacgttggcattcagatgaaagaggtctgcatacatacgatcataggccgcagggaactccgggcccggaatgaaacgtgacgcaaaaatgtgagtgtggtccatgaaatagcgaccgacatggtcgtgagcattgccaatgccgacattcatgacgtcattcgacgtcagcagcagacgcgcattttcaatggcatggcagcacaaggcgaagacctttgcgcgcacttgaactttgcggccattgagcgtggcgcagtccaggtggctgacttccttgccatcagatctcaggcgtacctgtgtgagattcagatggtgataaatacgcaggtttggggacgcgccgagttcgtcatgatacttgggcccaaggcgaatatcttgggcaatctgaaagacttttgtttgaagaatctccgatttgcgatccacgagttcatccacggggactccccgattctcgaagatcgcttgggggtcgaagaatttggacgaaatcccaagctgctcggcggccttggcaatgtacggggcgatctcagcatagccgacaggccacttcggcaagttgagctctggcctgccgtcatagtcgatctcgtcgtttgcgcggcagaagcctgaccagtgattggtggtcccgccaaagtaacggagccggcaggcggtcaggttgtagtacggcaggctgagattccgtcctgcaaagaggttctgggtctctccctcgagtgaaaagcccccgattcgatgagaaccacatccttgacggatttggccagtctgcgtgcaagcgtcaggccggcagcgccggatccgacgatacagacagatgcctcaatcaggtcgcctgcgtcactgttgcgcgcatcgatgaatccagatgtcattctaaaacaacctcaaaatcacttcccggtggaatcggcggccaggatgaagattgatgtctcggtccgcgagaaggagataccgccgatttggaccgtgcggccctgacgaaaatcttcggcaatctccctcttcatcgagcgcagggcgctcatgtcgcgctgaggaagccgcttaccttctgcccgcaaagcggtaacgtcagcggccggaagatccgcgatggcccgcctgccgagcttggcgagggagtctgccgtctgtggcgccgcgggcagtgccaacgcggcactagctgtcacggcggtgacgcatccggctgacaatgaaaggaacgtgcgacgattcacgggcaggcctctcctgatttcagtgcctgtatgcgattcggccgagcgggctcggacgtccgcttatcgaatagcatgttaaccctgatcgggccatgctcgatcgtcagccgatctgatcagaccgctccggcgatgccgttgcccgcagattgattcagatactgcgacgcgtcgcggcgaatacgagcttgatgaaagcgagcccacccaataggaccaggacgctacctgccttggccacgggttcacccgtcgcgacgtcgcccgagaacaggatggtgagaccgattgtcatcaccaccagtcccagatgggcgaggatggcatgtgccaccgcaaagcgggtggctgccagatcggggcggtccttcagcaccagcccatagatggcggatgatgcaaagcccagcaggttgagatggccgtgggcaggcccgtattcaaagtgctggctcgcggccatggcgatgcccgcggccatgccgagagcgacatagatcgctgcggcacgcagatggaaggcggcgagggcgttcatggacgaccctttctgtgcggattggtgtgacccgtcgatgcggagcggcccgggggctgagaccgccgggcgcgcatttccacaccgtatcctgccgccgatcaacgccctgcacagggcgggtcgaagtgggggtgaacggccgtcaaccttctcagaagtcgacgcatttcccgttgcgttcccagtcgccgtaacggaccggatcaagccccttggggccgccgatttcggtgggcttttccggtgcgggtgccggggtggtcgtgtccgtcgcggggggcgcgtccggggctacggcgcggccggcgtcgttctgcgtcttttcggtcatagcctttgatcctcctgcactgcatgacaccgatgcgggcggtttcgcttgaagcccccgtgcctgtccatatatgtcaggcgttccggcggcgcacccccgcccgatgcggaagccgcctgcggcctcgtcctccatccgggctcgacacatcccatgaaccacatccgaacggcagtgctgctcgcggtcatgaccgggctgttcatggtcgtgggctatctgatcggcggtggcagcggcatgatgattgcgctgctgatcgccgtggtgatgaacggtttcgcttattggaacgcggacaagctggtgctgcgcatgtatggtgcgcgcgaagtggatccgcgtgcggcaccggaactgtacgacatggtggcacggctcgccgccaatgccggcctgccgatgccgaagctctacatcgtcgaagaggcgcagcccaatgccttcgcgaccggccgctcgcctgaaaagggcgccgtggcggtgacccgcggcctgctgcaggcgctgtcgcctgaagaagttgccggtgtggtggcccacgagcttgcccatatccgcaaccgcgataccctgatcatgacggtgacctcggtcatcgcaggtgcgatcggcatgctcgccaacttcgccttcttcttcggcggttcgcgggacgacaacggcaaccccaatccgctgggcttcgtgggcgtgttgctgatctcgatgctggcgcccgtcgccgcggctcttgtgcagatggcaatcagccgctcgcgcgagtatcaggccgatcgcatcggtgccgagatctgcggccggcccgactggctcgcctcggcgctgacccgtcttgagaacgcctctcgccgcgtggtcaacggccacgccgaacacaacccggcctcggccaatctcttcattgtgaacccattgaaatccaacgccgtcgacagcctgttccgcacccatccgaccaccgccgaccgggtggcgcgcctgcgcgccatgaccgtgggcaccgcgccggccggcgcgccggtgggctttgcccgcggcccgcgccgcggcccctggggctgagcgccggatgcgcccgccccgccgccccgaggacgaccgccgcaacgaccgcggcgcccacccctctcgtgattccgggccctctcgtgattccgggccctctcgtgattccgggccctctcgtgatgcccggccctctcatgacgaccgtcccgcccgtgatcaggctgccggtgaccgcccccgcggcgcccgtccgccccagggccgcgaccggagctatcagggggatcgcgacggccggatccagggcggcaagccccggaacgaccgctatcgtgcggcccgcgatcacgcccatgagccgcggccccgcgccgactttcgtgagccgacgccctcgcgggccatcgcggccgaactgctgatggatgtgctggatgacggccggccgctggatgatgcggtcgccacccatccgggcttccaccggctggagccgcgcgaccgtgcccacgcccggatgctggtcgcgaccgtgctgcgccggaagggcgagttcgaccggctgctcggccgggtgatgcagcggccggcacccgaaaaggccatgcatgtcctgcgcctggggctggccgatctcagggttctgtcgaccccggatcatgccgcggtggacaatgccgtgcgcctcgcccaagcgggcgggctcggtggcctctcgggtctggtcaatgcggtgctgcgccggctggcggccgagggcgatcagatcgccgcggccgcgaagatcgatcccaagcgagaaaacctgccccgctggctgcgtgcctcgtgggaggcggcctatggggtggagacgaccgatgccatcgccgaggtgctgctgcgcgagccgccgatcgatctgtcggtcagaaacccgcgcgaggcggcggcctgggccgaaaagctcggcggccgtgccgtcggtggccgcaccgtccgcctcgatcgggccgagggtggtgtcgaccggctggagggctatgacgaaggggcgtggtgggttcaggatctggccgccaccctgccggccatgctgctcggcgatgtaaagggcaagctggtctacgacctctgcgcggcgccgggcggcaagaccgcacagctggcggctgccggggcccatgtcaccgccgtcgatcgcagtgcccggcggatgatgcgcctgggtgagaacatggcccggctgggcttcaccgacgtcacgccggtgaccgccgatcttcttgaatggcggcccgagggcgcggccgatgccgtgctgctggacgccccctgctcgggcaccggcacgctgcgccggcgccccgacctcgcctggtcgaagcgcccggatcaggtggcggaactggcggagctgcaggagaagctgcttgaggcggctttgaaactggtgaaaccgggcggcgtggtcgtctatgccacctgttcgctggaaccgtcggagggcgaggatcttgtccgccgggtgctcgaccgcggttttgacgccgaacgcgtgccgatcggtgccgatgaacttcctgcccggctcggcgttgcgatcaatgccgccggcgaattgcgcaccacgcccgccctgcttgccgatgccggcggcatggacgggttcttcgccgtccgtctgcgacgccgcgacgccgcctgagaccacccgtaaccagccgtcatgacggccccgtcggaggcttcccacctgatgaccgcatccgccgccagcagccgctccgccacccccagccaggcaccgatccggattgcgccgtcgatcctgtcggccgatttcgcccggctgggcgatgaggtcgccgccatcgatcaggcgggggccgactacatccatgtcgatgtcatggacggccactacgtgccgaacctgaccatcggcccgatggtggtgaaggcgctgaggccgtggtcgaagaaggtgttcgacgtccatctgatgatcgcaccggtcgacccctacatcccggccttcgtcgaggccggggccgacatcgtgaccgtccatgccgaggcggggccgcatctgcatcgcagcgtgcagctggtgaagtcgctgggggtgaaggtgggggtgtcgctcaacccctccaccccgcccgaggtgctggactatgtgctgccggatctggatctggtgctggtgatgagcgtgaaccccggcttcggcggccagagcttcatcccgtcccagctcgacaagatccgcatcctgcggtcgaagatcgatgccaccggccgggcgatagatcttgaggtcgacggtggcgtgacgcccgaaacggcggccctggtggccgccgccggggcggatgtgctggttgcagggtcggccgccttcaagggcggtgccgaggcttacgctccgaacatccgggcattgcgcgccggcgcagatcgggggcgcaccggcggctgatgccgccctccccttccgatcccgtctccgtctacgcgtcttccttttctccccccgcaatcgagagaccagaggcccatggccgcgatcacgcgcatgccgccgcccggaagtccgctgcctggcgccggcgatcgtctgagagcgctggctcatcggtggttcgtggccccgctgccggatgcgcgcggcgggctgaaacgcgtgctggaacccttgcgcccgggcgacccgcaccgcggcgtggagatggtacaggggcatttccgtctggcggggcaggtggtggaagccagtcacaagctgggcccggacccgtttcgccccgacgaggacgggatggcccggggcgacgacgagccggacatcgagctgaccccggtgccggcgcagccgccagcccctgagccgatcctggacgataccgcgcgccctgaagatgcggccctgctggaaggcggtgacgtgtcggcggagggcgagacgccggcaatggtcttcaacgccccgacccctgcgctgtcgcggccggactggctgcccgacgaggcctcggatgcctggctggtcgcctggcagggctttcagtggctgggccatctgagggctgtggcggggccccatggctcccgcgcccgggcgctggcccgcgcactcgtttttgaatggatcgcggccgaccgggctgaattccagccctatgtctggtcgccgggcattgccggccgccggctggcggcgctgtcgatgcatgcgaatttcctcatcgacgccgatgacgaccggctgcaggcggcccgcaccgatgatcgtcgcctgatggcggcactgcgccagcatgccgaccgtctggagcggatggtcaaatggcgtcgtctggacggaatcgagcgtatccaggcgctccgcggcctgtggatggggcgggcggcgctgggggccggccggcgcaggctcgcccggatcgcgaagctgttgatgcaggcgctggagcgtcagatccatgccgacggcgtgcatcagtcccgctcgccggtctgtcagctcgatctcgtctcggatctggtcgagttgaagacgatcgccgccgcccatgacgccgatctgccggccgggttcgacgagttgatcagccggctggctgcagcactccggctgatgcgtcatcgtgacggcgtgctggccctgttcaacggtacgccggagattccggcggcccgggtcgatcaggtgctggggcatgtgccggcccgcggcatggaacgactggacggcgccgtcggcggcttcgagcgtctggccgcccgccggaccacggtgctggtcgatctggggctgccggcacccgtcaccgccggacaggccggcttttccggtttctcgtcattcgagatgtcgaccgggcgcgagcggctggtggtcaattgcggcgcctatgtcgcgaggcccgggccctggatgcaggccgtcacccaggcggctgcacattccggtgtaacggtcgaagaccaggggccgcagcgagtcgaagccggatctggggaacgtcgccgcaaggccggcccgccggtcaccatcgatcgccgcgacgacgagggggcacagtggctggaattcacccatcacggcttccgtgatcacggcctggtccatgcccgccgcttctatcttgggccggacggcgacgatctgcgtggcgaagaccgctttatcgccctgccggggcgtggcgaggcgccggtccgcttcgcgctgcgcttccatcttcatcccgccgtcaaggccttacccattcagggcggcgccgccgtgctggtgcggccggtccacggcccgggctggtatgtccgggccgatggcgccagcatcgcgatcgaagagagtgtccatatgggccatgaggggcgggtgcgcccggcccagcaggtggtggtgagcggcgtcgccgagggggcggagacccgggtgcgctgggcgttccagcaggttcagcccaggggtgagggggatgtgcggccgcagggcggcttcgatgcccgacctgcgcgcatcgatgatccccgccgcgcggtgccggctgtgacggaggcgccgtcggtgccgcagggcgccgaacgcgacggcatcgcggacccgcctgcgactgcgtgaaagccgcaccgcgccttgcgtttttgccaaagttgggtcttgccttccggacgccgatgaccgatataggacctgaacagtcctgattggcgcgaggcccccgtggccctcgtgtccgaccggcccatccgacccgggacagaccgtccgatgctgaaaatcgccaagctcaccgactatgggatcgtggttctgacccatatcgccaacgcccccgatcgggttcatcgggtgacggagcttgccgaagagctggccattcccgcgccgaccgtcgccaaactggccaagaccctggcgcgggacggtctgctgatttcgcatcgtggcgcgcatggcggctatcgcctggcgcggccggcggccgagatccgggtggtcgacatcgtcgagagcctggaaggccccgtggccatcatggaatgcatcgaacatcccggcacctgccggcaggaaagcgtgtgtcagacccgcggcaactggatccggatcaaccgggcgatcagccgcgcactggaagggatcagccttgccgacatggcggcggatgcggctgtgcagcccttccccgcggcgcaggcgggctgagccggaccgtaagtttctggccggcgcgggcggtctccgggctggtgacgacgagatcaagaggcgacgcccgccggcccgatggacgggccgttcgttaaagaacgggcgcgcggaggacgagtgatgacgagcaagaacgcagtcgaggcgcttgtcgcccgcgagtacacggaaggcttccatgtcgacatcgacgcggacaacgtgccgccgggtctcgacgaggacgtcatccgcgtgatctccgcgaagaaggaagagcccgacttcatgctggagtggcggctcaaggccttccggacctggcaggcgatggaggagcccgactgggctttcctcaagaagcccaaggtcgattttcagtcgatcatctactactccgcccccaaggccagggccgacgcgccgaagagcctggaagaggtcgatcccgagctgctgaagatctacgagcgtctcggcatcccgctcaaggagcaggagatgctggccggcgtcgccgtcgatgcggtgctcgacagcgtgtcggtcgccaccacctacaagggcaagctcaaggaactcggcatcatcttctgctcgttttcggaagcggtgcgcgaatatccggagctggtccagaaatatgtgggatcggtggtgccggtcggtgacaatttctatgcggcgctcaattcggccgtgttctcggacggcaccttcgtctacgtgccgaagggcgtgcgctgtccgatggagctgtcgacctatttccgcatcaatgccgccggcagcggccagttcgaacggactctgatcatcgcggaagaaggtgcctatgtcagctatctcgaaggctgcacggcaccgatgcgcgacgagaaccagctgcatgcggcggtggtcgagctgatcgccatgaaggatgccgagatcaagtactcgaccgttcagaactggtatccgggcgacaaggacggcaagggcggcatcctgaactatgtcaccaagcgcggcgcctgccgcggggccaattccaaaatttcctggacgcaggtcgagaccggctcggcgatcacctggaagtatcccagcgtcattctgcagggtgacggctcgatcggcgagttctactcggtcgcggttgccaacaatgcccagcaggccgataccggcaccaagatgatccatatcgggcgcaatacccgcagcacgatcatctccaagggtatttcggcgggacgtggccagaacacctatcgcggcctggtgcgcatgcagaagggggcggagggcgcgcgcaactatacccagtgcgacagtctgctgctggggcctgactgcggggcgcataccttcccttatatcgagagccgcaatcccacggcgcaggtcgagcatgaggcaaccacctcgaagatcagcgacgaccagctgttttatctgatgcagcgcgggctttcggccgaggatgccgtgtcgatgatcatcaacggcttctgcaaggacgtcctgaaggagctgccgatggagttcgcggtcgaggcgcagaaactgctcggcatcacgctggaaggcagcgtcggctgacccggccatccgtttcccgcggcccgggattctgccgggcctgacgcattgcggccgcgcaaggccgccggacgatctcattcgaggaccaacatgctcatcatccgcgacctgcacgcccgcgtcgacggcaaggagatcctgcgcggcctgaacctggacgtgcgccccggcgaggtccacgccatcatgggtccgaacggcgccggtaagagcacgctctcccacatcctggccggccgcgacggctatgaggtcacgcaggggtcggtcacctatatggggcaggatctgctggagatggcgcctgaagaacgggctcggtcgggcgtgttcctggccttccagtatccggtcgagatcccgggtgtgaacaacacctatctgctgaaggcggcgctgaatgcccgccgcaagcatgagggcctgcccgaactggacggcgtgcagttcctgaagctggtccgccagaagctgaagatcgtgcatctggacgaaagcctgctgaagcgcccggtcaatgccggtttttcgggcggcgagaagaagcgcaacgagatcttccagatggccgtgctggagccgaaactctgcatcctggacgagactgacagtggtctggatatcgatgcgctcaaggcggtggccgatggtgtgaacacgctgcgcgatccggcacgctccttcgtgatgatcacccattatcagcgcctgctcgaccatatcgtgcccgatttcgtccatgtgctggcccgcggccggatcgtgcgctccggcgacaagtcgctggcgctcgaactggaggagaagggctatggctgggtcgaggatctcgccggggcggaggcctgagaccatggcggttctggatgccacgcccgacaagctggatctgctgatcgcggcccagggagccaagaccgggccggactggctggaggcgctgcgggcggccggtcgggacgggttccgtgccctgggcctgccgaccccgcgccaggaggactggcgcaatcttcgcctgaatgcgctctacggccagagcttcgccgccgccgatgcggcggcaccgcggctgacctgggcgcatctgcagccgatcgtgcccaaggggctcgactgcgaccgtatcgccatggtgaacggggtcttctccgacgaactctcggcggtgggggaactggccgacggggtggtggtcgccgggctgtcccgggcactcaccaccgcccctgatcgggtgcatgcggtgctggggcaggtggcgcgcggggatcgtgacggctttgccgccctcaatcaggcggcgcttgccgatggtgcggcggttctggtgccgcgcgcggtggaactggcccggccggtgcacttgctccatcacgccctcgccccccgcatgccggtggtcgcgcagccgcggatcgtgatcgatctggccgagaatgcccgggcgacggtgatcgagcactggcgcggccttgccggcgagaccgccttcgtcaatgcgacggttgagatccgccttggtcgcggggcgaagctgaccctgatccgcctgcagaccagcggcgagaagggcttccatatcgaccggctggcgtcgtcgattgcgggcgatgccgaactcgacatgatccagatcgacatgggcggccggctgtcgcgccacacgctggacgtggccctggaaggccgcggcgcggcggcgacgctggacgggctcttcgccatcggtgccgggcagcagaccgacacccggtccaatgtcgagcaccgcgctcgcgactgccgcctgtcccagacctggaagggtgtggcgggtggccgggcgcgcggcatcttcaacggccgggtccatgtccttccgggggcgatcggcaccgatgcggagatgtcgagccgcaacctgcttgcctcgcgtgaggccgagatcctgcccaagcccgagctcgagatccatgccgacgaggtgaaatgcgcccatggcgcgaccgtcggtgccatctcggagcaggagcttttctacctgcgaagccgcggactggatgccgccgaaggccggcggatcctgacccgggccttcgccgaggaaatcgtcgaccgtctgcccttcgagaccttccgcgagcaggtctcgggctgggtcgaccgccacatggcccagaccgtgctgaacgagacggtcgcgaaggaggcgacggcgtgatgaccgatcagaagaccctgccggtttacgacgtggagcggatccgcgccgatttcccgatcctggccacccaggtgcgcggcaaaccgctggtctatttcgacaatgcggcctcctcgcagaagccgcgccaggtgctggatgtcgagcgggcggtctatgagacctcttacgccaatgtccatcggggcgtgcactacctgtcggaaaaggcgacctcggcctacgaggcggcgcgcgaaaccgtgcgggcctggctcaatgccgcgtccgagcgggagatcgtcttcacccgcggcaccaccgaagggctgaacctcgtcgcctatacctggggccgggccaatctgaaaccgggtgacgagatcctgatcacccatctggagcatcactccaacatcgtgccctggcagatcgtggcggagcagaccggcgcgcggttgatggtggtgccggtgaccgataccggcgaggtcgaccaggatgccttcgatcggatgatcgccggcggccgggtaaagatcatggccgtggcccatgtctccaacgcactcggtaccatcctgccgctgcagcggatgatcgatgcggcccatgccgcgggggcgattgcggtgatcgacggcgctcaggccctgccgcatatgcgggtcgatgtccgggcgctggatgccgatttctatgcggtctcgtcacacaaggcctatgggccgaccggcttcggggtgctctacggcaagctgccgctgctggaagccatgccgccctggcagggcggtggcgacatgatcgagacggtgagcttcgagaagaccacctatgcgccgccgccggcgaagttcgaggccggcacgccgcatatcgtgggggcgatcgcctttgccgccgcgctcgactatctggccgcggtcggcgtcgaggccgtggcagcccacgagcacgacctgaccgtctatgctcatgaacggctgcgcgagatcaaccggctgaagatcgtgggcgaagcgcgcgaaaaggcgggtgtggtgtcctttgccatcgacggcattcatccgcatgatatcggcacgatcctggatcagcagggcatcgcggtgcgcaccggtcatcactgcacccagccgctgatggcccgtttcggcctgccggcaacggcgcgtgcgtctttcggcatgtacaacacccgcgccgaggtcgatgcgctggtcgacgggttgcgcaaggtcgtgaagttcatgggctgaggagacccgccatgccggccgataccgccctcgacgacgacctccggtcgctctatcagcagatcatcctggagcataaccgcaacccgcggcatttcggccggctggacccggccgatgccagcgcccatgggcataacccgctctgcggcgacgaggtgacggtcgatctgaggttcgagggggatcgggtggcggagatcgcgttcaaaggtcgtggctgcgccatctcgaccgcctcggcatcgatgatgaccgaggtggtacaggggcgcagccgggccgagatcgcggagatgttcacccggttccgcgatctggtgaccggggccgatccccgggcgctggaccatccggaggtcgaggcgaccctgggcgttctggcggcactgggaggcgtgcgcgaatttccgagccgcgtgaaatgcgccaccctgccctggcacaccctgacccgggcattggagcatggcggcgacgcaggcggggccggcgggccggtttcgaccgagtgacgtggcccaaggcaatcatcaggccccccgatgcaggcggccggagacgacgggtttcgaacggaaacaggcgatatgagcgacaacacgaacccactaccgcaggacgatccgggcgatctcgaagccgcggtcatcgatgtgctgcgcagctgctacgaccccgagatcccggtgaacatctatgatctggggttgatctacgaggtgcgcatcgatgcgggcgaccaggcctatatccgcatgaccctcacctcgccgatgtgtccggtggccgaaagcctgccggtcgagatcgagaccaagatccgggacattgcaggcatctccgacgtgaccgtcgaggttgtctgggatccgccctggacccctgagatgatgagcgaggacgcccggctcgaactcaacatgttctgagccggaatatgttccgggcaggccacctgcccgggattgaacccgtcatcctgctgcgtcatgctgccttgagcatgaccgggcacgggcacgtgccataagaacgcagaggacgggatccatgcatcagatgatcggcctcgccatcggcgcggtgctgttcctcatcacccatctggtgccgggcatcccggcggtcagacgctatatgatcgcctctctgggggagggcgcctatcgcgccctgttctctctggtggcgctcttctctctcggcattctgatctggggctatgggcaggcgccctatgtgccgctctgggacggcagcggggcgctgcgtcatcttgccttcaccctgatgctgtttgcggtcgcctttgccgtgctggggcttacccagcgcaacccgaccatggccggggccgatgccgccggtgcgcccgcgcccaaggcggtcggtgtgctcaagatcacccgacacccgctgatgtgggggatcatgatctgggcggtggcccatgttctggccaatggcgacctggccaccaccatcctgggcgtcacgattttcatcgtcgcattcgccggcagccggctgatcgagatccgcaagcgccgcgacatgccggtctcgtggatgctgtttgccgctgccagctcgtatatcccctttgccgccgtcttcgcgggcaaggccaagggtgcctttgccgagatcgcctggtggcgctggctggtggcgctcgtggtttatgtggcccttttcgcaggccatcgctggatcgcgggcgtgccgctgatgtgaggcaggcctgccattcgcccggggatgccggccgataaaaagactcgtatacgagatatatgtatgcgagagttcatctcatgaaccgcatcgaagactgcatcagtttcctgaccggcaaggccgctcaggccgtgacacgcgcggcccgcgaccggctggcccggcatggggtgaccccggtccagtacgccgtgctccagctcctgtgggaagaggacgggcagagcggtgccgccatcggcacccgcctggtgctggacagcgccaccatcaccggcgtgatcgaccgtctggtcaagctggagctgatcgcgcgccggccatccgcccgggaccggcgggtcaacgccctgcacctgaccgatcggggcctggcgctgcgtggcccgctccaggccgagatggacgcgctgaatgccgatgtcgatgcggccctgggcggcccggcagcagaggagctgaaatcactccttcgccggatcgcagccgccccctcccgtaaggagctcgcggagatatgcagttcgagaccaagatcgcgctggtggtgcgcgatgatcttgccgtgtggcaaaaactgaatgtcacggcgttcctgatgagcggtgtaaccggggccgcgcctgagatcatgggcgagccctatcgcgatgccgcgggcaatgccgcattgccgctgtcggtgcagccggtcatcgtgctggcggccgatggcccgacgctcgccaccatccgccgccgctgtctggagcgcgaggtggtgccggcgctctatgtcgaagagatgtttgcgaccggccatgacgccgccaaccgcgcggtctttgcagaacagcggccagagacggcgaagctggtcggcctgggcatgcgggccgatcgacgcgtggtcgaccggatcaccaagggcgcgcgcatgcatccctgaccggtaggaggggcgggtcgcgtgacgtgatggcggctcaggcgagggcggcatgcagatccgcccgcacgccgtcgatatgggtggtcaacaccctgcaggcggcatcgatctccccccttcggcagagagcgatcagcgtgccgtgttcccgctcggcccggccgggggacggggtggtggagagctgaagccgggtatagcgatcgcaggtctgcagcagtccggtcacgatgcgcaggctgcgcggcagacgggcgtgtgtgtagatcgccagatgcagttcggcattcagggcaccccagcgggccatgtcgctggcggcgacggcgccgatgaacagatgatggatggtctcgatccgggcgaaatcggccgctgtcagggcgggaacggcgcggcgcagcagccgcggctccaggatcactctcaggtcgaagacgtcgtcgatctcctctcgcgagatcgacgacaccacggcgccgatgcccggcaggatccgcaccagcccttctgcatccagctgcagcagggctgagcggatcagggccggatcgaccccatgcctttctgccagcgcgttctggcgcagttcagtgcccgccggaaaggctccgtcgatgattgcctgacggagttcgttcaagatgtcggcggcggacggatgaagcatagggccaaagcgcctgcctattcgggggtctgttccggcgcgccggcgaagagtgcggcaccgggcgactggaccagggactggtagtggtcgaactggaccagcacgtcggaaatcaactgatcgcgggtcaggccgtagacgtcatagccgcggctgccgtcgctgaaccaggtgcgggcctcgtggcgcagatcggggcgggcggcatccatcgcggtcagggcgggcagcgggtggctggccggctggatgccatagatgaagtttcgcacgccttcggcaggcagcaccagcgagacaccgcccgtcgtctcgtcgcgttccacctcggccggatggccgcggccgttgaattcagccgccactgccctcagcgcatccgtggcggtaccgtccaggaagcgacgcacatccttttcatccggcgtgtgcaggatctgaccaagacggcgcttccagccggcttcgacggccgggacccctgtggtcgtgacgggggcgccgagcggccggtgggcaagatctgcgctcatgccgcggaacaggctccagcacagcagcagcatcaccacggcgaagggcagggcgctggcgatggtgacggtctgaagcgccgacagaccgccggccagcagcagaaccgccgcaaccacgccttcaagcacgcaccagaacacccgctgcgggatcggggtgttggtcgcaccgcccgaggcaatggtgtcgacgaccatcgagcccgaatccgacgaggtgacgaaaaacacggtaacgagcatcaccgccagaaccgccgtgatcgacgagagcggcagatattcgaggaactggaacagggcgaccgacacatcctcggcgaccgcggcggccagtgcgccattggcgacctcggtgtcgatgaacatggccgtgttgccgaacacggtcatccacaggaaggtgaaacccagcgggacaaagagcaccgcgatcacgaattcccgcaccgtccgtccgcgcgaaatccgggcgatgaacatgccgacgaagggcgaccacgagatccaccaggcccagtagaacagcgtccaggaatagatccacgagcgcggttcataggcatagaggttgaaggtcttgaggacgaaattgtcgagatagatgccgatgttctggacgaaggcccggaacagcatcgtggtgggccccacggccagcacgaagagcatgagcgccacggcgagcaccagattggtctcgctcaggatccgcacgcccttgtcgaggccgctgatgaccgagatggtggccacgccggtgacggcggcgatcagtgtcacctgcacgatcggagagacttcaagcccgatcagatgatcgagaccggcattgatctgcagaacgccgaagcccagagaggtggcgagaccgaagaccgtgccgcagatcgcgaagatgtcgaccgcatggccgatcggcccgtggatccgctctttcagaagcggatagaggcccgagcggatcgtcagcggcaggttgtagcgatagccgaaataggcgagcgacaggccgacgatggcatagatcgcccaggcgtggatgccccagtggaagaaggtgatgttcatcgccgagcgctgcgcctcgatcgagcggggctcgaccacgggcgggctcgcgaaatgggtcatgggctcgccgaccgcgaagaacatgagtccgatgcccatgccggcggcaaagagcatggccacccacgatccgtagcggaaatccggttcggaatcgtccgggccgagcttcagccggccgaagcggctgaagccgaggaacagggccatgcccaggaagatcgcgaccaccaggatgtagaaccagccgaagcgatgcaggatctcgctttggacgacggcgaacaaggcttccatctgctcgggtatcgcggcccctgcgaccacgaaggcgaggatgatggaagcggcgccgaagaagaccggcgggttgatcgtcatccttagcatgatccggatcctgcattggtggcgctctggtccccacgctacaggaagccggccgatgacgcgacgtcagatccagggcaatgtcatggatcaagtcgtcacgcagtgccatcaaatgacataacccgtgttcattccggggcggaccctgccgtaacgttacgatctattgacctgatgcatctttcatgacgtcatgtggtcaagcgaagtcgggtgacattcgttgctcccgaaagatacgaggtcatacaaatgagccggaacgttctgtatctgattatcggtgctctgctcgttgttgtcgccgtcggcggctaccagtattacgaggagagtcagaagagcggcatcgaggtcgaggtcggcaatggcggcctgtcggtcgagacgaagtgagcctccggctgatcaaccattcaggcgatcgatctcggccagccgccgggctgcgttgtcgagatcgtcgtcggcaaacacctcgataccggcggtggcaagagcctcggccgtcaggccgtcgccttggatcagccggccgctgaaactgccgtcatggatccgcccgaccccgcaggacgggctccgcgctttgagcagcgccaggcgcacgccatgggccagggcagtttcgacggcgatgcgggcaccggctgaaaatgccgcggtgacatcggcgccggttgcgtcgatcacccggcggcggctgtcgagctccgccggcggtcgtggtgtcggcagaccacccgccatctcggggcagagcgggatcagccgaccttcggcgtgaagatcgtcgatcagcggatgcggtcgtgcggcaccccggccgtcgaaacgaaccggcctgcccagaaggcaggccgaaatcagaaccgggcggcgccctgccgcccggttttcgtggcgtgcggacatcacgccgcttcgcggctgagcccgtcgaccaggtcgacgatgtcggccatgatctgggtgatttcgaagtccttgggcgtgtagacccgggcgacgccggccgccttcagcttgcgggcgtcctcgtcggggatgatgccgcccacgatcaccggcacgtcggtgagcccggcttcggccatgcggcgcatgacatcggcgaccagttcgttgtggctgcccgacaggatcgacaggcccacgacatgaacgctctcttcgagggcggcattgacgatctgggccggggtcaggcggatgccctcgtagaccacttccatgccgcagtcgcgggccttcagggcgatctgctcggcgccgttggaatggccgtcgaggccgggcttgccgaccaggaatttcagccggcggcccaggcggtccgacaggctgtccaccttggcgcgcaccgcctcggtccggtcgcgatcgccgcgcacctcgaccacgctgccgccgacgccggtgggggcgcggtattcgccgaagatctgacgcagcgtctcggcccattcaccggtcgtgaccccggcatgggcacaggcgatggagctttccatgatgttgcggccttccttggccgcacgggcgagttcggcgaggctcgcctccaccgccgtcgcatcacgggccgccttgtgggcctggagcttctcgatctggcggcgttcgacgccgggatcgacggtcagaatggcgccgtcctcgcccgaggtcagcggcgagggcgcggtctcgacgaatttgttcacgccgatcaccgccatctcgcctgattcgatcgacgccacgcgccgggcgttgctttcgaccaggcgctgcttcatgtagccgctctcgaccgccgtcaccgccccgcccatctcttcgatccgggccagttcggcgcgggcgccagccttcagctcctcgaccctggccgcgaccaccggcgagccgtcgaacagatcaccgtattccagaaggtcggtttccatggcgacgatctgctgcaggcgcagcgaccactgctggtcccagggacgcggcaggcccagagcctcgttccaggccggcagctgcacggcgcgggcgcgggcgttcttcgacagcaccaccgccagcatttccagcaggatgcggtagacgttgttctcgggctgctgctcggtcaggcccagcgagttcacctgcacgccgtatcggaagcggcggaacttctcttccgcaacgccgtaacggtcgcgggtgatctcgtcccaaagctcggtgaaggcgcgcatcttgcaaagctcggtgacgaagcggatgccggcattcacgaagaagctgatccggcccaccacctgcggcagatcagcctcgggcacctggccgccggcacgcaccgtgtccagcaccgccaccgccgtcgccagcgcataggccagttcctgctcgggcgtcgcccctgcttcctgcagatggtaggagcagacattggtcgggttccacttgggcagttcccgataggtgaaggcgatggtgtcggcgatcaggttcaggctgggcttgggcgggaagacataggtgccgcgcgacagatattccttgatgatgtcgttctgggtggtgccctggagcgacgcccgcggcgccccctgcttctcggcggtggcgatatagagcgacagcagccaggccgcggtcgcgttgatcgtcatcgaggtgttcatccgctcgagcgggatgccgtcgaagagcgtcatcatgtcgccgatatggcagatcggcacgcccaccttgcccacctctccccgggcgaggatgtggtcggcgtcgtagccggtctgggtcggcaggtcgaaggcgacggagagaccggtctgaccgcgcgacagattggtgcggtacagcttgttgctctcctccgccgaggaatggccggcataggtgcgcatcagccagggcgtatcgcggcgcggcatggcgccgcttgccgcttctgcggcggaattcggctgcttcggcatcttttcgtcctgtcgtggcggggttctgtgtcgaatcttaccctgagggcgccccattggaaataaggccctattttgcgccgcaaaaaagggcttgaaaatcccttatatccggaaaatcatgaacggcaaccggaaagctccggtcgcgatcgcgtcgcagcatgcgaccgtaccgcgattgatcttccggggttctggtcccgtcgtccctttgcggacgggaccgccggaccatccgaacgataccaccaagaacgaatgacaagaaccaacgcgcgaacaatacgcgcggttccacgacagtacgccggccccggacatcggggcgctgccaggaggccgcaggattgcgtggtgccccgaccccacctgcggacgcttaaggtcgagagaagtagaacgagggcacggtcttcccatgaacactgacaccaccgccgccgagacgacccgcacccagccggtcaagtcgctctacgaggtcggcgagattccgccgctgggccatgttccggatcagatgtacgcctggtgcatccgccgggagcgtcacggcaaccccgacaccgccatgcaggtcgaggtcgtcgaaacccccaaggatctggcgccggacgaagtgctggtcatggtgatggccgccggcgtcaactataacggcgtctgggcctcgctcggccgtccgatctcgccgttcgacggccatggcgcgccgtatcacatcgccggctccgatgcctcgggcatcgtctgggccatcggctccaaggtgaagcgcttcaaggtgggcgacgaggtcgtcgtccactgtaaccaggacgatggtgacgacgaggagtgcaatggcggcgacccgatgttctcgccgtcgcagcgcatctggggctacgagaccccggacggctcgttcgcccagttctgccgcgtgcagtcgcgccagctgatgccgcgcccgcgccatctgacctgggaagagagcggctgctacatgctgacgctcgccacggcctaccgcatgctgttcggccatcgcccgcacatcctgcgcccgggtgacaatatccttgtctggggcgctgccggcggcctgggctcgatggcgttgcagctgatcgccacggccggcgccaacggcatcgcggtcatctcggaagacaacaagcgcgacttcgtgctcagcctgggcgccaaggcggcgatcaatcgcaagaatttcgactgctggggccgtctgcccgaagtcgatgacgtccagggctacaacgactacatccgccgcgtccgcgccttcggcaaggcgatctgggacgtgaccggcaagggcaatgacgtcgacttcgtgttcgagcacccgggtgagcagaccttcccggtctcgacctatgtggtcaaacgcggcggcatggtcgtgttctgcgccggcaccaccggctacaacctgaccatggatgcccgcttcgtgtggatgcgccagaagcgcatccagggcagccatttcgccaatctgaagcaggcagcccaggccaatcgtctggtgatcgagcgccgcatcgatccctgcatgtcggaagtcttctcgtgggacgacatccccgaggcgcatatgaagatgctccgcaaccagcataagcccggcaacatggccgtgctggtccaggcgccgcgcccgggcctgcggacgatcgaggacgccatcgacggctgacagacctgacgcggtgagcgaccgggcggcggtgccgcctcgcccggtcccggcgctgcctgccccgatccggcctcgtcaggggagcggatcgggcgggcggcgccgcaccgtcgtctggatgccgcatcggatcagccggggcggcgctggacgccggccgcctcagggccatatccgctccggtatcccgccgtttccgacctccgcagtgttcgacacgtcttccgaccagaggaccatttctcccatgtccgcttccaccgcgaccctttcgcccgtgaccgacgcccccgtcctgatcgacgatctgctcgaccgggccgaacgtgcccttgccgccgtcgaggcctatgccgacgccgtccagaccgccgtgggcgggatggtgcgccgtgacggcaaggtcgatgccgccgtgctcgatgccagccagcatgccgcccacggtcttgcctggacggcgacctatgtcgaagccctgcgccagatgctgggctgggcacgccggctggaggccgaaggacggctgggggaaatcgaggggctgatgctgcagaccgccttcggcgagtatgtggcgcagctgcagggtggcctgcccatgtcgcagggcgagatcgtccgtcctgccgatttcggcctgatcgacgaggcggcggcactgtcccagggcgatgcggggctgttcctgcgtgcgggcaacaccgctgtggtgcgcgcccggctggcggcgctgatcgccgagggtaatttcggcgagctggggctcgaggacgagaccctgctgatgatccgcgaccagttccgccgcttcgtagaggaaaaggtcgtccccttcgcccatgactggcacaaggccgacgagctgatcccgatcgaggtcgttaaccagatggcggagctgggcgtcttcggcctgaccgtgcccgaggaattcggcgggctcggcctctccaaggtcgcgatgtgcctggttaccgaagagctgtcgcgcggctatatcggcgtcggctcgctgggaacccggtccgagatcgcggccgagctgatccggctgggcggtacggaagatcagaagcagagctggctgccgcgccttgcctcgggcgagatcctgccgaccgcggtcttcaccgagccaggcaccgggtccgacctcggcggcctcaagacccgcgcgacgcgcgatggcgacgtctatcgggtgaccggcaacaagacctggatcacccatgccgcccgcgccgatctgatgaccctgctggtgcgcaccgatccggcgacgaagaactattccggcctgtcgatgttcctggccgagaagccccgcggcaccgatgccgatcccttcccggccgagggcatgagcggcggcgaaatccgcgtgctcggctatcgcggcatgaaggaatacgagatcggcttcgacgatttcaccgtgcccgccgacaatctgctgggccggaccgagggtcagggcttcaagcagctgatggcgaccttcgaaagcgcccggatccagacggcggcccgcgcggtcggcgttgcgcagtcggcgctggaaatggggctgcgctacgcccatgagcgcgtgcagttcaacaagccgatctacgccttcccgcgggtcttcgacaagctggtctgggcggcagtcgagatcatgatcgctcgccagctgacctatttctcggcgcgcgagaaggacagcgaccggcgctgcgatctcgaggccggcatggccaagctgctggcggcccgcgtcgcctgggccacggccgacaatgccgtccaggttcatggcggcaacggctatgctgaggaatatccgatcagccgcgtgctctgtgatgcgcgcatcctcaacgtcttcgagggtgcggccgagatccaggcgcaggtcatcgcccgccgcctgctgggctgagggtgacggggccggcttccgcagggaagccggccttcgcgcgaaaatctcccccgccgggaccggttgaccctgtcagaccgggcccggcggggccatattgcgggccatggatacgatgtcaggcgtgatgccggttctgattgtggttgcgatggtcgccacggccggtgttctcctggtgggcgtgatgtcgatgctcgtcggcggacgcttcaaccagaaatactcgaacaagctgatgcagtggcgggtgctgctgcaggcgctggcgatcctgctcgttctgctgttcctggcgatgacgggcggctgagcccgccggtcgtggcccccgctggccgtggcccccgccggccgtggccatcgccccctggctatcttgctttcacccaccgacggagcccccgatggtccagctcacccgcatctacacccgcggcggcgatcgcggcgaaacctcgctcggcgatggcagccgccggccgaaggacgacctccgggtcgcctcttacggcacggtcgacgaggcgaacggcgtgatcgggctggtgcggctgcatctggagaccgagagcgaggaagaccgcatgctcgcccggatccagaacgatctgtttgatctgggggcggaccttgcctgccccgccggcgacgatcccgcgcgggaggccagggcgctgcgcattctgccggcccaggtcgaccgcctggaaaccgagatcgatgcaatgaatgccgggcttcagccgctcaaatccttcatcctgcccggaggcaccccggctgcggcccatctgcatctggcgcgaacggtcgtccgtcgtgcagagcgcgaactggtcgagctgatgcggctggagccggtgaacgaggcggcgctccgctacctcaaccgtctgtccgatcatttgttcgtcctggcgcgccatctgaacgacaagggcgcgcgcgacgtcctctgggtgccgggcgccaaccgctgacgcggcgttaagccgcggcgttccttgaattttcgagaggtgccccgaaattgacaccgcacgtcgcagcgcctaatgtgcggtggactcaatcggggaaccggcagccggggccatgtgacgcaggccgtcgcggtcagccggtcgcctgtcgcctgtcgtccgacggagagccggcgccctgccgttcgctgccgggcgtcctggtccggatccgcacccgctgaggggtcgggggatgcgaccggacgacgtagagccaagaaacccaactggagtcgggagatctatgaaggtactcgtccccgtcaagcgcgtggtcgactataacgtcaaggtccgcgtcaaggctgaccagaccggcgtcgacctcgccaatgtcaagatgtcgatgaaccccttcgacgagatcgcggtcgaggaagccgtgcggctgaaggaagccggcaaggccaccgagatcgtggtcgtgtccatcggccccaagggtgcacaggaacagatccgcacggcgctggccatgggcgcggatcgcggcctgctgatcgagaccgatgaagaggtccagccgctcgccgtcgccaagctgctgaaggcggtggccgaggccgagcagccgcagctggtggtgctgggcaagcaggcgatcgacgacgactccaaccagaccggccagatgctggcggcgctgctgggctgggcccagggcaccttcgcatcgaaagtcaccgtcggtgacggcgaggtcgaggtgatccgcgagatcgacggtggtctcgagaccgtctcgctcaagctgcccgcgatcgtgaccaccgatctgcgtctcaacgagccccgctacgcttcgctgccgaacatcatgaaggcgaagaagaagccgctcgacaccaagacccccggtgatttcggcgtggacgtggcgccgcgtctgaagacgctgaaggtcaccgagccgccgaagcgcaagggcggcatcaaggtgccggatatcgcgacgctggtggacaagctgaagaacgaggcgggggttatctgaccatgacggttctcgtcattgccgatcacaacaacgcgtcgctcggcgccgcgaccctgaacgccgtcaccgccggtgcgaagctgggcgatgtgcatgtgctggttgccggcaaggatgccggtgcggccgccgaggcagccgccaaggtgcagggcgtcgccaaggtactccatgccgagggcgaccagtatcagggtggcctgcccgagaacctggccccgctgatcgtgggtctggccggcgactacagccacatcgtcgcctcgtcgagcagcgttgcgaagaacgtgctgccgcgcgtggctgctctgctggacgtcgcgcagatttcggacgccattgaaatcgtgtcggaagacaccttcgtccgtccgatctatgccggcaatgcgctggcgaccgtgcagtcctccgacaaggtgaaggtcctcaccatccgcggcaccgccttcaaggcggccgaggccgagggcggttccgccgccgtcgagaccatcgccgccggtgaggatgcaggcctcagccgcttcgtcggccagagcctgagcaagtccgagcgtcccgaactcgccagcgcgaagatcgtggtgtcgggtggccgcggcgtcggcagctccgacaacttcaagatcatcgaaggtctggcggatgccctgggcgccgccgtcggcgccagccgcgcggccgtcgatgccggctatgtgccgaacgactaccaggtcggccagaccggtaaggtcgtcgcgccgcagctttatgtcgcggtcggcatttcgggtgccatccagcatctggccggcatgaaggacagcaaggtgatcgtggcgatcaacaaggacgaagaggcaccgatcttccaggtcgccgattacggccttgtgggcgatctgttcaagatcgtccccgagctgaccgagacgctgcagaagtgaagtaacatatgaccggaacgatgccggtcatgtgaaagaaaaccgagcccggtgcggggtctggcgtaacttgtgtaaagcaagcgacgccgagccctgtcccgggctatcaagtcgaagaaggtgcggtcctcatgatcaggaagatcggcgtcatcggggcaggccagatgggccgcggcatcgcgcatgtctgcgcgctcgccggctacgacgtcacgatggtcgacatttccgaggcgcagctcgccaaggcgatggaccggatcgagcaggcgctcgaccgtcaggtgtcgcgcagcgagatcgagcccgcggacaagcccgccgctctgtcccggatcaggacgcaggtcggttacagcggcttcgagacgatcgacctggtgatcgaggcggccaccgagagcgaagaactgaagcggaagatctttgccgagatccgcgacatgctgaaggacgaggtgatcgtcgcgaccaacacctcgtcgctgtcgatcacccgcctggctgcgaccatgcgtcaccccgagcggttcatgggcatgcatttcatgaacccggtgccgcgcatgcagctggtggaactgatccgcggcatcgcgaccgacaacccgacctacgaggcggtgcgcgagctggtcttcaagctcgacaagactccggcggtgtcggaagactttccggccttcatcgtcaaccgcatcctgctgccgatgatcaacgaggcgatctacacgctctacgagggcgtcggtacggtcgaggcgatcgacaccgcgatgaagctgggcgcgaaccatccgatgggtccgctcgagctggccgacttcatcggcctcgatacctgcctgtcgatcatgcaggtgctgtatgacggcctggccgacagcaagtatcgcccctgcccgctgctggtgaagtatgtcgaggccggctggctgggtcgcaaaaccgatcgcggcttctacgactaccgcggcgacgttcccgtgccgacccgctgacgcggcacaggatcatcgaatcttctggggccgccttccgggcggcccctgccgtttgaacctcagcggcccgccgccgctttgccgatggcggcgttgatcagggccacaccttcgggtgcatcccaatgggcgatgccgaccagccgggcgatctcgcggccttcgcgatcgatcagcagggtggtgggcaggccggcgaccctggtggcccccagcgtgcgcatgggcttgtcgatcgcaacctcgatccggtcgagattcagcttttcgaggaaggggccgaccacggccgcaccaccctgatcggccgcgaccgcaagcacggtgaagtcggcgccgccgagcgaggcctgtagccggttcagggccggcatttcctcgatacagggtgcgcaccacgtggcccagaagttgagcagcacgaccttgccccggtagtcggcaagcgtcaccgggctgccgtcgagcctggtcatttcaagtgccggcagcggagcgggctggtcctggacctgaagcttcgccagactgtcccgtgcaaaggaggcatcgatcccacccggcttgtcggcggggccgaagccgcggtagataaggacacccgccacgatgacgacgacggcggcggcgagagcggcgatgaccggtttcttcatgcgaggcggatctccgtgtgaggaagggctgtcgcgactatccgcctgccgcgcaatcgccgtccccatccgtcgaaacccggggagaccatccaggtcccccgacctgccaggaagccgaggagcgagatgaccagcgacagcaagggcggcgccggccgcgcgagcggcgtgaacatgtggggcggccacttcgacagcgcgccctcggatctgatgcaggagattaacgcctccatcgatttcgacaagcgcctctacgcccaggacatcgccggctcgcgcgcccatgcccggatgctgggcgccagggggatcctctcggccgaggacgtggctgcgatcgaaaacgggctcgaccaggttctggccgagatcgagggcggtgactttccgttcagccgcgagcttgaagacatccatatgaatgtcgaagcccggctgaccgagatcatcggcgatgccggcaagcggctgcacaccggccggtcgcgcaacgatcaggtcgcgaccgatttccggctgtggctgcgcgacatgctcgaccgtttcgacggccagctccgcgatctgcaggcggcgctgatcgagcgtgcggaacagcatgccgagacggtgatgcccggcttcacccatctccagaccgcccagccggtgaccttcggtcatcatcttctggcctatgtcgagatgttcggtcgcgatcgcggccggctctccgatgcccgccgccggctgaacgaaagcccgctggggtcggcggcgctggccggcacctccttcccgatcgaccggcacatgacggccgccgaactcggtttcgaccggccgatggccaactcgctcgacggcgtctcggcgcgcgatttcgcgctggagttcctgggagcggcggccatctgcggcacccatctttcgcgcattgccgaagagctggtgatctggtcgtcggcgccctttcgcttcgtgcgcatgtccgacgcctataccaccggctcgtcgatcatgccgcagaagcgcaaccccgatgcggccgaactggtccgcgccaaggtcggccggatcatgggcgcccaggtcgcgctgatgacggtgatgaaggggctgccgctcgcctattcgaaggacatgcaggaagacaaggagccgaccttcgatgcggtcgacgccctgtcgctggccatccaggccatgaccggcatgatccgcgatctgaccatcaaccccgatgccatgcgtgcccaggcctcgggcggctattccacggcgaccgatctggccgactggctggtgcgggtggtggggctgcccttccgcgaggcgcaccatctgaccggtcgcgtggtccgcgccgccgagacccgcgggctccggctcgacgaactttccgccgaggatctggcggcggtggatgcccggatcacggccgaggcgatggcggtgctgaccgtcgatgcctcggtgcgcagccgcacctcgttcggcggtaccgcgcctgacggcgtgcgtgcccgtgcggccgaagccagggagcgctttctgtgagccacttctccatccgcctccgatacctcgtcctggccctgatgatggcgacggcccttgccgcctgcggcaagaagggtgaactggtgccgccgatggcggtgaaatccgacggcaccgtcgacaaggagaagatccccaactatccggtggggtccgacccgaagagcctggtgaccccgggccgcaccaatggccccggccttggtgtgccgccctactgacgcccgatcccgaggacgacatggatcatttcgaataccgcaacggcatcctccatgccgaggacgtgccgctgacccggatcgcggccgaggtgggcaccccggtctacgtctattcccgcgcgaccctgacccgccatgcccgcgtctttcgcgacgcgctggcggggctggatccgctgatctgctatgccgtgaaggccaatggcaatcaggcggtcctgaagctgctggcggcggagggctatggcgccgatgtcgtctcggcaggcgagatgaagcgtgctctggctgccggcatcccggccgggaagatcgtgttctccggcgtggccaagaccgatgccgagatccgcgcggcgctggaggcgggcatccttcagttcaacgtcgaaagcgacgccgaactggacgcgatcgagcaggtggcggcagccatgggggtgacggcgcgggtgtcgctgcgcatcaaccccgatgtcgatgccggcacccatgccaagatcaccaccggcaaggccgacaacaagttcggcatcgcctgggatcgcgcgatcgacgtctacgcccatgcccgacggctgccgcatgtcgaggcgaccggcatcgacctgcatatcggctcgcagctttcgaagctcgaacccttcgaggcggctttcacccgcacggtggagctgatccgcaggctcaaggccgaaggtcacccgatccgccatctcgatctggggggcggcctcggcatcccctatagcgacgagacgccgcctgcgccccaggcctatgcggagatggtgcaccgggtgaccggcaacctggatctgaagctgattttcgagccgggccgggtgatcgtcggcaatgccgggctgatgctctccgaggtggtctatgtcaaggagacggcgagcaagcgcttcctgatcctggatgcgggcatgaacgacctgatgcgtccggccctctacgacgcctatcacgaggtggtggctgtcaacgagcccgcggccggggcgccgcgggacccggtggagatcgtgggccccgtctgcgagagcaccgacgtcttcgcccgggagcggccgatgccgccggtggcgcggggcgatctggtcgccttccgttctgccggtgcctatggcgccaccatgtccaacacctacaatgcccgcgaactggtgcccgaggtgctggtcgatggcgaccgctatgccgtcatccgtccgcgccagacggtcgacgagctgatcgcgatggaccgtgtccccgactggatctgagatccggcggacccgcgcatgaatgaagagggcggcagccggtgaccggctgccgccctcttgccgttcgaccgccgggctgccgagcggggtcagccctctttgggggccagcacgccgataaagggcagctcgcggaaataatgagcgtagtcgaggccgtagccgatcacgaacaggtcgtcgacggtgaagcccacatgatcggcctggaactccaccttcgccttgccgggcttgtggagcagcacgcaggatttcacctccgcagcgccgcgcgacagcaggtgagcgcgggcgaagcgcagggtgcggccgctttccaggatgtcgtcgatcagcaggatctggcggccctcgaccgagtcggtcacgtccttgcggatctcgaccacgcccgagctggtggtgctgcggccatagctggacagcatcatgaaatcgacctgaggctgcatgccggcgccgtgcaggccccggatcagatcggcgcagaagacgaagctgcccttcaggatggcgaccagcaatggttccggccccatgctcgacgcgatctccgaggagagcccctggatcctctggtcgatttcgcctcggctgatcagggtgcggatgtcgccttccggacgcatgcggtctggtctccagatgtcggggatggataaggcgccgcgcctggcggcggcggcgcctttgggagtctattctgcggccgagaagcgcacgtcgaagcggactgcctctcgcggcggattttcgacccgctggttgaagcgtagaacctcgccgggcagcatgcggttcgacgagacgctgaagctcgacgttccgagttcctgaccgcccgcgccgtaatacatgatcgtgagcggcggaacggcccggacaccgtcggagagattgtagatctcgccgtcgatttcgaggatcggccgtccctcgaccgtttcgccccgggcaaccaggttgcgaacctcgagccccagcacctctcccccgacacccaggcccagcgtgccatagacggcggcggtgaagggcagggcgcgtaccacctgttcccggcccacgatcaggccgccgatcatcgcggcgatcacgatgccgagggcggtgaaggccggccagcgcgggctgcgggcgggggccatatccatggcaaccgggcgccgctcgtacaggctggcgggctcgtcggggttctcgtcacggggcagcgccagggggcgcggcatgtcggccggcgggtcctggtgccagacatggccgcattgggtgcaacgcaccttccggccatcagggcccagggactgcgggtcgagcgtatagcgggtcgaacaggccgggcaggtcaggatcatcgctcgaaaccgagggtgtgcggggcggcatgcgccgtgccgccgggcggcctggcaggggaggtcctcgcgccggatgaacgggtgcagccaaggttgcagcctccgtccgggcgggttataggctccaccgggtgccggttgcaaggccaccggccccgtgccatgcttcccgcggcgcgtcatgaggataccctcctacggaaccccctcgcaacaggcaggatcgatggccgacgagacggctctagtccggttcgacgacgtcggcatgcggtatgacggcggcgccgaggtgctgcacggcgtcagcttcagcctcgcacccggctcttatcactttctgaccggcccgagcggtgccggcaagtccacacttctgcggctgctctacctggcccagcggccgacggcggggcagatttcgctcttcggccgggatgtccgcgaactcggccgtgccgatcgcgcacgcatgcgtcagcgcatgggcgtggtcttccaggatttccgcctgctgccgcatctgagcgtgttcgacaacgtcgccctgccgttgcgcatcctgaaggcgccggaggccgagatccgccgcgatgtgggggagctgctggcctgggtggggctgggtgagcatgaagcggcctcacccgccacgctgtcgggtggccagcagcagcgcctggcgatcgcccgggcggttgtggtccggccgcggcttctgcttgccgacgagccgaccggcaatctggatgccgagatgggcctgaagctgatgcacctcttcgaagagctgaacaagctgggcacgaccatcgtgatcgccacccatgacacgaccttgcttgcccgctttcgccatccccgcctggtgctgaccgagggacggctgaagaccatgccgcccgccccgccgccgcggggacccgtggttcagcgcacggcgccggtggcgccacgcgccgaagacacgcgcggggaggggcggtcatgatcggtcgtcgtggtgcgggcctgccgctcggccgggatctgtcggcgcgttttctgccctggctgctggcgccgatggcggccctgctggcgctggccctgatcgcgatcggcacggccgaccgggcgatcgatcgttgggccgcggcgctcggcgatcgggcgaccatctggttgccggcatcggaagatcaggatcacgggcccgatgcccggctcgggccattgatcgggctgctggaggccgagccgctggtgcgcgagatccggccggtcccgcgcgaggatgccgaagccctggtctccccctggttggggccggaactggccgaggtggatctgccgctgccgaccctggtcgatctgacgctcgcaccggcccggccgggggagatcgaggccttgtccgatcgcatcgccgagctgatcgagggcgcccggctggaacggccgggcgactgggtggcgcggctggcggcgatcggccgcacggtgcaggcagccgcggcggggctgggcgcgctcttcgggcttgccgccgcgctggcggtgatttttgcggtcaagaccgcgctggccatccatcgcgagaccatcgacatcctccatgtcatgggcgcacccgacgactatgtcgcccggcagttcgccatgcaggggctccgggtcggcttctggggcggcctggccggcagcctggtggcggcggcgctggtctttgccgcgggcgcggttctgcccgaaacctcggcgccgctgctgccgcggctcgatcccgggccggtcggctggggcggcctcattctggtgacgccggccctggcggtggtggcggcattggtcgcccgcatcaccgtcatccggcgcctgagggcgatgccgtgagccgccgtggccgtgggcggcggctgggcggcgcatcggcagggggaccgcgacggcgcccctggcggttgcgcctgctggtctggcgcctgctgctggtggcggtgggggcctgggcagccggtttcgtgatctatgccgaaaccctaccgtccgaaaccccgcccgactggcggcgcaccgatgcaatcgtggtgttgactggcggcgccgaccggctgggggtggggctggatctgctggatgcgggggcggctccgcggctgttcatttcgggtgtcgaccgccgggtcgacctgcctggcctgctgaaagcgtcgggacgtgaggccgcagactatgcggggcgcgtggtgctgggcttttccgccggcgacacggtgggcaatgcccgcgagacctggggctgggcagaggcgcagggcgtgcgctcgatccgcctggtcacggcgtcctatcatctgccgcgggctctgatcgagtttcgccgtgccttgccgggggtggagatcctgccccatccggtcatcccggaacatgtcaagcaggacggctggtggcgctggccgggcacggccgcgctgttcctggccgagtatcagaaattcctggtcgcctgggcgcgggactggctgctccgcaagctgttgccctggccggccggcatggttgacgaggtcggggcatgactgcggtgcgggcgctggtcttcagcctgttcttctatctctggggcacggtgatcatgctggcggccctgcccgtcgcctggagtcggggggcgctctggtggctgcgccgggtgtggatccgggggttcctggcggtgctgaggctgctggtcggcctcagggtcgagatccgcggccgcgcgcatctgccgccggagcccttcatcatcgctgccaagcatcagtcgatgctggagactttcgtgctgggcgcgcttttcgaccggccggccttcgtgctcaagcgggagctgacctctataccggtcttcggctggtatctgaagcgggtgggcatggtgccgatcgaccgggcgcgcggaccgtctgcgctcaggcggatgcacaccgctgcccgggcctgtgcggccgagcgccggcccctgatcatctttcccgaaggcacccgccgtgcgcccggtgcgccgcccgattacaagcgcgggcttgccctggtggcgcgggccactcccgatctgccggtggtgccggtggcgctcaacaccggcctgttctggggcaagggcctgctggacaagcggccgggggtgacggtgatcgagatcctgccgccgctggcccccgggctccagggggatgcgctgctcgatgccgtcgcggcggtcatcgagccggcctcggcccggttggcgcatggatcatccggggagcgctgaggtgatgcgaccatccaccgcagtctgtggataactctgtgtatgatctggggatccgtgcgggcatccgggctgaacagagtctgagagtctttttaactctttgatctgaaaaggagtcagcgccggcatccacatgtcgtccgaaatgtggatgaaatccccggagccgtgttcagtcgatcaggaaatgtgcgatggccgaggcgatcgggcgcgcccggtcttcctgccatgccgtggtgtgaacattgaccacccgacggcccatcttggtgatccggctggtggcataggtatccacggcccggcccgagcgcagatagtcgatggtgatggtgatcgtcttgggcacgcggacctgcgacatctcccaggtgacgtgggagagggctgcggtttccagcagcgagccgatgatcccgccatgcagcgcccgaagcaccgggttgccgatatgctccgggcgatagcccatccggaagaccagttcgtcctcgaccagattggcggtgaggttcaggaaccgggcatagggcaccgcctggttcaggggcgtgaagtcgccggtggcgcgcgaccgctcgatggcatcctgaaggctggtcattcggcgtcctcgcgatgggtcaccttggtgccgatcatgaagctgccggcggcggtggcgatggggccgtcctcgccctcgtgccaggcttcggcggtgacgaaggcaacattgggggtgacgcgggttacccgggcgcgggcgtgcagccatttgttcggcgtggacgggcgcatatagtcgatgcgcaggtcgagcgtcgcgatcggctgcagccggggcagggcggtgaaaaccgcaatgccgcaggcgctgtcgatcagcgtggtgaccacgccgccgtgcagcacgccggtctcggggttgccgatcatgaagctgcgatagggcaggcgcaccaccgccagacccttgtcgatctccagcacttcgagaccgaaatggctgatcagcgggtggtcttcgccgaagatcgccctgagggcgggattgttgcccgtatcgagtgccccttttccggcgggcgttccgtccgtttcggtcatcgtctggcggccgtcctgtgcgtttccatcgccttggttcttctgatcctacacgtgcttacccgaggtgggcccggaaggcaaatttgttgcgcgggtgtactccgccgtcgggacctcgacgccgcgtgccaccgcgtccagaacgtcgcggagcgggccgccatgcaggcccatctcggccatccgctccagcgtctgcgacagatagtcccgggccgttcccatcatgccggtgccggcgcggaccagctccgccatgtgttccagccccagccggccggtatagcgggcgccgttgcgatcggcgacataggtgacggccggtacccggcggccgtcgtcgagccggaccggcagaatccggcgcagatagacccgatcatcctggcccatctcgcggtcgtccagataggcgagcacggttcgggtttcgtcggcccggatacggaaggcgatgccccggcaggcgccgccgcgatccagccccatcaccagaccgggccgctcgggcgtgccgcgatagcgggtggaatagatgcacaatgcgcggtgatagccgtagagcagcgctgcccgggcctctgccggctcgaagcccggccgccacatcagagagccgtagccgaacacccagacgtcgccaccgtccatcgacatcatccgccttcccatgtcatgcccgtccggcagtttcagccgtgcagtctacgccgcgacctgcgggcgcgaaaagctttgtgaccgtctggctgtccatgaccgggccgcagccccgtgaccattgaggggcgatcctcccatatctcgacccctgttcctcgccgcgttatacaggccccagccgtgccgctcgtggtgctgccgtccaacggagaaagccctggcctcatgcgactgaagcgtgtgttcgttctccttgccatcccggtggtcgcccttggggcctggacggtggtctggttccgcatcgccgacgaggtgaaggcgtccgtcgacgcctttgcggccgaccaggcgacatccgggcgcagttttgcgcatggagacgtggccgtgaacggctggccgttccgggtggaggcgaccgtgccgcagccggtgctgacggcggagaacggccgcaataccgtccgggccgaccgggtggtggtctatgtgcagcccttgcagatgcgccatctggtggcggtgatcgagggcccgatcgcctttgccgatgccacggcgcggatcgagctcgaacccgaacacgccgcgtcgagcctggtcttcgacgaggccggccggctggagcgcggggcgctcgacatgacgaagatcaaggggcgcatgatcgaaggcgatgccccgcctgccgccttcaccatggagcggcttcaggtccatgagcgccgcgaggccgagggtggcgcccgtgcggcactggagatggaagggctcgaccccgaggcagaagattatccgatgctgtcgcggctgttcatcgacgtcacccggccgcagccgatcgacgagccggtcgatcgtgcggcgctggaacgctggcgcgatgccgggggcacggtcgacctcacccgcttcgaggcgatcgccggcgaggtgacggtgaccggcgacggcacgttcgcggtcgacaaactgctgaggcccgagggggcggcctccttccgcatcgccggcgccgaggaattgctcgcccggctggaacggtccggccgcatgacgccgcaggtccgcaccatgctggaacagatgctgggcctgttcgaacaggtcgaggagggcggccgcaaggcggtgcgggtgccggtgacgatccaggccggcgtgctgaccgtggccggcctgccgatcgtgcccgttgcaccgctgctgccgcccgagcagccgtcctgacaacgacccggaggtgttctcagggtcggaggcgcgtcaggcctggcgcgcctcgatgatcgcccgccgggcgtcgcgggtgcgggtgaacaaggcttcgagcttgtccgcctcgccccagcggatcgcccgctgcagggcctgaagatcctcggtgaagcggccgagcatttccagcaccgcatcgcggttgttcaggaagacgtcacgccacatcaccgggtcggaccccgccaggcgcgagaaatcgcggaagccacccgcggcatatttgaacacctcccagtggtggtgctcctccaggtccatgaccgtgccgacgatggtgtacgagatcagatgcggcagatgcgaggtgatcgccagaaccgtgtcgtggtgctcgggcgtcatcacgtcgacattgctgcccatcgcccgccagaaccgggtgcagagatcgaccgcaccggcatcggccccttcgatcgagggcggggtcaggatgcaccagcggccgtcgaacagcgtggcgaagccgtgctccgggcctgacttttcggtgccggcaaccggatgggcggggacgaaatggatgccggccgggacatgcggggcgacgtcggcgacgaccgaggtcttggtcgaccccacatctgagaggatggcgccgggccgcatggccggggccgcggctgcggcgatgccgcccatggcacccaccggtgcgcagatcagcaccatgtcggcatcggccaccgcatccgcgatgctggtcgcggcacgatcgatggccgaaagctccaatgccgtcgccagccgtccggcatccggatcataggccaccacctcgcccgcggcgccatactggcgggccgcccgggagacggagctgccgatgaggccgatgccgagaatggcaaggcggccgatgaccggggggttcttgaccatgagacgggttccggaaggcggagggcaggtgtcggcagcgggacgaggcgaccggcgccccgtccgctacggcgatgatcagtcggcgttgcggcccaggatgttcttcagcgaggccagcatgatgtcgaggctgtcggcggcaccgatggtgatgcgcagggcattgggcaggccgtagctcgccatggcgcgcaggatgatgccgtcggccatcagcgcttcgtagacgcgggcggcggtgttcggcccttcggcggggaagtcgaccagcaggaaattgccgtggctgggatggacggtcaggccaagggccgtcagctcgcccgcaagccaggtccgcttggcgaccgtgtagtcgcgcacccgggctacatgttcctggtcacgcacagcggcggcggcggcgatctgcgccggtagcggcacgttgaacgggttgcggatccggttcagcacgtcggcgacgacgggcgagcaataggcccagccgacgcgcagggcggcgaggccgtagatcttcgagaaggtccgggccatcacgacattgtcggcggcgtcgaccagttcggtaccgggcgagtagtcggggtcggtgacgtattcggcataggccgcgtccagcaccagcagggtcgaggccggcaggccggcatgcaggcggcggacctccgggaacggcagcaggctgccggtcgggttgttcgggttggccaggaacacgatccgggtgttcggcgtgaccttggccagaagctggtcgacatcggcgaccagcgcctgttcgggggccgctaccggctgcgcacccacgcccctggcattcagcggatacatcaggaagccgtactggctgtagaggacgtgatcctcgggccccgcataggcgcgggtcagcagggtcagcacttcatccgagccgcagccggtgacgatccgcgcgggatcgagcccgtgcacctcggcaatcgcctcgcgcaggtcgtcggcaccgccttcgggatagcggtgcagcatcgatgcacaggagagataggcctccaccgccttggggctggggcccagatcgttctcgttcgaggcgagcttgatcgaccggacggcgccgtcggccgaattcttgccaccgacatagggcttgatgtccatgatgcccggacggggcgtaagggcggtcatgcggggtctccactcatcgtcaaccgcggcccgtgcaaggccgtgcgcaggaatgtcgcggctgccgggcggatcactgtctctggtcttctggcccgggggcgcgggcactctgccgatgcgggggcggccgccggcttattcggccggcggcgcggggtatcgcagttcctcggccgaaagcggcgtggcatatccgccgatcgggatcacccgcacggccacgtcgttgaagcagccggccaggcggccgagccgctcgtcgccggccccgacgaattcggccacttccagaagatgggtgcgcagattcgccgggccaccggtcacgtggctgtccacccagcgggccttgagccctgcgcggtcgaagccttcgaacagccggtcgcggctgatttcggagccttcgagttcgaccgcgatcagggtgcggtcgtcgccggttgcctcgggctcgagggtggcgatcaccaggccgtccagatcctgagcccggctgttgggcatgcggacgaagggcaggcgggcgatgaccttgggcgtgcccggccgttcgctgaacagaccgcgccaccaatgggcatcgccatcggcaccgccggtccccggaatgggaaggacgcccaccgtggcattgcccgagctgacctctgccagcacgtcggaagcgctgcgccaggcatgcatcggagcgaaggagccgaaatggtcgcgggaaagatcccagtactcgccgtcgccgcgcgtatccagcaccgcgaccgagaacggaccttccagacacagcgacccgatgatcatctcgcgccacagccggagcaggaccggtcgcgggaaacgtccgcgatgctgggcgttcagccggcgtagcatgcgcgcctcgcggccggggcggatgaagctgacctgcccccaggcctcgcgcttgatctcacccacacgctccaccagctccgtccggcgaacgatcaggtcatggagatcgtcgtcgatggtgtcgatctgccggcgcagcgcatcaaggcgttcttcgggcgtcggttccgtgctggacatgggcggcgcgatctccgggaacacgcgaggcgcgtgggtgcggccggcgcggtcgatcgtggacgagggggggcgggcggacgggcatcggacgggaacggtcggcgcggcaggtgcggctgcgtgcagacgccgcgcgccaccgatcgtcgggcgtccgctgcccggcgttcattgatagtcgcgggcacggtcaaaatcaaagaaaacgttgacactggccggggggcggccgctagctgtcttcccaactggtcgtcataatgcgatcaggatgcaacctgagatgatgggaggcgtccatggcccccgatgccgggcgggccccagacgggccggaggatccgccgccggagggtcccggacagaatgaccggtgggcgcccgacggcgtcacccgcatcgcatgtctggccgtggacaaaccgatgccgctcgattgcggccgcagcctggggccgatcgagatcgcctacaccacctttggccggctgaacgcggcgcggtcgaacgccatcctgatctgtcatgccctgaccggtgatcagcatgtgctcggcacccatccggtgaccggcaagcccggctggtgggaaaacctggtcggccccggccgggcgatcgataccaaccgctacttcctgatctgctccaacatcctgggcggctgcatggggtccaccggccctgccggcattgatcccgcgaccggccggatctgggggaccggtttcccggtcgtgaccattgccgacatggtgcgtgcccaggccctgttgatcgaccatctgggcatcgagcggctgttcgcggtggtgggtggttccatgggcggcatgcaggtgctgcaatgggcggcatccctgcccgaccggctgttcgcggcggtgccgatcgccacggcggcccgtcattctgcgcagaacatcgccttccacgaagtggggcgccaggcgatcatggccgatcccgactggcatcacgggcgctatgccgagcatggcagccggccggtcaaggggctggcggtggcgcggatgaccgcacacatcacctatctgtccgaaatggcgctgcacaacaaattcggccggcggttgcaggatcggggtgcgcgttcctatggtttcgatgcggattttcaggtcgaaagctatctgcgccatcagggcagcaccttcgtcgaccggttcgacgcgaacagctatctctacatcacccgcgcgatggactatttcgatctggcggccgatcacggcggggtgctggcccatgcctttcgcggcagccgggtccggttctgcgtgatctcgttctcgtcggactggctgtttccgacggcggagagccgtgccgtggcgcgcgccatcgcggcggttgccggcaatgtcagcttcaccgagatcgagaccgatcgcggccatgatgccttcctgctcgacgagccggtcttcgcccgcatcgtcaaaggcttcctggacggcgtggcggggcatgcggggatcgaccggacatgaccggatccttctccccgccggccgacgaccggatccggccgatgggcccgggcgtcatccgtgatgcgcacggctatccggcgctgcggcccgatctggacctgatcgccggcatggtggagcctcaggcccgggttctcgacatcggctgcggtgacggggtgttgctgcactatctggaccgggtgaagggctgcgacggccgcggcatcgagatcagccagcagggtgtgcaggaatcggtcgctcgtggcctgtcggtgatccagggcgatgcggaccacgatctcgacttcttccccgatgatgccttcgacgtggtcgtgctgagccagaccctgcaggcgacccggcggccggacatggtgatccgcaatctggtgcgcatcggccggcgggcgatcgtctccttccccaatttcggccattggcgctgccggacgcatcttctgatccgcggacggatgccgcggacgcgcggactgccctatgcctggtacgacacgcccaatatccatctctgtacgatcaccgatttcgtccggtcctgcgcccatgccggggtgcggatcgaaatctcgctcgcgctcgacagtcgcggccgggtggtgcgccgcaatgcgccggacggctatgccaatctgatcggcgagatcgggatgttcgtgctgagccgcgaccgggggtgatgccggtggtcaggcggcgggcagggtgacgcgaaccgtggttccgataccttcggtgctgtcgatgtcgagccggccaccctgcaattccatcaggctgcgcgagatgtagaggccaagccccgtgccctggtgcttgtgatcgctttccacccgcacgaaaggctggcccagaccggccagccggccggccgggatgccgatgccctcgtcactgacctccagcccggcatgatcctgatcgggcctgaagatccgcagggtgacccggccgtcgggtcggttgaacttgagggcattgctgacgaggttgagcgcgacctgggtcagcgcccgccggtcgccgcgggcggtgaccggcgtatccggtgccctgatctctaccgctttcgcatccgccccggccatcgcaagggcgtctgcggcaacccctgccaggtccaccggttccgcagccagcgtcatgcgtccggcctcgatcttggacagatcgagaagatcgtcgatcagggtgagcaggtgccgaccgctggtggcgatgatccgggtataatcctgatagcgcggagagccgagggggccgtacatctcggccgacatgatttcggcgaaaccgatgatcgcgttcaacggcgtgcgcagttcgtggctcatgccggccaggaaggtggtcttggtcgcgctggcggcctcggcgcgcgccttggcttcgaaaaccgcatcgtctgcccgccgccgcccgatcgccacggcggcgagtgcagccatatgtgcggccgtccgcagatgctggcgggtgggaccgcggcggtcggagaagtagatcgcgaatgtgccgatcgtccgtctttccggatcacggatcggcgtagaccagcaggctctgagtccagcagtctcggccagatcgcgatagtccacccaaagcgggctctcgcggatatcctcgaccacgacctgtctgccggtataggcggcggtgccgcatgagccagccgaaggtccgatctccaggccgtcgatggcggcgttataggcctgcgggaggtgcggagccgcgccgtgacgcagcttcctgtcatcgtcgaggatgaggaccgaacaggcagatccctcgatcagccgttccatcgccgtgcagatgatggtcagcacccgttcaagcggccatccccgggcaagtgcgcgcaaggctgcccgatcggccgcggcgagcgtgcgccgccaggcagtatcgggtttgaccggaagatctggagagttgcgggtcatgggggcggccgatctgtggtcggacgctcgcaggatcacccagcctgcccgttgtgcgcaacagcaaaggccctgcgatcttcttgccgggcctcggaaaaaggctcggcctccacgcatgcgctcgtccaacatgtggatccaggggagacatggcctcgcccgcaggataaaacagaagagcgcgacgatatgccccttgggaaaatatgcctctcgggggcgtgctccttggggaaggagccctggtagatggggattgtcgtcgccgcaccggaacgagccgcggccaacggcggccgggggacggagttccggcgctttgcgcctgaaccggccccgccggacgatgagaagaacgagggaccttagagggaggaacgtcctgatgaaaccgacgatgctcggaacggctgcggccgccctgctcgggatggtgatgttcggcggtgctgcggttgcggccgatcctgtgacactgaaactgggctacagcctgccggccacgtcgcattacggcgtcggtgcccaggctttcgcggatgcgctggcggaaaagaccgatggccggttcaaggtggagatgttcccctcgaacgcgctgggcggtgagcgcgagatgatcgagggcgctcagttcgggaccatcgacctggtggtgacctcgaccggccccgtgggcaatttcgtgcccgagaccctggtcttcgacatccccttcctgttccgtgactacgcccatgcccgcggcgtgctcgacggcgagatcggtcaggaagtgctggacaagttccccgagcggggcctgatcgcgctggcctgggcggagaacggcttccgccatctgaccaacagcaagcaggcggtgaccgagcccgaggacgtcaaaggcctgaagatccgcaccatgcagaacgacgtgcatatgcgggccttcaccacgctcggcgccctgccgacgccgatggccttccccgaggtgttcacagccctccagcagcacaccatcgacggccaggaaaacccgatcccggtgatcgtgtcgggcaatttcgcccaggtgcagaagtacctgtcgctcaccggtcatgtctattcgccggccctgttcatcatggcgccgtcgcgctgggaggagctgtcggacgaggataaggcggccttcaaggcagcggccaagatcggtgccaatgccatgcgcaagcaggtggaaaccttcgaagccgacggcatcgccaagctcgaagccgccggcatgacggtggtcgagcatcccgacaaggcgcgtttcctggaagagctgaagccggcctatgccgaatacgagaagcggttcgatccggagctgatcaagcgcatccgcgactggaagcagtgatcctctcccgccggacctgacccgtggcggcccggtccgccgcccctcgtatcccggggcggcgaccgggtcgttcacgcctccgatcggtggggccacatgatcattcgtctgattctcgccgcagaccgggtgttgaccggtcttgcggttctcaccgccatgatcgcactcgccctggcggttctcctggggttctggcaggtggtggcgcgtttcgtgctggcccagcccagcccctggaccgaagtcgccatccagctgctcatcgcctggatggtgtttctcggcgccgccggtgccttccggaccggcgccgctgtgtcggtggatctggcgcgccgagcgctcaagggtcgtgcccggcttgtgctggatgtcgtcatcgcggccgcatcgaccggtttcctggtactcgtcgtctggcagggctggatcgtggtccgcagagtccggttccagaatctggcgggtctcgacatcccggtcagctatgcctatgccgctctgccggtcggggcggccttctgcatgattgcggtgctggcgcggctgctcgatcccgaaagccggcgcgaggaaaccgatccctcgctcgaaacgcaggtctgacgccatgaccgcgggtatgctcatcgccatgctggtgctgctcgggctctccgtcccggtcggcatctccgtcggtctggccgccgccgtcggcgtctatgccttcaccaaactgccactgctgatcgtggtgcagcagctgttcattgccgtcgacaagttcccgctcgtcgccgtgcccttcttcatcctggccggcaacgtcatggagcgggcggggatttctcagcgtctggtggacttcgccaaggcgctggtcggcggcctgcgcggcggcctcgccgtcacctgcgtcctgacctgcatgatcttcgccgcgatctcgggctcgtcggtcgccaccaccttcgccatcggtgcgatcctgatccccgcgcttgcccgccatggctatcccaggccgcacgccgcctcgctgcaggcggtctcggccgagctgggggtgatcgtgccgccctcgattccgctgatcctctatggtgtgtcggcggaggtatcgatcggcgagctgttcatcgccgggttcggccccgggcttctgattgcctcggcacttgcggcgaccgtgctgatctggtgccggatcaagggctggggcgcgcgcgacggcgaagaccggctgccgctcttcaccgccggccggcgagcctttgcctcgctgatgctaccggtggtggttttgggcggcatctatggcggtgtcttcacgccgacggaagcctcggtcatcgccgtagtggcggcgctggtgatcggtttcgtttttcaccgcgaactgaagcttcgtgatctgccggtgattttccgcaagtcggtgatctcgtcatcggtgatcatgttcatcatcgcggcggcggggctgttctcgtatctgatcacgcaggcaggcgtgccggcggctctggggcggtatctggccgacaccttctcgggcccctgggccttcctgatcgcggtcaatgtggtgctgttcgtggtcggcatgttcatcgagacctccgcctcgatcatcgtgctcgcaccgatcctggcgccggtcgcgatcgccttcggcatcgatccggtgcatttcggtatcatcatggtggtcaatctggcgatgggcatgttcaccccgccctttggcgtgaacctgttcgcagccagcgccgtggcccgggtgccgttgaaccggatggtgccctatctgctgcccttcatcggggtggtgatgctgtgtcaggcggtcatcacctactggtcgccgctggcgctcacccttcgcgatctcgtctatcgctgagcgtggccgtgcgcgccggggcccaggccccgcgcgcacggctgcggaccgccagccgggccggcgcccgacgccccccgggcggggtggcggcatagacctgcttttgtgcctcgataaccacgacaccgcccaccgccggcagccagcgccggccgaaatgctcgatcggtcccgccagccgcaggaacagtccgcgctcggcaggcggggcgaacagggcggtctcgggggcgccggtcacgaacatggcattgcgcagcagccgggtcagctgtccggtgctgaaggggtggccgtggccgaagggggtgcggtcgacccgcgcccagataccgcgccggttcggcaccaccaccaccagccggcccgaggggcgcagcacccgccagcattcccgcagcagggtctgggcggcgggcgcgaactccagcgcatggaccatcagcagccggtcgatgctctggtcgggatagggcagctctgcctcttcgaccagcgtcaccagattgggcccctcatggggccagacatggccgccctgaggggcgggcatggcggcgatcacccggccggcctcgcccagaaaggggcgcaggaacggcgtggcgtagccgaggcccagcagggtttcggccggtccgattcgcggccagatccggcggacctcgcgacggagcaggcgctgggcgatccggccgccacgcgactggtagaagttcctgagatcgatgatgtcgtgccacatggtggcgcgatcctccggcggcgggttcggacggcgtgccctggcggcatgtccggcagcagcccccaagatggggccgcgaagagcccccggcaaggcgccgcaccgccgcacggcggctgaccggacgtgttatgatgatggaaaatggccggcatgaagccgggccaccccttccggaacctcaaggacgagccagatgatccgcatcgatgtcgaacgcattccctgcctctcggacaattatgtctggatgatcaaggtcgacgacgacgatcagcccaccgcgaccgcgatcgtcgatccggccgaggtcgggccggtggtggcggcgctggagcgtgccgggcggcagccgacccatatcctgaacacccatcaccatggtgatcatgtcggtggcaatctggagctgaaagcgcgctatgggctgaccatcgtcggacctgcggcagatcgggcacgcatccccggcatcgatctcgcgctcgcccaggatgatgcctatgatctggggggcgctgtggcacgggttctggacgtgcccggccatacatcgggccatatcgcgtggtatttcgagcgacacggcgcgctgttctgtggcgacaccctgtttgcgctgggctgcggccgggtgttcgagggcacgatgccccagatgtggcagtcgctgctgaagctgcgcgatctgccggacgacaccaccgtctactgcgcccatgaatacaccctgtccaatgcccggttcgcgcgcggcatcgatccgtccaatcccgctttggcggttcgggcggaggcggtggcacgggcacgggaagaggggcgggccaccgtgccgtcgcgtcttggcgacgaaaaggagaccaaccctttcctgcgggccgacgatccggttcttgcggcggcgatggggcttgccggtcgaccggccgaggatgtcttcgcggcgatccgcagtgccaaggatcgggcttgagcggcgcctgcgcccgggggctgcggccgatcggtggttccacctgatcgggatctgctctaccgttctcgaccgggagaaacgccaggatttcctgcccgacattccgcgtcgggccgggaagatgtggccgatcagagagacctgcggtccatgaagctgtactacacgaacacctcgccctttgcgcgtatcgtgcgccttgcgattctcgaactcggcatcgcggatcggctggagatggcgatcgcagacccctggaccgaagagtcggggctctaccgggtgaaccctctcgagaaggtgcccgcgctcgagttggatgacggtcgggttctggtcgacagcctgacgatcgccgaatatctggaccgtagtttcggcgagaaccggctgctgccgctcgatcccgcgggctgggtgagcgaacgccgtctggcggcgcttgctcatggcgtcatcgaggccggcgtcgcccggctgatcgagcggttgcgccggccggagccctatcgttgggcgggttgggacgcgcggcagaaggcgaagatcgtgcgtacgctcgacctgctggagggcgaggtggcgggctttgccggaacggagcccgggctcggccggatcgcgcttgccgcggcactcggttacatggacttccgctttgcagatgatgcctggcgtgaggggcggccgaagctggcggcatggtatgcggcagtggccgatcgccctgccatgcagcagaccatgccggggtgacggcagggcgcccacgcatctggtccagacttactccggcctactccggccggtcggcaagccatgcttcgagggcatcgcggtctccggccggcaccagcagccagcctgcctcggcatcgacctgggtcagggtcggcgcgaaataacgcttgaggcctgcatgatgacaagcggcctgaaaagccgccgcctgatctgccggtaaccctgcctgcccagcttccatggccgcttcgcgcgcctgttcgtaccagagctgcatctgctcaagcaggaggagcagctcgtcaatgaccgcttccagcagagcgtcgttgcctcgggcattcgtgtgttcgatgacgtcgagctgccgctcgaggtcggcaaaggtgtcgctcagatacgcatggaaccggggcgaggcatcaagaagtgccaggaaggagaagggggcgaacgggggcatttgtggctcgggggctggttgccgacctcgtcactttgccgggttcgtgagcgtggtgcagccccggtgttgcggccgcatgtggccgcaacaccggggcgcatctcagggctccagaagcagttcggcctgaaccgtcagacgcagcgtgcgttcgcccggctcgatggacggagccgccatatccgaggcggccatcgcttccatgcgcatcgccttgaacgggatcggctggggcgttccggggccgcttcccgggctcagcgcccggatcttcacggtgcgggtcccgatttccttgccgatcagatcggcacgggcacggatctgacgaatggcctcaagcgtcagcttgtcactttccgcccgggcgcgttcttccgagacataggtcgacagatcctgcagcaccagaccctgagcctggagcttgcccgcaagctcggcgagcgcggtcatgtcggcgctgtcgagttcgatcgtctggcggccgttccagacgcgggcctggccctcctggtcgatcggatagacgccataaccgccggtttcgaccttcacgggcgccgcgtcacgcgccagattgagggcggcttcgatctttcggttgatatcggcctgaactttcgccgcatcggcgccgcgttcctccgccgccagtgtcgcccgtgcacgatcggcggcgacagtggtggtggcggtctccgacagggtcagcacggtggctgcgtcgggcacatcgcgttcggcgcgggcgggcgagggcgaggcggcggccagggccgccagcagggcaccaagggcgaccgcagcgcgcaggcggcgggtcggcgacagggtggcgagggggctggtcatgggtcggtgtcaccttccgatgatggatcggcagtgcggcaaccggccccgaagcgggggcccgccggccacgagtgggccggcgggcggaaccggtcagccggcgatgtactgggcgccgttgacggtgagggtggcgccggtgatgaagccggcatcctcggcagtgaggaagctcaccgcgcgggcgatctcttcggccttgcccaggcggccgacgggaatggtcccgataatcttctgcagcactgcctcgggaaccgccgcaaccatttctgtgtcaacataaccgggggcgatcacgttcacggtgatgcccttggacgcggcttcctgtgccagcgccttggtgaagccgatcatgccggccttggcggccgaataattggcctggccgatctggcccttctggccgttgatcgagctgatgttgacgatgcggccatagctgcgggcgcgcatgccctcgatcaccaggcggcacatgttgaagatcgaggtcaggtcggtgcggatgacgtcgtcccactgggcctgggtcatcttgtgcagggtggcgtcgcgggtgatgccggcgttgttgaccaccacgtccaccggcccgagatccgcctcgaccttggcgatgccctcggcgcaggcctcgtagctgcccacgtcccacttgtagacggcgatgccggtctccgacgagaacgcctgtgccgcggcgtcgttgccggcataattggcggcgacggtgaacccgtccgccttcagacgctccgaaatcgcacggccgataccacgcgtaccgccggtgacgattgccactcgtgccatcttccctggcctcctggatctaggcttattggactgctctgggtctcgctccccgccggacccgccgcctgagcatgacggtgggcccggcgcccccgggaaacgatgctacgttacgaaggttggtttcgaaataaaatgactttttcgtgaaccagacacttcaaaacgtaaccggctgatctatcagcgctccaccagcatggcgatgccctggccgccgccgatgcacagcgtggcgagaccgcggcgggcgtcgcgcttcttcatctcgaagagcagggtggtgaggatgcgggtgccgctggcgccgatggggtggccgatggcgatggcgccgccattgacgttgagcttcgcgggatcgaagcccagatccttgccgaccgccagcgcctgggcggcgaaggcctcgttggcctcgatcagatccagatcgtcgatggtccagccggccttggccagggccgcgcgcgtggccgggatcgggcccgagcccatgatcgccgggtcgacgcccgcctgcgcccaggcgacgatgcggcccagcggctcgagcccgcggcgctccgcttcctctgccgacatcacgatggtcgccgcggcgccgtcattgatgcccgaggcggagccggcggtgacgctgccggccttgtcgaaggcgggcttcagcttggtcagcatatcgagcgtggtgccgtggcgcggatattcatcggtgtcgatgacgacatcgcccttccggccggcgatggtgacgggcacgatctcgtcggcgaagcgcccggccttctgggccgcctcggccttggtctgcgaggccagggcgaattcgtcctgctcctcacgcgtgatctgccactggcgtgccacgttctcggcggtgttgcccatgtgatagccgttgaaggcgcaccacaggccgtccttgatcatggtgtcgaccagcgacagatcgcccatcttcttgccctggcgcagcggggctgcgtgcggagcattcgacatgctctcctggccgccggcgacgacgatcttcgcctcgcccgacttgatggcctgagcggccagcgccacggtcttcaggcccgaaccgcagacatggttcacgacccaggccggcacttcctgcgggacgcccgcatggagcgaggcctgacgggcggggttctggccggcagcggcggtcagaacctggcccatgatcacttcggacacgtcggcggcatcgacgccggcgcgggcaatggcctcgcggatggcgatggtgcccagctcggcggcggaaagcggcgcgagcgcgccgttgaaggcaccgaccggggtgcgggcggcggcaacgatgacggcgtcggtcatgggagactgtctcctgttctgtcgcgcggggcgcgcaggctgcggggacgggttggtcctctccgtgcccgcagatcgttattcggttcctactataccggcgttttctcgccggaaaagcgtggcgggaggtcgcggtaccctactttcgaggggggctgcgccgtcgtcgccgcgctgccggggccggctcttcgcacagccagtgcgcgagcggttcccagagttctttcgctgaacgactgcccaccatcatgccgatatgtccggctgccggccggatcagccgggcgtcgggcagaacaccggccagggcggctgcggtcgggggaggcacgatccggtcgcgttccggcacggccacgagcaccggcatcggggccagaaccccgggatcgatgatctctcccgccacctcccagcaaccttctgccggtttgttggtgccgtaccagtcgtggaccaccgtgcgggcgaccggccccgccagcggtacgccgtcgttcagccagtcttcgagggctacgaaatcccgggcggcatcgctttccgggtcaagggctgcgaaatcgcggaatttgcgcggcaccatggccgggtcggtggccacgaacaggatctggagcatgtcgaccggcatgctgccggtctgctccaccgtcttcaggatggaccgacccaatacgcggatcaggcggcgctctgcggtatcgccggcggcgaaatcccagggcgtcgccatcagcgccatgcgggcgacgcgctcccgtgccagctgcacgcccgcgatggtcaacagcccacccatgcaataaccaacgaccgggacgggcgcccccgcgagatccgaggcatgggcgatcatcgcacccagccggcgggcgacatagtcctcgatggacaggttgagttcggtgccggtcgggacgccccaatccaccagcagggggcggaagccgcggaccatcagccagcgcatcaggctgcgccggcgggacaggtccatcacatagtggcggttgaccagcgagggcacgaacagggcgatgcggccgtcgcccctgagaccgtcatcgccgggggtgaaaccgagcggatcggcagcaccatagtccagcagacgggtcgcaccctcctgccagatgaccggcgggtcggggagatcgcggacataggggtgatcgcgatagcggttgacgcctgcgagcagagcttccagccggcgtttcgcttcggccgcgacctcggcgccgatgacggcgggatcaagcccctgcagcacctgggtcagatgcgccccccgtgccgccagatgcggagcccagggcagagagccgtcgcgcagcatcggcaaggccgcgactgagctggtcagcaaggcgctggtcatccccagatgatagggcatcggccgtggtcccttgcgggggaacagcgtctccgccggtggcggcaggggctccggtgcgggtgttgtcgtggtttgcattgtccggggcttggtcacccgcttgcgtgaccgtggacgcgctccgggcggtgtttccgcctctgccgcggtctggagcgtcggttccggctggggtcggattgcggctcggctcatcgggagagggggtcctcgacggatcagacgcgctgttgccgcccgaacgggcggcggcgaccgctgcggcatcgatcgccttggcgagattgatgtcggtcaccatcgccgacgcctggcgctcccagaggtcgagaaatgcagcggcggttgccggtatgccagatggggtcgacatggccagagtataccgatccgggggcctgtgcgaaagcgccagaggggtgcgatcatgcgatcgccggtaccccgttcccccgcgctgcggtccctcttgttgcggtgcggatcaaccctgtgatttaatcactcatgctgcgtctcttgtcggttttgccgtgcagcaaggctccggtcgctcacgcgcagggagacccccatggcagatgcggcgacattgcccgacaccgatacgggccgataacgatacaggatccatgaggcgcgggatccgtgtcccgcggacatggcccgatgaatgcgcggggagagaatgaccgagaagtctgaagcgaccgccgggcggaccgaaaaggtaaaggtcaagatcaagaagtacgccaatcggcggctttacaataccgcgaccagcagctacgtcacgctcgatcatctgtcgcagatggtgaaggacgatatcgacttcatcgtcaatgatgcgaagacgggtgaggacatcacccatcaggttctgacccagattatcgtcgaggaagaaggcaaggggcgcaacctgttgccgaccagcttcctgcgtcaactgatctccttttacggcgacagtctgcaggccttcgtgccgcgctatctggaaatgtcgatggagtcgcttgcccggaatcaggagcaggtgcgccggaccttcggcaatctgtttcctttcccctcgatcgaggagatgagcaagcagaacatgcagatgatggaacaggccatgcgcatgttcgcaggtggtctgcgcatgcccgagacgccgcgcaccgacgagaccgaggagcggccagcggccccacctccggcaccggccgccggtgaggatatcaagctgctggccgacaagctcaacgatctgcagaagcagatcgaagccctgactcgcgatcgtgacaagtaagacgcgcggccaggtgagacgctgagggcttcccgaggcctgccgcgtgggcacgtgacgtcacagttctgaatgctaaaaagtaagtcccgatcaggtgaagccgcctgatcgggagatgtcctatattgtgtcagaaaaattggccccgttttctatggggtgaagcacatgggtgcggttctggaccgattacccggtcaatagcggccgagactgatcacggatcggccgagcacgtcgcctttggtgacggcaagacgcatcccgggcaacggcaaaggcgtgcgcagggccaggatctctgcggaataatgattgccggtgccgcctgaacaggggccgagatacgccgtgccgggtgagagtcgcccacgatgaggggcaatcatcgtcactcccttgggcagagccgccgtttcccctggaacggcggggaccacggcccagccggtgtcgccttccgctgcgatcgcgatcatgccatggccgccatcggtcgcgagcggccgatagctgtcgtcattgaaggcgacggcaatcatacgggtgccttccggcaggccggtgacgatcagttcgggggaagcgccggccggaccatagcggctgcaacgggcatggtcgggaatggtgacaccgttccatgcagggtcggcgaagcggacatgcaggccggacgagccggaccagggtgtgcccgatggcgatgtgcccgacggcaatgtgcccgacggcgatatgccggaggctgccagatcactgctccatgacgaactcgccgaaggcgtatggccgacacctgccatcaggctgccggcgaccagcagaccagctgcaaaggcgccgaaggcaatcgccagaatggtaaatgcccatttgttgctgccatcggcccgttcggttccccggggggcctgaaggatgtttccggccacgtccctgacaatcgggccgacgccgatgtcggccacagcgccatgggacgtggcgttttggacgccatcgtcgatctgggccatggattgccccgttcccgtttatgcctggtggcttgtgcctggtggcgggggtcgtgatcggcgccccctgcttctctcgtatcctaccaataagagttattgtttcaaacaaatattgcgttatgcgtgcaattgaaacaactcaaaggggaaggtcagcgatcgctgccacgggccagatccggcggagatgtgtcgtcgtcaaggccgtcatgcggctgtccggcccggccttctccaccagggagccagcgccgcacggctgccaccaggtcgtcacgccggaagggtttcgagagatgatcatccatgcccgctgcgcgacagatttccgcggcttcccggccggcgttcgccgtcagcgccaggatcggggtgcgaccccgcggcccctcgagggaccggatgcgacgagtggcttccagtccgctcaggcccggcatctgtacgtccatcaggatcagatcgtaatcctggctggttgccgcttcgactgcggcattgccctcgctcacgctgtcaaccgtatagccggcccgttgcagagcacgagcggtcagcatctggttcatggcgttgtcctcggcaagcaggatgcggatggcggggtcggcgggtaacgcatccgtgtcggcatgtcggggcatggtctccggtcctggatatcgtcggggcgggatcctggaaggctcgggagccaacaggggatgagcactggccagactgcgcggcgaaggcaggaccgccggaagttcgaaccagaagcggctgccctctccggcaacgctgtcgcaaccgatgcgcccaccaaggagttcggtcaggcgccggacgatcgccagcccgaggccggcgccccgcgccatggcagccgcctgatccgcgccggcctgataatattcctcgaacagcagtcgggtctgctcgggcgggatgccgacgccggtatcgatcacgtcgatccgcaagacgggtgctcctcccgacgacgccgccagcagatcaagagagagcgtgatccggccggtgtcggtgaatttcaccgcattgccggtcaggttcaccaggatctggcgcaaccgccgctgatcccccatcagccgcggagggaccgccggccccgcctccacggtaatctccaatcccttgcgccgggcctgggggtcatacatcgccttcacgtcgcgggcgagggcaacggggtcgaagggtttgggatcgaccgccagttttcctgcctcgatccgcgacagatccaacacgtcgtcgagcaggtcgagcagcagttccgaggcccggcgcatgatttgcgccagaccggcctgttcgggatcgagatcggtgtcttccaggaagtgcagggcgttcaggattgcgttcagcgggttgcggatctcgtgggacaccgtcgccagaaagcgcgaccgcgcctctgcagcgccgatggcccgctcccgcgcatcttccagcgcgtcctgcatgcgacggcgatcggtgacgtcggtgtagatggtcagtgtgccaccatcgtcgaccggcaggcggatcagctccagccggcggccgtcggggcggacatgttccaccggttgcccgagcagcgccggatcgcgcatccgggcgagccaggcttctgccagccgttccggatcgccggggccgaattcgccgcgacgggcgacgaaccggaccagttcggtcatcgggttgccgggtcgggcaatgccgcttgggatttcaagtaactcctgaaagcgacgattgaccaccacgatgtcgagggcgcggtccaccagcatcagcccctgttccatcgcatcgacggtcaggcgcagcacctcggtctggcgggccagttcgcgctcggcggcgcgtctggtcgtgacgtcggtgaaggtcatcaccagcccgccgccgggaaagggcgcgctcgccatctccaagaccgtcccgtcgggccgccggcgttcccagctttgcggccagggccggcgcagcgccgaaagccgccgcgtcacctcggtgaaggctgatccggcgccgaattctccacgccgggccatcaggtgcatcagctgttcgaaatcagccagaggcgggcagtcctcggccatcaggccgttcatctccaggaagcgccgattgtggagcaccacacggaattccgcgtcgagcaggcacagcccctgacgcatgctgtccagcgtggtcgagagcaaacgggaattctcggtggcggcccggtcggcggcgacccgttcgccgacatcgcgcaggctggcgtggaattcggcgggggcacctgtacgcgggtcgcggatcatccgggccccggcctcgacccagacggggcgccccgtcgcgtggcgcatgcgcagggtcgcccgatcgcgaccatgctcgacaagcgcggtcatgtgggcggcaagcacgtcggcatcctcggtcgcgaccaggtcggcgagacgccggccgatcagccggtcgggctccagccccaaaaggggctgcgacgccggagaggcgtagaggatggtaccttccggatcctgacgcaggatcaggtccccggcattctcggccagcagccggtagcgccattcgctgtcgcgcagcgccgcatcgatctggcgtgcttcggtgacgtcttcatagatcgcgaccgagccgccatcggccatgggattgtgggtgatacgaactacccgcccctgggcagaggtttcggtcagcgtggcggtttcgcgcatccgggcaagggtcagccgcttttcgatccgctccggtcgcgttgtctcggccacctcgtaaagcgcctgttccgcaattctggcaagtggtgtacccggccgtgtcagctcttcgggaacccccatcagcccggcatagcgtcgattgcaggcaacgagcaccaggtcccggtcgaagatcgcaatcccatggccaagcgctgcgaaggccccgtccagcagccggccacgatcggccgcttcagccgtgcgggcggcgacttctccttcaagatcacgggtgtggcgatcaagagcggcgcgcatgtgctcgatgccgtctgccagttcgacgatctcccgcgcgccgccgacggcaggtacttcccggatcgtgttgccgccgccaagctccgccaccgccgcatgcagccgggcgatcggcaccacgatgcgccggcggatcaaaagcagcatgacggagagcaccgctgctgccaccgccagcaggatcagatcggctatgcgagcctccgcccaggccgcgcggatatcggcgagtgacaggcctgcggcgacggccagcggccgccccgggacatcggcaagaccataaagacgcgtcacgccgtcatcgggatcgacgatcgcgcggtctggtgcgatgcgcgtcgggtcggtccaggcacggccgaggccggcaggattgcgggggccggtcacgcttccggccgcacgtccggttggggctccaccgtccggtacgctgccgagcttgcggccgtcggtatcgagcagcagcaggcggccgccggggccgacatcgactgaacggtagacctgaataaagtaggcgggatcgaccgcggcggccacgacccccagaagcctgttgtcgatcgtccggatcgcgcgggctgccgggacgtaccatttgccggtcaggactccctcgaccggctgatcgatgatcagcccgtcggcgccggccgcggcccgggcgaaataggtccgatcggtcgctgtcagctccggtgccggccagtcatgggtcacctgcacgatccggccggccggatcgatcagccagagtgcccggatctgcggcgtctcgtcggcgatgtggcgcagccggtcgaaccagagtttgtcctgacgatccggcagccggttctcattgcggatctgatcggcgatgcgggcaacctcgatgtcgacggcatccatggcccgggcggcatgctcggccagaagcagcgccagtccggttgcgcggcggccggcctcggtcttcgcagtctcgtaggatcgccaggccagacctgccgcgaccacggtcagcagcgcgcccagcgccagggcagcgatggtgagcgatcgggcaagggcggcgggtcgatcctggtgcatgaaccccggggcggacgagcgtgcaactggaaaaaacgtcgatctgcgcgcagagggcgcgccacatgcgggatcatcgcgcgccagggcggtttccgtcaaaccgcatcggatgagtcattgggcaccggaaccgacggaagccgtaacgccctgtgcaaacaggggcttgacccgtgcgcgcttcatcacgatatctgacgcgagcacgggtgatcgatgtcgcccgtaccgaggttacggagcacggccatgcagatcccacccaccgccgctttcctgaacgcgcagaccgtggcgccgacccaggtcgcaggctatgccgacccgcgtggcacgcagaccgtcgaggcggtgcctgccgccggcaaggcggaaaacccggccgaccgtcagcccccgccgccccaggccagcgggcgcggcagcgtgctcgacatcaccgtctgaacgtcgtcccgtcgagatgtccttcccaccgccggttccgcaggggccggcggtgtttttgtggcatgcatccctgttttcgtgtgggtgaccatgcccatgcccggtctgcgtgcatcgggcgccgatggatcgccgggtgcgcttgacccgctgcgcaggccatgggcatccttgtgccagcgcgcatacggccggtcagccgccgtgggagatggcggttgtccccgtgtcggccgcacgcgaaaaagacgagggaccgcggcgcggggacgctgccgcgccacaacgacaccagggaagggcgtctttccatgaccatgatcacccgccgccggaccacgcggatcgcggcatcgcttgccgggctcgccattgcgggcctcgccgccggcaccagccttgcggccgaggagaagtccgtggcgatcacccagatcgtcgagcatccggcgctggatgccacccgccagggcgtgcaggatgcgctgaaggcggccggctgggaggtcggcaagaacctgacatgggactatcagaacgcgcagggcaatgtcgcgaccgcggcccagatcgcccgcaaattcgtgggtgagcagccggatgcgatcgtcgccatcgcgacgccgtcggcccaggcggttgcggcggccacccgcgacattccggtcgtgttctcggccgtgaccgatccggtcggtgccaagctggtgagcagcatggagaagccgggcggcaacgtcaccggcgtctcggacctgtcgccgatggacgaacatctgaagctgatcacccggatcacccccaacgtgaagcgtctgggcgtgatctacaatccgggtgaggcgaatgcggtggccctggtcgacctggtggagaagaccgccggccagttcggcatgacggtcgagaaggccgcctcgcccaagtcgagcgacgtgctcaccgccgcccggtcgctggtcggcaaggtcgacgcgatctatgtgccgaccgacaacaccgtggtctcggcgatcgagagcgtggtgaaggtcggccaggatgccgacattccggtctatgccggtgacaccaactcggtcggccgtggcgcgatcgcggcggtcggcttcaactactacgacgtcggcgtccagaccggcgagatggtcgccaagatcctggcgggcgccaagcccggcgacattccggcctcgaccgtctccaagctcgagctttacctgaatccgggttcggccaaggagatgggcgtcaccatccccgaggcggtgatcgccgacgccaaggaagtggtgaagtgatctgacggccggttcgggtcgcaggctgcaggatgccgcccggttcgccgggcggcatttttgctggggcatccgcattgtccctgccggatcggtcttcgcgaaatagtttcattcgttctacacttctgatatggacttgcgatccgcttgcggcacggggggtgatccgctaccactgccccgtcaccctggcggcacgactgccgagccgtcgggggagacggcggccggcggcatcagaggcccgcggcacggccgcaacgggcccttcggacctgtggggatcacacgcggcccgggcttcggagacaggcccggcggacgcggcagacgggaacgcaaccgacatgctgcacgcatgccttccggcgcagggctgcgccgggcgcctcgggggaggggcgcgatgagcctgatcgcctggatgggtgcgatcgagaccggcttcgtctacgccctggtggcgctcggggtctttctctccttccgcatcctggattttccggatctgaccgtcgacggcagctttccgctgggggccgcggtcgccgccactgcgatcgtcggcggctgggatcccttcctgtcgacggcccttgccttcgtcgcgggctgcatcgcgggcagcatcacggcctggctgaatgtccggctcaagatcctgaacctgctcgcctcgattctgatgatgatcgcactctattcgatcaatctccggatcatgggccggcccaatgtggcgctgctgggcgaacggaccgtgctgaccccgttcgagggtctgggtctgccgttttatctgctcacgcccctggttttcgccgtggtggtgatcgcggcgatgatcctgctgatccgttttctgaacagcgagatggggctcgccatgcgggcgaccggcgccaatgcgcgcatggcccgcgcccagggcatcaacaccgccgcgatgacgttgctcggcatggccctgtccaacggcctggtcgccatcggcggcgcgctcttcgcccagtcccagggcagtgccgatgtcaccatgggtgtcggcaccatcgtggtgggcctggcctcggtgatcggcggcgaggcggtgatgtcgacccgcaccatcgcccgggcgatcatcgcctgcctggtcggcgccattctctatcgcgttgcggtggcgctggccttgaatgccggcttcctgggcctgaccgcctcggacctcaatctggtgaccgccgtgctggtcgccgccgccatggtgctgccgcgggtgctggcccagcggcggcgcaaggccgcctgagccgggagggatgatccgatgatcgaagccaagggccttcaggtcaccttcaatccgggcacgccgcttgagacgcgggcgctgcgcgggctcgacctcaccatcggcgagggtgaattcgtctgtgtgatcggctccaacggtgccggcaagtcgaccttcctgaacgcgctgtcgggcgaaatcggggtggatgagggccggatcgtgatcgacggcaccgacgtcacccgctggccggcacggcgtcgcgccgggctgatggcgcgggtgttccaggatccgatggccggcacctgcgagaagctgtcgatcgaagagaacatggcgctcgccttctcccgcggggccaatcgcgggctgggggccgccgtgcgcgccgatcgccgcgaccgctttcgcgcggcgctgaagcggctcgacctcggcctcgacaagcggctgggggatcgcatggggctgctctcgggcggtcagcgtcaggcggtcagtctgctgatggcgacgcttcagccgatgaagatcctgctgctggacgagcacaccgcagcgctggatccgcgcacggcggatttcgtgcttcagctcacccgcgatattgtcgacgaaggccggctgaccacgctgatggtcacccacagcatgaagcaggcgctggatttcggcacacgcacggtaatgctgcacgaagggcgggtggtgttcgacgtgtcgggggaacagcgtcagggtctgcaggtcgaagatctgctggccatgttcaagcgcgtgcgcggcgaggaactggccgacgacgcgctgctgctcggctgatcgccggccgacacgatgaccggtggcggggcttgcccggccccgcccgggctgtcactctgatcggacccgattgcacccgccatccgcccggaggttcccggccttggactattgctcgtcctgcggcggccgcgtcaccctgcgcatcccccagggcgacagccggccgcgccacgtctgcacccaatgcggcatgatccactaccagaacccgaatatggtggtgggggcggtctgtatgtgggaagaccgcatcctgctcgcccggagggcgatcgccccccgtgaaggcttctggacgatcccggccgggttcctcgagaacggcgaaagcacggccgacggcgccctgcgcgaggtgttcgaggaagccggcgcccgcgccgagatcgagcgtctgcttgcggtctatgacatccccgaaatccatcaggtccagatcttctacctggcccggatgacgcgggccgaaatttcggccggcatcgaaagccttgaggtcggcctgttcacctgggacgagatcccctggggcgaactcgccttccccacggtcaaggcgatcctgaaggactggcagcgcctgcaccagggcgatgccgtttcccgccgggacttctggcgtcccagaccgccggaacccgagcggaaacccgagctggtgcccgagacggagtcgccaccggcgcaggcctgacctcgcccgacctccggcgagccaacgccgcttccgacagtgtctgaagcgaacgtcatatcaaatcgggggcggcacgccctcggctctggcaggtgagacaaatcccgcgcatgatccatatcggagaagcgtccggccaagaccggatgccccggatcatccgcagaggaaacgtcccaatgtctctcagcttcaagcggtggctcgccgccggggtggccgcggccgcactggtgccgggcctggcggcagcgcagagcgcgccggtcgccgaatggcagctcgacaccatcattcagccctcgccgttccgcggtgtgcacggtctggcggtcgcccccgacggcgaagtgctcggcggcagcgtggtcggccagcagatcatcggcgtcgacccggtcagcggcaaggcccgggtgatcgtcgaccggcccgccggccaggccgacgatctggtgatcgcgcccgacggccgcatcgtctggacggctttcctgtccggcgaggtccgggccatctcgggcgatgcgcttcagggcaaggcggcaccggtgcaggtgctggcgacgggccttcccggcatcaactcactcgacttcgatgacggcggccggctctacgcgacccgggtgttcctgggcgatgcgctatacgagatcgacccgaccggggcgacgccggcaaagcagctcctggaaggcatgggcgggctcaacggcttcgagatccgcggtcgcacgctcaccggaccgctctggttcaagggcaagcttgcccgggtgaacctggacgatccgaaagtcgaggcctttgccgaaggcttcaaggtgccggctgcggccaatctggaagccgatggcaaggtggtggcactcgataccgtcacgggcgaggtcaagcgcgtcgacccgatgacgggcgcggccaccgtgatcacaaagctcaatccggcgctcgataacctcgccatcggcgaggacggcacgatctatgtctcgaacatggcggagggggcgatcttccagatcgacccgaagaccggcgggacgcatacgatcatcaagggcgatctggcggtgccgggcggtctggtggccgttcccaaggccggcggcggctcgacactgcacctggccgatctcttcgcctatcgcaccatcgacggggcgacaggcaaggtgaccgacgtcgcgcgtgcctatgcgagcaatctcgaaaacccgatgaatgccaattacgacggcggccggatcctgctgaccagctggtttgcgggcggggtgcagatgttcgatcccgcgaccggtgccgagcttggccatgtcaacaagctggccgcgcccatggatgcgctgatggcggatgacggccatctgctggtcctgaccgccggcggaaccatccacaaggcagcgctggacggcagtgcggccccggctgatcagaagccggtggtggagcatctggtcatgccgacccgcatgatctggtcggggcccgatcacagatcggtctatgtggccgaaaccggtgccggccggattgtcgaagtgccggtcgacggtcaggcgcttcgggtcgtcgtgggcgatctgaaggcccccgagggccttgcccgcctgcccgatggccgactggtgaccgtggaaaccggcacggggcaggtgctggccttcgatcctgaaacggcgaagggcgaactgatttcgaccggcctcaagggccgggtcgggctggaagggaccgccggcatgccgccggcctatatcccgaccgggatcgcggtggatgatgccggccgcatctgggtggcgggcgaccgcgacggcagcctgatgcgcctcagcccgcgctgagcggcaagaaactcacccctggccgccggtgtcgccaccggtggccagggtgtgacgctggatcagcggcacctgcgagatgctgaacagcagcgtcagcggcatgatgccgaacagcttgaagccgacccagaaatcggtggagaaattccgccagaccacctcgttgatcaccgccagcagcaggaagaacaggccccagttgcgggtgatcttcagccagccctgatggtccagaaggaaggcccaaccgaccagcggcttgagcagcggccgcccgagcgccagaccgcccagcaggatgacaccgaacagcgtgttgaccacggtcggcttgatcttgatgaacagctcgtcgtcgaagatcagcgccagcccgccgaagcccagcacgaacacgcccgagaccagcggcaggatcggcacccgccgctcgcgcacccacgagacggtgagcgcaatggcggtagcagccatccagccggcggtgccggtcatcaggccgaatttcgcattcagcacgaagaacaccaccagcggcccggcttcgagcgccagacgcatcaagccggtgccggcatcggccgggcgttgctccgtggggcgggcttcgatgccctcgttcggcttgtcggtcatcgggtcaggtctccagtccgacgagggcgcgggcgaaggcccgggcctcgaagggcttcaggtcatcaatgccttctccgacgcccaccgcatggaccggcaggccgaagcggtctgccagcgccaccagcacgccgcccttggcggttccgtccagcttggtcagcaccaggccggtcaggggcaccatcgacttgaaggtttccacctgattgatcgcgttctggccggtggtcgcatccagcgccagcacgatctcgtgcggtgcctcggggtcgaccttgccgatcacgcggacgatcttctgcaactcggccatcagcccggccttattgtgcagccggccggcggtgtcgatgaacaccagatccatgccgtctcggcggccgcgctctaccgcgtcgaaggcgaggcccgccgcatcggcgccggtttcacgcttcagcaccggcacgccggcgcgctgaccccagacttccagctgttccacggcagccgcacggaaggtgtcgccggcggcaagcagcaccctgcggcgctgggcgacggcggcggacgagagcttgccgagcgtggtggtcttgcccgtgccgttgacgcccaccatgaccacgacccgcgggcccgaggcggccggggcgaagttcagcggctgcgccaccggctccaggatcttggcgatctcgtccgccagcagagccttgatctcgtccagccccagatcctgaccatagcggcccttggcaaggccggcggtgaccttcgccgccgtcgccgggcccagatctgcctggatcagcagctcttccagctcttccagcgtctcggcgtcgagcttgcgcttggtgaagatgccgaccagaccgtcgccgatgcggctgctggtcttcttcagcccggcccgaaggcgggacagccagccgcctttgctcgtctgctcctcgctcaagcggtcgccctccctgcggcgtcgatacgggggtggtcatgggtgcggctgtggtcggccgcatgatgcggcaggatcacgcccgccagggtttcgtcgtcggctgcggtgatccgggcggtcacgatccccccgaccaacgccggatcgaccggtgtcgccagacgcacgagggcgaaaccttcgctgcggccggtatccggggtctcgagcaggaccggcagctcggcgccgatctgggtcttgagccagccgcgaagcccggcagcgccggcctcacgcagggcccgcgcccgttcgcggcgcacggctaccggcacctggggcatgcgcgcggccggggtgccggtgcgggcggaataggggaagacgtgcagatgcaccagccccatctcctccaccagcttcaggctgttggcgaacatctcgtcggtttcggtcgggaagccggcgatcaggtcggcgccgaagacgacatcgggacggatgcggcgcacggcctcggcgaaggcgatcgcctgggcccggttgtgccggcgcttcatccgcttcagaaccatgtcgtcgccggcctggagcgagagatgcagatgcggcatcagccgtggctcttccgccagcgcctgcatcagatcggggtcgatctcggcggaatcgatcgaggacagccggagcctgggcagatcgggcaccagcttcagcacccggcgcaccagattgcccaggcttgggcgaccgggcagatcggcgccgtaagaggtgatgtccacgccggtcagcacgacctcggcatagccgcgggccgccagttcgcgcacctgggccaccacctcgcccaggggcaccgagcggctgttgccgcgaccatagggaatgatgcagaaggtgcagcggtggtcgcagccgttctgaacctgtacgaaggcccgggcacggccgtccagcccctcgaccagatggccggcggtttcacgcaccgccatgatgtcgtcgacgaagatccgggcgggttcggtcgcgcccacgaaatccggacccgccgccgcgaccggagccgacggggcgaggcgattgggtgtggtggcgagggcggcggcgaagcggtcggccttcagcttgtcctcgttgccgaggacggcgtcgacttccggcatatccgcccaggcttcgggccggatctgggccgcgcagccggtgacgacgatgcgggcctcgggatcctcgcgccgtgcccggcggatggcctggcgggcctgacgctccgcctctgccgtgaccgcgcaggtgttgaacacgatcgtccgcccgtccgacgccccgtcacgggcatggccgcgcatcacctcgctctcataggcattgaggcgacagccgaaggtgatgatccgcagaggatcgtcagtctggtcggacatgagggcggaaaaccggatgaggaagcgaaggtcaggcgagcagggacgggtggagcgtcccctcgaaactggtcgcgaccgggcccgacatcaagacgcgatcgtcttcggtccaggtgatgaccagcgggccgccgtcgagcacgatctcgaccgtgcgacccgtgaggccgcggcggatggccgcgacggccgtggcgcaggcgccggtgccgcaggcggcggtgatgccggcgccgcgctcccagacccgcatgcgcagcctgtcggggcccagaagatgggcgacttcgacatttgtgcgctcagggaaggtgggatgacgctcgatcatcggcccccagcgggtgagatcgatcgcctcggcatcgtcgacgaaaaagaccgcatgcgggttgccgacattgaccgccaccggcagcttcaacggcccgacttccacgccctccacggccaacgtgtcggcgggggccgccagcggaatctgccgccagtcgagccgggcggggcccatgtcgacggtgaccgtgccagcttcgtgctgctctgcatcgcggcttgcccggagcaggcccgagatcgtggcgatggtcgcgcggccgagcccgctttcgtccatcagcagggccccgacacagcgggtggcgttgccgcaggcaccgacctcgccaccatcggcattgtggatgcgcatcaccgcatcggcaccgccggcggcgatcgggtcgtcgtcggtcggatcgatcagaatgaactggtcacagccgacgccgagccgccggtccgagatccggcggatggtcgcgtcatcgagcacgaggccccgggccgggccgctccgtcggtcgatgatgacgaagtcgttgccgagcccgtgcatcttgaggaacgggatcctgatcatagctccgatcttataggcttcggcccggctgccgtccaatcaattcgcggccgtcacggcagggttgcaggcggcgatcaggccggaatttcagtctgttgactggtcagaggcggggctgccgccggtgcctgcaccggcaagaggcaggtgatccgcgcgccgccccccggggcatcgtcgatccggatccggccgccatgcagctcgatcaggctgcgggcaagcggcagaccgagacccaccccggccttgcgttcgccgcggcgacggcgccagaagcgctcgaagacctgttcgcgctcttcctcggggatgccggggccctggtcggaaatgatcaacgccaccatcgacgggccgccttccggatccgcggggcgggcttcggctgccatgcggatccgggtgtcgacgggggtgaatcgcagcgcattgccgagcaggttgtagagagcctgacgcaggcgcaggccgtcggcatcgatcgtgccgcactcaggcgggcagtccagatcgatcgacaccgaggcggccttggcacgctggcgggcgagatccgctaccgaccgcaaaagctggcagacatcgaccggacgacgattaagggtgacgtcaccggcatcgatcgaggcaaggtcgatcatgtcgttgatcagcaccagcagatgttccgaggcatgcacgatgtcttcggcatagccgcgctggcgcaggttcagcggccctgccatttcgctggcaagaagctgggcgaagccgatcaccgaattcaacggtgtgcgcagttcgtaggagacatgagcgacgaattcggatttgaggcgatcggcttcggcaagtgccgcggcccggtcacggagggcgcgctgcacccggatggtgtcggtgacatcggcaagcgacaccagtgcggccccgtccgggagcggggtggcggcaatggagaagaaacgatcgccggcgagttcgagcgtcatctcgccgcggcggcgttcgaccagagcctcgtccaccacctgccggacgagatccagatcgtcggcacgggtggcgagggggcgcgcggcatccagcagctggccgagcggcgtctcgatcgagacctgatcgggccgtacttccagcaatcgggcgaaggtctggttggcgaggccgagccggccatcggaccggaacacggccagcccttcggccagggcatcgatggtcgcgcgctgcacggcgatcagggtgttgtaggaccgctccagcgccagccggtcgctgacatcctcgtagatgtggaccagcccgccctggcggtggggcgcgatgatgacatggagcgtgcggccgtcgggcagatggaccagttcttccatcggcgcaaacaggctggtgtagagggccagccggtcgcgtttccaggccggaaaattcacgacttccggcaggcgccggctttctcgcagacgttcaagcagttcgccctcacgtgggcgctggtccagaaaggcggcattcagatgccacagccgggcaaaagccccgttccagaaggtcaggcgcatatcggcgccgaagaccgcaatgccgctggtgacgctttcgaaggcttcgatatagccggcttccacccgctccatcgccgcttccgcttcggcgagcgccgtggcgtcgagagcgaggcccacggcaggtcggtcggttccgggcggaatctccaggatctcgtatacccggcgcacgccgtcggtgaccacggcgcggcgttcgcgcatcggcagaccgcgatcgcgggcggtgcgggccagggcgcgggcttgggcgatcagggcacggttggcgaattccggtcgttcatgcccgtcatcgcccagttggaaggcatcgaaagcggcgttgtggccgccgatcgcgccgctgatgtcgcgccaccagaccggcagaggcagcgcgtcgagcagggccgtggcggcatctgcccgtgccgaggcggtttcggcggcgacggcagcagcttcatgggcgcggcgttcggcggcaagctcacgctcggacgattgcaggcgatcggcaacggctcgcccacgcgcacgcagcctgattgcgtacacggcgaggccggccgaaagggccgtcatgactgcggcgacgacgatcggatccatgacctgagtttagcagtcatggccggggccgcaatcacgacaccgcagggatcgtgtcattggccgtgaacgcaacgccgccgccgggcggacccggcggcggcgcaacggtggtgcgatcccacgagatgggcggtactcagtagcggtagtattccggcttgaacgggccttccgccggcacgccgatatactgggcctgcttgtcgctgagcctggtcagcttcacgcccagcttgtcgagatgcagcgccgccaccttctcgtccagatgcttgggcagggtgtagaccttgcgctcataggcctgggcgttgttccagagttcgatctgggccaggacctgattggtgaacgacgcgctcatcacgaagctcggatggccggtggcgcagccaaggttcacaaggcggcccttggcaagcaggatcaggcgcttgccgccgggcagcgtgatctcgtcgacctgcggcttgatctcgttccactcgtaattgtgcagggccgagacctgaatttcgctgtcgaagtggccgatattgcagacgatcgcccggtccttcatctcacgcatatggtcgagcgtgatgatgtcgacattgccggtggcggtgacgaagatgtcgccctgcggcgccgcctcatccatggtcgtgacctgatagccgtccatggcggcctgcagggcgcagatcgggtcgatctcggtgaccagcacccgggcgccctggccgcgcagtgcctcggccgagcccttgccgacatcgccatagcccgccaccacggcgaccttgccggccagcatcacgtcggtcgcgcgcttgatgccgtcgatcaggctttcgcggcagccatagaggttgtcgaacttcgacttggtgacgctgtcgttcacattgatcgccgggcaggccagcttgccggtcttggccatctcgtagaggcgcagcacgccggtggtggtctcttccgagatgccgcggacctcgttcatcagctccggatacttctggtgcatgatgagggtcaggtcgccgccgtcgtccaggatcatgttcggggtccagccatcgggccccttgatggtctgctcgacgcaccactcgtattcctcttcggtctcacccttccaggcgaagaccgggatgccggcggcggcgatgccggctgccgcctgatcctgggtcgaaaagatgttgcacgacgaccagcggacctcggcgcccagcgcgatcagggtttcgatcagcacggcggtctgaatggtcatgtgcaggcagccggcgatccgcgcacccgccagcggcttcgacgcgccatattcatcgcgcagcgccatcagccccggcatttcggtctcggccagcgagatctccttgcggccccactcggcgagggcgatgtccttgaccttgtagtccgtgaacgtggtcatcgagggcgctcctgatgggcatagcggctttgccgggaaaccggcagacgtctctcccactggttatagccctggctgccctgatcgggcaagggaatataaagctatctttatatggtaatatgccgccgcatgccgggccgggccatgaaaaaacccgccggaacggcgggtcggcagggccggatgcgcggaagaccggctattcatcctcgtcgaagcggttgccgatcagcgtcaccagggcatccatggcctggggggcgtcggcgcctgcggcctcgatatcgatggtgcagcccgggcttgcggccagcatcatcagccccatgatcgaccggccggacacggtctggccgcagcgggtgacctcgatgtcggccgagaagctgtcggccgtcttgacgaatttcgctgccgcgcgtgcatgcaggccgcggcgattgatgatctcgacggtgcgcttcaggcgatcgccggagggcgcggcggactggttcatcgggcgggggctccctcggatcagcggccgtcgccggcgagcagggtgctcgcgacgttgatgtatttgcgcccggcatcctgggcgctggccacggccttggcgagcggctcggtctcgcgcacgctggcgagcttgatcagcatcggcaggttcacgccggcgatcacctcgacatgagcccgatccaggattgagatcgcgaggttggacggagtgccaccgaacatgtctgtcagaacgatcacgccatcgccgccgtcgacggcggccaccgcgtcgatgatgtcctggcggcgcttttccatgtcgtcgtcggggccgatgcagatcgccttcatggccttctgagggccgacgacatgttcggttgctgccacgaattcgtcggcgagccggccgtgcgtcaccagtaccagaccgatcatcggttccgtcgtcaccttgttgtggaggcaccggcaccgcccgccatcgtggccgcgcgccggggcccctcagttcaggggcagccacctgccggcgaaggcgcgcagtgccgcctcagaccggtttcgcagccggggatcccgttcgcgccagatccgcgtcgggcatgtcgcgatggcgtactgtaacccgccacccgtcctgcctcaattcctctgcgagacgttcggtgacgaagacagagcggtgtttgccaccggtgcagcccaccgccaccgtcagataggattttccctcgcgggcataggccggcagcagcaggcggatgaggtccagcatccggtcgaagaagggggtgaacagcggatcggccgcgacatgggcgcctaccgccggatcctgaccggtgagcggccggagcagcggatcgtaatgcggattggccaggaagcgcacgtcgaagaccagatcggcatcgcgcggcaggccgttgcggaaaccgaaggaggtgaccgagagctgcagccccggagagccgccgaaggcgaacagctcggacgccttgcgcctgaggtcggtcaggctgaactcgctggtgtcgagcaccacatcggcgcggtcgcgcaagggggcgatcagcgcccgctcgtcgcggatgccgtcttcgaccgggcgatcggttgcgctggcgagcggatgccggcgcctggtctcggtgtagcggcggtagagcacctcgtcgtcgcagtccagaaagacgaccgtggcggcaagcccgggcagagcggcgacctggctcagcgcctgatcgaccgcggcggcatcgaagccgcgggtacgcacgtccacgcccaccgccagcgcctcgcctggcgccatggcttcgaccgcaggcgccatcagccggacgggcatattgtcgatcgtctcgtagcccagatcctccagtgccttcagcagcgaggtccggccggcgccggacaggcctgtgatcaccagcaggcgggcagggccgttcgcatcgggtcgggctgcagcggaccgggggatcggtgtcatgtatgcctctgaagcggatcgagcacggcagccagggcggcgcgcaacttggccggcgccgaggcctccaccgccaccagatcgatcaccgggacggcggcgccggcaagcatgacggcatggggcatgggcaggcgctcaatcctgtgccccggcggatggagccggaccgccagacgcaccgggacgggtgccgacatatcgctgcgcaggatgccgaccccgcgtacctcgatcaagccgcaaagcgccgcaggggcagaggcgacaggccatggtgcatccggtgttcctgccgcctgcagcaccacgcggtcgtcggcgaccagccgggcgccggcatcgatcagtcgcagggccagatcggatttgcccacgccgctcggcccggtcagcaggacgccggccgggccgatgcagatgcaggtggcgtgaatggtctgcgggtccgtcgccatggcaaggttgcgcccctcggtccggtcgcgcgcgcggcccgtgttcaggcggcgttcaggcggccttgctcgatgcgtcgtcggtgagcagtgcgtagagcgcttcggccgtgtcggagccgcgaagcttgtcgcagacccgttcatcccgcagcagccgcgacacccgcgccagtgccttcagatggtccgccccggcagattccggggccagcagcaggaagatcagatcgaccggctggtcgtccacggcgtcgaaatcgatcgggcgctccaggcgggcgaacaggccctggacccggtccaacccgcccagccggccatggggaatggcgacgccgttgccgacgccggtggtccccaggcgctcgcgctcgagcagcgtctcgaagatggtgcgttcgtcgatgcctgtcagatcggccgcccgttgcgacagatcctgaagaacctgcttcttgctgctggacttcagggatgcaaagaccccctccgggcgcagcagatccgcgatctccatgacgatcgaaacctcttgtgggaaagccggggcgcccgtgcggccccggcttacacgtcggatggcccctccgggaccgggagcggcgatccggtggtcgccgggccggatgccgcgaccggcccggtaccgacgttccggcgtctccgccgttcgacgtcgaccctcaggccggctggcgcggatcgacccagccgatattcccgtcctcgcgacggtagaccagattgagcccgccatgtgccttgttgcggaacagcagcgcagcctgatctgccaggtccatgcgcatcaccgcctctcccacggtcagggacaggatggcggtgtcggtttccgcaatcaccaccgggtggccgtcggccacgtcctcacgctcgaccgtctcgtcctcctcggcggcgagaacgtaggcgcgggccgggatggatgcaaatgaattctgtgcagcatcggcccgcgcgtcagtgcggtgatgatcccgcaggcgccgcttgtagcgccgaagctgcttttctgcgcgggagagcgcctgatcgaaggcgacatagatctcgtcggaggcgccgctggccttcatcatgacgccgcggcgggcgtggaccgaaatatcgcagcggaacagatgagcatcgcggccaaaggcgacatgggcgtcgatggcgtcgtcgaaatacttgctgacgccgcggtccagttcctcggagacgtggtcgcgcagggcgtcgccgacgtcgatctgcttgcccgtaacggtaagctgcatgttccctcgcctgtcgcttgtccgcatccggcgtctgcgatgggggcagagcgtgacagactgccacgcgccctgcaccggcgcattgccgggggcggatcgttgacggggccgtcgggccggccggcctcccttccggcaggtccgcagtggggtccgattccagtatcagcgcctggccatcttggcccggcggcgctggaccgaggatccgatccccatcccctcccgatactttgcgacagttcggcgcgcgatgtcgatgccatccgcagccagcagctcgaccagcttgtcgtcggacagaatcgcatcggcgctctcgccgtcgatcagttccttgatccgatgcctcaccgcctcggccgagaccgatccggagccgtcggcggtggcgatcgcggcggtgaagaagaacttgagttcgaacaggccccggggcgtggccatgtacttgttggcagtgacccggctgaccgtgctttcatgcatgccgatcgcatcggcgatgtcgcgcagggtcagcggccgcagatggcggatgccatgggcgaagaagccgtcctgctggcgtaccagctcgctgcccaccttcaggatcgtgcgggcgcgctggtccagcgccttcaccagccagcttgcggtctgcatccgctcggaaatgtattcgcgctccgccttggacttcgcctgggccgtgatggtggttgcataggcatgatccaccagaacccggggcagggtctcggggttgagctcgatctgccagccaccatcggggcgggggcggagcaggatgtcgggcaccacggtctgcagcgggtccgcgctgaagcgcaggccggggcgcggatccagggcgcgcagctcgcggatcatgtcgtcgaggtcttcatcgtcgaccccggtcacccgcttcagccgggtccggtcgccctgggccagcaggtccagattggcgagcaatgcctgcatggccggatccaggcgatcacgctcagccagctgcaggccaagacattcggccagatcccgggcgaagacgccggtcgggtccagccccttcagcctggtcagcaccgcctcgacgcgtgtggtgtcgatcccgatcagctgggccgcctcgaccggggtcatggtcagatagccgttctcgtccagcaggccggcgagcacggtcgcgatcgcccgctccatcccctccgggatctcgaccgcgatctgttcctcaagatggcgggcaagggtggtggcctcgctggtgcgggcttcgaagccctcgtcgtcgccatcgaaattcatgtcgccgccgcggccgaccggcccgccggcatcgaagccgaggcccggatccaggtccatctcgcgctgtgcaggggtttcctgggatggtgccgggccgtcgctctcgaacatgccggcgatatcggtgtcgaggggggcgtgctctgaatccggcatgacgccgctgccgaccagttcggtcagctcggtgcgggctcccggttcgaaagcggggtcctggccccgcggatcgtcgccggcgtcgccggtcgcgagggccgtcagcggttcgtcgcgctcttcggcacggaccagcaacgggttctgcagcagctcttcgtccacgaaggcgccgagttcgatattgttcagctgcagcagcttgatggcctgctgcagctggggcgtcatgaccagcgcctgggagagcttgatgtccagtctctggctgagcgccatgcgcgggctcctagaggctgaaccggtcgccgagatagacgcggcgcacgtcgtcgttggcgacgatgtcttcgggggcgccctccatcagcacggtgccgtcgtgcaggatgtaggcgcgatcgatgatgtcgagcgtttcacggacattgtggtcggtgatcagtacgccgatgccgcgatgcttcagatgcgagaccagatcgcggatatcggccaccgcgatcggatcgatgcccgccagcggctcgtcgagcagcacgaaagccgggctggtcgccagcgcgcgcgcaatctccacccgccgccgctcaccgcccgagagtgcaatggcgggcgtgcggcgcagatggctgatcgagaactcggccagcagttcgtccagcatggtctcgcgcttgtcgcgcacgggctcggccacttccagggtcgcgcggatgttgtcttccaccgtcagcccgcggaaaatcgaggcttcctgcggcagatagccgatgcccaggcgcgcacgccggtacatcggcagggtggtcacgtcgtcgccgtcgagcaggatccggccgtaatcggccgagatcagcccggtgatgatgtagaagcaggtagtcttgccggcaccgttcgggccaagcagccccaccgcttccccgcgggcgacgttgagcgacacgtcgcgcagcacggggcgcttgcggtagtgcttgcccagcgactgggcgaccagccccgccggcacatcgccgcccgcatccgcgcgctcgggcgcgtcggcggcaagcctgccgggtatgtcctgatggccagaggtcaagggctcggtgttcctcgtcgatgatgcggccctgtcggcgggccgccgcgtcacgtcttgtcggtcatcacttcttttcaggcacgaacaggccgcgcaccgggcccttgcgaccgctttccagcgtgctgcggcccttgttcaggtcgagcaccagccgctcgccttcaagctggctgcggccctgggtgagctttaccgcgccggtcagcgtgatcatgcccttgttgacatcatagacgccgacatcgccgcgggcgctctcattcggggtgatgatctgcacatggccgtcggcctcgatcttcgagatctcgccggcggcatcggcaagaccgccgccctgctgcccttcaccctgctgcccctcactctggcccgcctccggcggggcctgcttcgcacccttcgcgccgggctgggcgacatggaccttcagtgtgtcggcataaagggtcatggtgccctgaaccgccttcacctcgccgcgaaacgtcgccacccgctcgacatccgcccattcgagcgagtcctgggcggtgatttcgatcggctgcgaggtgtcgatgctggaggtgcggatggcgctctgcgccgcagccggcacgggggcgagcaccgggatcacggcggccgccgatccaagggccgtcaccagcagggcgagggccgcaccgtgacggcggcccgtggaaaggctgaagggcatgcgcgctcctgacgtcatctctcaacacccggatagcccgtcacgcggacagggccatcgaaggtgatggtgtcattttcccgccgggcggtgaagccggcggcgtcgatgcttcccaccgggccatgcgccaccaccgggctgtcgctccggatggttccgctgcccagctcggcgtccacccgttgggtcgacatggcgtagcctgtctcggcgatcacctcgacatcgccctcgagcttcagccgttcggcatcacgatcgaaggcgcccgtcttggcccggatggcgagccaggttccgtccgaggcggtcatgtcggcgcggatggtcttgagcgtgatctgcgaactgtcgaccgacggctgggtcgcctcgtcggcttccacccggaatggccggccgtccgcatccacacccgtaaatctgggttccagcatccggagcgcatccacatcgtcccggacgatcttcgaatatcctatacgggcatcgccgccgatgcccgacaattgcgaccacacgagcaccagcacgatcagcccggcgccgaccgcgggcagcaggatccgcgccagccgtacgaaccggctgtagcggctgcgccggcgcggggcccgggggcccgtcggcaaggggggcattctgggcgtctcggccatggtcggctcgtcttgctccgggcgggacaggctggggagaggagggcgagataagggctggggcgccgttcggtccataccgaccttcaggccacgccggccctcaggcagtcgtggacgtggaggatacccacgggccggccgtcgtcatccaccgcaaacagggcggtgatcttgtaggcattcatgatcgccagcgcctcggcggccagggcgcgggcgcggatggtcttgggcgcggccgtcatcacctccgacaccttgcgggcggcgagatcggggcccatgtggcggcgcaggtcgccgtcggtcacgatgccggcaagccggccggcatcatccgtcacgccgacgcagccgaagcttctggcgctgatttcgatcagcgcctcggccatcgggcggtccggggtgatcagcggcaggtcctgggggccgtgcatgatgtcggccaccttcaccagccgcgcacccagcttgccgcccgggtggaagacgcggaaatcctcggcggtgaagccgcgccggtcgagcagcgccatcgcgatcgcatcccccagcgccagcgtcatggtggtggaggtggtgggggcaagctgcagcgggcaggcctccggtgccggcggcaggatcagcgccacatcggcggcctcggccagcgggctggcgctgcgggcggtgatgcccaccagcgggatgccgaagcgccggctatgggccagaatatccgacagctccggcgtcgccccggaattggacagggccagaatggcatcctggcgggtgatcatgccgaggtcgccatggctcgcctcggccgggtgcacgaactgggcgggtgtgccggtggaggcgagcgtggcggcgatcttggcgccgacatggccgctcttgcccatgccggtgacgatcacccggcctttcgtggcgtaaagcaggttcaccgcgcgcgcgaaatcgggccccagcccggcgcgcagggcttcgagcccggcgatctcgagcgcgagcgcctgttcggccgcggcaagggcgcggccgtcatcggcggcggtgtggggggcggtctcggcggtcatcggcacggtgtcccgtggtcgtgtgcggggggcatgtgcggcagagggcggcacatgcggatcaatatggttggcccgcctgccgcgtgaaagggcagtcgcggccgcatgttccgccgggcggaatgagcggcgggcctggccggtcaatgggcgaagatgtcgggctcttcccagcccagcagatccagccgggcgcgggccggcaggaaatcgaagcaggcgcgggccagatcggtgcggccctcgcgcgcgagcatttcgtcgagcacgcgcttcaccgcgtgcagatgcagcacatcgccggcggcatagctctgctgttcgggggtcagctgatccgcgccccagtcggacgattgctgctgcttggagatctcgacgccgatcgtctcgcgcagcaggtcgcgcaggccgtgccggtcggtataggtccggatcagcttggatgcgatcttggtgcagtagaccggccggcagtcgatgccgagccgttcatgcagcaccgccagatcgaaccgggcgaagtggaagatcttgagaacgtccggatcttccagcagggcggccagccgcggcgccgtggtctggccgcgggcgatgcgcaccagatgggcgtcgccgtcgccggttgaaatctgcaccaggcacagccggtcccgatgcggcttcagccccatggtttcggtgtcgatggcgatcgatgccggccgaccgaaatcctcgggcaggtcgccttcgtacaggtgaatggtcatccggccgcgcctccgctgtcgtcacggcagacccactgcctgccgaggcaaggttttagcgcaagccgatcccccccgccaagtggggatggccgctgccggacgtcatccgatcgtcatcaagccgcggccggatcatgactttccgtcgcatcgggcggctccggcgttgcgtcgcggcacccgccggattatgtgtagccccaggtttgcgcgaccggcggtgccggaccaggagagggagactttgatcgccatgaaggatcggctcgtcacggtattcggcggctcgggcttcctcggccgctatgtcgtcgcgcggcttgcccgcaccggcgtgcggatcagggtggcggtgcgtgatgcggaccgggccctgttcctgaagcctgcgggtgatgtcggccagatcgcgatcatgtcctgcgacgtgaccgacgcagcccaggtgcgggcggcgctcgccgacgcttcggcggcgatcaatctgaccgggatcctggcagaaggctggggcgccaccttcgacggcgtccatgtccagggcgccggcaacatcgcgaaggctgcggctgacgccggactcgggtccctggtccatgtctcggcgatcggcgccgatccggaaagcagctcggcctatgggcggaccaaggccgccggagaggcggcggtgcgcgaggccttcccgacggcggtgatcctgcgtcccagcatcctgttcggccccgaggacgacttcttcaaccgtttcgccgggatgacccgcatctccccggccctgccgctgatcggtggtggccagacccgcttccagccggtctgggtggtggatgtcgccgaggccgtggtccgctcgctcgacgagccggaatttgccggtcggaccttcgaactgggcggccccaaggtctacagcttcgcccagatcctggaatacattctcgccaccgtgcgcaagcatcgcggtctggtgccgatgccctgggcgcttgccggggtggtggcccgcttcggcgatctgctgcccggcggcatggcgccgctgaccacggaccagctgcggatgctgaagcgcgacaatgtcgtgaccgagggtgctgaagggtttgccgccttcggcatccgcccgaccccggtcgaggcggtggtgccggactatctggcccgctatcgcgcctggatccatcggccgcgcgacggccgcgcggggaactgagctgcttttcagcgccgagacctgatatgcggccggccccgacggggccggccgcatgcttttccgggggatggcatggccgcacggtgccggatggccgatctgggccttgctgaccatcaatccttctgaaacaaaagcttgtggtgatataggtcaggaaatgcgaccattatctcgacaagcatcgcggatctacctgcgaatcgctcgcaacccaggggcatcggaagaaaagtagtccagtttcggacctttcatcacgtttttactcgccaggcggtctggaaaggcgtatatgaccttcgaaggcctccgtgcgcgcaaggggcggggtccggccgtgtcgatctgtcggtggaatgaccgggatcgggcgggatggatccctgaccagcctccccggcgttcgcgtcgtcttccgcccgcccgaggcggaccctgacgcgaccgcagacgacatgcccgcagccaggaacagccccggacccgcccgacctggcgggttgccgatgcagaaccctgccggcacggacgccaccctgacaaagacgtcgcccgcgacccgtctgtggatcccgggcggcaccgaaccgatccgcggcgcggccccggccgaagcgcgcggacacccaaccccctgccgggcaggacatgcccggcccacggtcgaaggacgaggaccatggcgcgcaagctgatgcagttcacccgtatcgagcagaagatgcccgagaagcgaaccgctcaaacccgcgccaaagatttcggcgagatctatgcggggtttgcgccggaacaggcggccacccaggcctcgcgctgctcccagtgcggcattccgttctgccaggtgcattgcccgctgcagaacaacatccccgactggctgaagctgaccgccgaaggccggctggaagaggcctataccatctcgtcggcgaccaacaccttccccgagatctgcggccgcatctgcccgcaggatcgtctgtgcgagggcaactgcgtcatcgagaagggcttcaactcggtgaccatcgggtcggtggagaagtacatcaccgagaccgccttcgagaacggctgggtcaaggcgccgaagccggagcgcgagctgggcctgtcgatcggcatcgttggtgccgggccggccggccttgcggcggccgaaatgctgcgccgccggggctacgagatccatgtctatgatcgctacgaccgcgtcggcgggctgctgatctatggcatccccaatttcaagctcgacaagcaggtcgtgctgcggcgctggaagctgcttgaagagggggggatcaagttccaccttggcgtcgatatcggtcgcgacgtgacgatcgaggagctgcgccagcgtcacgaggcggtgctgatcgcgaccggcgtttatcagtcgcgtgagatcaaggtgccgggcgtggggcttcagggtgtcgagaaggcgctcgacttcctgaccgtctccgaccggctcaatctgggcgatgcgctgtccgacgagatgcaggcgcggttctcggccaagggcaagaacgtggtcgtggtcggcggcggcgacaccgccatggactgcgtgcgcacctcgatccgtcagggtgccgcctcggtgacctgcctttatcgccgcaaccggcagaacatgcccggctcgcagcgcgaggtggcgaatgcgacggaagaaggcgtcaccttcgagtggctgtccaaccccgaagccttcctcggcaatgagaaggtcgaggcggtacgggccgtccgcatgcgcctgggtgcacccgatccgtcgggtcgtcagtcgccggtggtggtcgagggcagtcagttcacactcaaggccgatctggtgatcaaggcgctgggcttcgaccccgaagatctgccggtgctgttcgagtgccccgatctggtgaccacccgctggggcacgctcaagaccgatatccgaaccttcatgaccagcgtcgacggcgttttcgccgccggtgacatcgttcgcggtgcctcgctggtcgtctgggcgatccgcgacggccgcgatgccgccgagcagatcgaccgctatgtccgcaaccgcatcaccgccgccgagcagtcggcggctgccagctgaacgcctggacgggagacagagccatgtccgagatcatccgcgagacggccgagaccttcgttgccgcctgggctgccaacaaggccaagctggaagccgcccatgcctataacccggccgacgagcacgacgcctgcggcgtcggcctcgtcgcctcgatcgacggcacgccccagcggcgggtcgtcgaggccggtatcaccgcgctttccaacctgatgcaccgcggtgcggtcgatgccgacggcaagaccggcgatggcgccggcatccatctgcagatccccaaggacttcttccgggaacatatcgagcgcaccggccatcgcatggccgaaggcagcgaactggccgtgggccaggtcttcctgccgcgcaacgatttcggcgcccaggagctgtgccgcacgatcgtcgagagcgagatccttgagctcggctacacgatctatggctggcgccaggtgccggtgaacacccgggcgatcggcgagaaggccgcggcgacgcggcccgagatcgagcagatcatgatcgccaacgacaagggcaacggcactgtcgccttcgagcgcgacctctatctcatccgtcgccggatcgagaagaaggtccgcgaggcgagcgtcgccgacttctacatgtgctcgctgtccagccggtcgatcatctacaagggcatgttcctgggcgagcagctgacggtgttctaccccgacctgctcgacgagcggttcgtgtcgaacttcgtcgtctaccatcagcgctattcgaccaacaccttcccgacctggtcgctggcccagcccttccggatgctcgcccataacggcgagatcaacaccgtgcgcggcaacagcaactggatgaagagccacgagaccctgatggtctccgaggtcttcgggccggcaggcgaggacatcaagccgctgatcccgcagggcagctccgactcgggcgcactcgatgcggtgttcgaggcgctgtgccatgccggccgttcggcgccgctggtgaagctgatgctggtgccgccggcgtggtcgaaggtgccggacgtgccggaggcgcaccgttcgctttacgcctatctgaacacggtcatggagccctgggacggcccggcggcgctcgcggtctatgacggccgctggatcgcggcgggcatggaccgcaacggtctgcgcccgatgcgctatgccatcaccgccgacggcctgctggtcgtggggtcggaagccggcatggtgccgctgaccgatcaggacgtgatcgagaagggccgggtcggcccgggcgagatcctgggtgtcgacctccaggagggcaagctctaccacgaccgcgcgctcaaggacctgctcgcggcggagcacgactatgcctcctgggcgggcaagaccacccggctcggcgcgctgatcgatcaggtgcctgcaccccagccgcgcttcaacgccgacgagcttcgccggcgccagctggccgtcggcctgaccatcgaggacctggagctgatccttcatcccatggtggaagagggcaaggaagccgtcggctcgatgggcgacgacgcaccgatcgcggtgctctccagccattatcgcggcctgcacaacttcttccggcaggaattcagccaggtgaccaacccgccgatcgacccgctccgcgaggagatggtcatgacgctggatacccgcctcggcaacctgggcaatgtcttcgcccaggacgagagccagatgaagatcctgctgctcgacagcccggtcgtgaccaaccgcgcctatgcggcaatgcgccgttacatgaaggatcgtgcggtcgagatcgactgcaccatgccggccggtgcgggcgaaggcgtgctgaagaaggcgctggagcggatccgtcgcgaggcggaagatgccgtgcgcggcggtgccgagcacatcatcctgaccgacgagcggctggacgagaccaatgtcgccgtaccgatgatcctggcggcgggcggtgtgcatacccatctggtgaagcagaagctgcgcaccttctgctcggtcaacgtccgctcggccgaatgcctcgatgtgcagtacatggcggtgctggtcggtgtcggcgccaccacgatcaacgcctatctggccgaggagacgatctatgatcgccatcgccgcggcctgttcggcgacctgacgatcgacgaggcggtgtcgaacttcaagcatgctgccgatctgggtctgctcaaggtgctctcgaagatgggcatctcggtgatcagcagctatcgcggcgcctacaacttcgaggcggtgggcctgtcgcggtcgctggtggcggagttcttccccggtatgtcgtcgcgtgtctcgggcatcggcctcgccggtatcgagcgcaagaccatccgccagcatgagcgcggcttccagggcggtgcctcgatcctgccgatcggcggcttctaccgctaccgggcgaagggtgaggcgcatggccatgacggccggctgatccacatgcttcagacggccgtcgccagcgacagctacaccctctacaagaagtatgccgaaggtgtgcgggcgctgccgccgatccatctgcgcgaccttctggacttcaagaccaaccgcaagccggtgccggtcgacgaggtcgagagcatcacctcgatacgcaagcggttcgagaccccggccatgtcgctgggcgcgctgagtgcggaagcgcacgagacgctgaccatcgcgatgaaccggatcggtgcgcattcgaactcgggcgagggcggcgagagccgcgatcgcttccagccgcgtccgaacggcgacaacgccaattccggcaccaagcaggtcgcctcgggccgcttcggcgtcaccaccgagtacctgaacaactgccgcgagatccagatcaaggtggcgcagggtgccaagcccggtgaaggcgggcagctgcccggcttcaaggtgacggtcgagatcgcgaagctccggcattcgacgccgggcgtgatgctgatctcgcccccgccgcaccacgacatctattcgatcgaagatctggcgcagctgatctacgacctgaagcaggtcaaccccgatgccgaggtctcggtgaagctggtcgcccgctcgggcatcggcaccatcgcggccggcgtcgccaaggccaatgccgacgtgatcgtgatctcgggccacaatggcggcaccggcgccagcccgcagacctcgatcaaatatgccggcgtgccctgggagatgggcctgtccgaagccaaccaggtgctgacgctcaaccgtctgcgccatcgggtgcggctgcgcaccgacggcggcctgaagaccggccgtgacgtcgtcatcgccgccatgctcggtgccgaggaattcggcatcggcaccacctcgctggtggcgatgggctgcatcatggtccgccagtgccacagcaacacctgcccggtgggcgtgtgcacccaggatccggcgctgcgtgccaagttcgacggcacgcccgagaaggtggtgaacctgttcaccttcatctcggaagaggtgcgcgagatcctggcccagctcggcgcccggtcgctgaacgaaatcatcggccggtcggacctgctgtcgcaggtcagccgcggcagcgcgcatctggacgatctggacctgaacccgatcctggcccaggccgatccgggcgatctgccccgctacttctcgctgtcgggccgcaacccggtccccgacaccctcgacgcgcagatgatcgtcgacgcggcgccggccctcaacgagggcgagaagatgcagctgacctacaatgtgcgcaacacgcaccggtcggtgggcacgcgtctgtcgtccaagatcgtccgccgcttcggcatggacgggctgcagccggggcacatcactgtgcgtctgcgcggctcggccggccagtcgctcggcgccttcgccgtgcagggcctgaagctggaggtgatcggcgattcgaacgactatgtcggcaagggcctgtcgggcggcagcatcgtggtgcgtccgcccttcgtgaccacccgcaagagcaacgagaacgtcatcatcggcaacaccgtgctctatggtgcgacctcgggcgagctgttcgcggcgggccaggcgggtgagcgcttctgcgtccgcaactccggcgcccaggcggtggtcgaaggctgcggggccaatggctgcgagtacatgaccggcggcacagtcgtgatcctgggcaaggtcggccacaatttcggtgccggcatgaccggcggcatggccttcatcttggacagcgacggctcgttcgagcgccgcgtgaacccggaaacgctggtctggcagcgcatcgccaccccgcattgggaagcggtgctgcgcggcctgatcgagcgccacgtggacgagaccaagtccgccttcgcccagaacctgctcgacgattgggatcgcacgctcgatcgcatctggcaggtggtgccgaaggagatggtctcgcgcctcgaacaccccctgaacccggaagaggtcgcggcggtcaccgcctgaggcggaccctcgcgggggcggccccggggccttcgggcccggacctgaggacgggccggacgacgaagacgggaagcggcgggcatccggaagggtgcccgccgttttcgttcaggcgcagctgccgtcactctccagctgcggaattccggaacgacatttcctttcagtccgatcgcggggcggttaaaccgcgcaaggatcggtcctgcgacgggcggggccggttctctctcgtaacccccgcaaaagactggtgacatgacatgttggatgatgaacgcggtccgctgcttcggcaggccctctctcgtctcgacgcggcggccgcgtatctcgacctcgatcaggacgtggcggagaagctgggtgccccccgcgagaccctgaaggcacggctgctgatccggatggacgacggcagccggcgggccttcaccgcctggcgctgccgctatgacgacacccgcggccccaccaagggcggcatccgctatcaccccgcctcgaccatggacgaggtggaggcgctggccttctggatgaccttcaaatgcgcggtgatgaacctgccctatggcggcggcaagggcgcaatccgggtggatccgcacggcctgtcgcgggcggagctggagcggctgtcgcgtgcctatgtccaggccttcgccggcgtgatcgggccggagcgcgacattccggcgcccgatgtctataccgacgccatggtcatgggctggatggccgatgaatacggctcgctgaccggtgcaccggcgccggcggtggtcaccggcaagccggtggcgctgggcggatcgctcggccgcggtgacgccacggcccgcggcggatggtatctgctgcgccatctggctgcccggctgggtgtcgaggaccagcccggccgcgtccggcgggcgatcgttcagggctatggcaatgccggccggcatatggcccgactgctggcgtccgacggctggacgatcgtcggcgtttccgacagccggggtgctgtggcggcacccggcggtatcgatttcgacgcgctggatgccgccaaggcccggggcggggtcggtcttctggaggggccgggcgtgcgccgggtcgatccggacgagatcctggccctggatgccgagttgctggtgccggcggccctggaagagatgatccatgccggcaatgtccatctgatcacggcaccggtggtgctggagctggccaacggcccggtgacgcccgaggccgacgaagtgctgactgcccgcggcatcaccgtgctgcccgacatcctggccaatgccggcggtgtcacggtctcgtatttcgaatgggtccagaaccggcagggctggtactggggcgaggccgaggtgcatgagcggctgaaagcggcgatggaacgggaaggcgacgcgatcggcgaccgtgtcgcggctctcggcatcgactggcggaccgcggcctatgtccacggtctggcgcggctggcggacgccatcgctgcccacggcacccagaccgatttccgcggctgacgccggccgacgtccggggctgacgccgggccgaggccgagccccgctcgtgcagggggtgcggagctttctgcccgcgccccctggcgggaagacgggcggggggataggatcgcccaggcgttcccgtctcccccgcttccggatccgcaccgctgatgtcttccaccccgcagagcccctcgccggcgctgcctgccggcgcgcccccggggcttggccggccggccgccgcggcgttcggcgcctacgtcatctggggcctgttcccgctctatttctctgccctggccgcggtaccgtcgctggaggttctggccgaccggatcctgggctcgctggtcgtgctgatcttcgttgccgcgggccatcgtcaccgggccgagatccgcgccgtgattgcccggccccgggtgctgggcctgctctgcctcagcgccgtcgccatcgcggccaattggggggtctatatctacgcggtccagaccggccgcgcggtcgatgccagcctcggctattacgtcaatccgctggtctcggtggtgctgggcgtggtgttcctgcgcgaaaggccgcgggcgatgcagatcctggccttcttcctggcgatcggcggggtcgcctggattgcgggggaaggcggcggcctgccctggatcgcgatcgcgctggccatgagcttcggcacctatgggctgctgcgcaagcttgcggccgtcggtgccgtcgcagggcttgcgatcgaaaccgcggtgctggcgccggtggcgcttggctggacgatcttcgcggcagccggtggtgctctggccatcccctcggcagggccgctgcaggtgctgctgctgctggccgccggggccgtgaccgtggtgccgctgctgatgttcggctttgcggcgccgcgcctgcccctcggcctgctgggctttctgcaatacgtcaatccgacctgtcagctcgccgtggctgtgtttctgctgggcgaaaccgtctccgaggcgcaaggtgtggccttcgttctcatctggatcgcgctcgcgctctataccggtgatgcggtagtggcccgacgccgttctctgcgctaaagtcctcggccatgcgcacgctttatcatcactggctgaaccctggttgccgcgtggtccgactggccctcggcgagaagcagctcgatcacgatctgcagctcgaaaaggcgtgggaacgccgcaccgagttcctgaggctcaatccggcagccgtgcttccggttctggttgaagccgacgacaccgtggtcgccggccatcgcaccgtgctcgaatatctggaagaggcctatccggaacatcccctgctgccgcgccggccgggcgaccgcgccgaggtgcgccggctgatcgactggttcgaccacaaattctccgacgaggtcacccgcaatctcgtgggggagaaggtggacaagcgcctggcaggcttgggacagccgacttcggccgcgatccgcgcgggcctcgccaatatcaactatcacctggaatacgtggccttcctgaccgagcggcgcaaatggctggccggcgaccagctctcgctggccgatctggccgctgccgcccatctttcggcgatcgactatctgggcgatgtgccctgggtccgccatccggtcgccaaggaatggtatgtccggatcaagtcccggccgagcttccggcccatgctcaaggaccggatcatcggcattgcgcccgcggcgcattatggcgacctcgatttctgatcggcgcccgcccgcgccgccaccgcccaggcgcaaggggccgccgctcgacctcgaccccgccggctggacggcggcgatccgcgccagggccagggagatcggcttcgatgccgtgggcttcgccccggcccgccttccccctgcgacgggcgaggcgctcgaccggttcgtcgaactcggccgccatggcgacatgcgctggatcgaggaccggatcgactggcgccgcagccccgatgcgctctggcccgaggcacgcagtgccatcgtactcgcccagaattacgggccggacatcgatcccctcgccaatctctcccaccctgagaccggcagcctgtcggtctatgcccggggcgacgactatcacgaggtgatcaaggcaaagttgcgccgtctggcccgctggctgtgggacgaaagcgcggtcgaactcaaattcttcgtcgatactgcgccggtgatggaaaagccgctggcggcgctggccgggctgggctggcaggggcgtcacaccaatctggtttcgcgtgatttcggatcctggacctttcttgcggtgatgctgaccgggctcgacctcgtccatgaccgcccccatggcgatcgctgcggcagctgccaggcctgtctggatgcctgtccgacggatgccttcccggcgccttatgaactggatgcccggcgctgcatttcctatctcaccatcgaactcgacgggccggtgccggcggagttccgggccgccatgggcaaccggatctatggctgcgacgactgcctggcggtctgcccctggaacaagttcgcgagaggggccgccgagacgaagctggcgggccgcgaggcgttgacggcgccggcgcttgccgatctggccggactggacgatggcgcattccgcaccatgttcgcgaagaccgccgtcaagcggatcggccgcgaccgcttcgtccgcaatgtcgcgatcgcgatcggcaattccgggcggcccgatctggtgccggcactccggccgctgctggcggatggtgcggcgcaggtccgggcgatggcggtctgggcggcatcgcggctgatgtcgccggctgaatttgcaggcgcggcggccgggcggttgccgggcgaaaccgatccggtggtgctgaccgaatggcgggctgccggtgtcctgtccgaggaggggccatgaccgaccaccccgccgatcacgaggcgaccgatcccgtggccctgcttcgccctgtggcgggccatggaggcctgctgttctgcttcggcctcggcttttccgcccgggcgctggcccgggcctggatggcggcgggcggccgggtggcaggtacctgccggagcgccggcaagcgcgatcagctggtggccgaggggatcgccgcgcatctgttcgacggcagcgaagcgatggacgccgcaggtctcgcggatctgggacgggccgtggcgatcctgtcttcggtcggccccgatgccgggggcgatgcggtgatccgggttcacggggcggatattgccgccgcagcggcagccggtgcggcacgcggtgccgcgccctggatcggctatctgtcgaccaccggggtctatggcgatcatggtggcggctgggtcgacgagaccacaccgaccatcgccgccgccggccggggcggccgccgggtggcggcggaacaggcctggtcggcgctggcgcccgaggcgccggcccatctcttccggctggccggcatctatggccctggtcggtcggcgctcgatacggtccgcgccggacgggcgcatcgggtggtgaagccgggccaggtcttctcgcgcatccatgtcgacgacatcgccgccgtgctggccgcctcgatcgcccgccccgcccccgggcgcgcctacaatctctgcgacgacgaggcagccccgccccaggacgtgatcctgcatgcctgcgaactgctgggggtgacaccgccgccggaagtgccgttcgaggaggccgatctcagcccgatggcgcgcagcttctacgccgacaacaagcgggtgcacaacaaccggatccgcgaggagctgggcgtgcggctgaaataccgcacctaccgggaggggctggccgcccagcttgcggcggaagcggcgcgccggtagcggcggtcaggcgggaagccgcagataccggccaatgcccacccgggcgagcaggtccgggtcgtggctgaccaggaccagggcgccatcccaggcggcaagtgcggtctccaccgtctcggtcgactccagatccaggtgattggtgggctcgtcgagcagcagcagctccggcggttccgcctggccgagcaggcaggcgagagcgacccgcacccgctcgccgccgctcagcatggccgtctgccgcaatgcggcgtcaccgcggaacaggaagcgtgcaagggttgcgcgcagggcttcctcgccggcatcgggcgcatggcgccgcagattgtcgagcaggctgagcgccggatcgagcagatccgcatgctggtcgagcagggcgatccggccggggcgtcggaccgaaccgctgcggggcaggtccagcccggcggcgatcctgagcagcgacgtcttgccggcaccgttcgggcccgtaatcgcgatccgctccggccccgtgacgctgagatcgggcagggagatgccggccgccgttacgacatcgcgcatgtcgagcagctcccgcccacgggcgagacctgttgcgggcagtgagaaagccggccggccggtcaggtcgagcgcggcgcgggcggccgtcaggtcgcctgctgccgtctccagacgccttgctgccagccggttcccgcggccccggctgcgttccgcccgatcctgtcgggcatcgagcaggatcttcggcatgtcgccgcgggcgcgatgccggcggccggcggcgtcgcggcgatcctgacgcgcggccgccgccgaggcctcgcgctttgtccggctcatctgatcccgggcggcggccatggcggcatgggccgcggcttcccgggccgtgcgcgcggcaagccaagcctcgctgccgcctgtgtggtggaagacccggcccggcgccagttccagaatgcggggcaggccgcgcaacaggtcccggtcatgagacgcgatgatcagcccgcccgtccagtctgcgatgagagaggcgaccgcctgccgcccgctctcgtccagatggttggtcggctcgtccagcagcagcagatccggttcggccaggatcgcgcctgcaagccgcaaccgggcgcgttcgccaccgctgagggtcgcgacggggcggcggacatccaggtccgcaaggcccatccgggtcagtgccgcgatgatccgggcttcaaggccccagtcgatgcgggctgcgtcacgggcgtcgatgcgccccgtcagcgcgcggtcgatgaggtcgagcgcggccctctggccgatcagatcggcaatggtcagatccgtcggcgtgcctgccgtctggtcgagcagcaggcagccggccggccggacgatccgaccggccgcgggagaggcatggccgctgatgatccggagcagggtcgatttgccactgccgttgcgaccgacgagaccaagggactcttggcccagatcgagatcgagccctgaaaaaagctcacgcccccggggatcgatcgcggcaatgccgcggaggctgaggtgcacggtggtggatgacatggagagccttcggaacggaacgacgacacggggtgatgcggtcggtcgtcgttccgatcatcggcagggcactcctgaaggctgcggcgtctgaaggtccccgatatgtggggagccgcggccccggatcaatccgcttcgaccaccagccggcacacctcgtcgagggtgcgggtcagcatggcgatgtcggaaggcgtcgaaagccgatgatcgccgcctttgaccagctcgagccggagatcggtggtggtcagtgccgcggcggtttccagcgacagccgccagggcacgtcgggatcttccaggccgtggagcaggcgcaccggcccttcgaaggggatggggccgtcgagcaccagattgtcgcgcccctcttcgatcagccggcgggtgatcaccgtgggctccgggtcgtattccgatgggatctccaggcggccgtcgcggagcagcatcgcctgctggtcggcggtcatgtcgggccacatcagcctttcggtgaagtcgggcgccgcggcgatgccgatcatgcccttcacccgatcagggcgggccagggcgacgcgcagcatgatccagccgcccatgctggagcccaccaggaccagcgggccgtcggtcaggcgatcgatcatcaccagcgcatcttcgacccagcggccgatgcagccgtcttcgaaggcgccgtctgagatgccgtgaccggaatagtcgaaccgcagatagggccggccggtgcgggcgcagaacccgtcgagcgccatggccttggtgccggtcatgtccgagcggaacccgcccaggaacacgacgcccggcccgggcgcccagagcttgggcagatggcgatgataggccagatgcacgccgtcgccgcgatcgatgcggccggtatcggaaccggcgggatgggcggggtcggcggaagaagtgggggtggacacgcgatcctccatttgggggataaggttggatgtggatgagggcgggcgtgacgggccggatgcatgacaggtggaccggtgaccatttcggggcgtgagcagcccggacttctgccggaaaggtcgctcgtgtagtctgtgggcggatccggccgggtggccgggccagccgtgcccgtgcccgcatggagccctgaacccggtgcaatcggacgatattagcagcaagcccgcccatgacccaaacgacggtcctgtgacgccccccgcgtcggccttccggccgcgcaccgttcttcaggtgcttccggcgctgggaccggggggtgtggagcgcggcaccgtcgacatcgccgccggcctgatcgccgccggctggcgtgccgtcgtggcctcggcgggcggaccgctggccgtggaactggagcggctgggcggccggcatgtcaccctgccgctggcgacgaagcgcccctgggcgatccgcgccaatgccgggcggcttgccgatctgatccgggaagagggggtcgacctggtccatgcccgctctcgcgcaccggcctggagcgcttttatggcggcggagcgcaccggcacccccttcgtgaccacctttcacggcacctatggtcacggcagctggctgaagcgccgctacaacgcggtgatgacccgcggccggccgctgatcgccatctcggacttcatcgccgaccatctgcagacggtctatggcgtcgatccggccgtgatccggaccatcccgcgcggggtggatgtttcgaaattccatccggcagcggtctcggccgaccgcatcatcgcactcgcccgccgctggcggctggacgaaagccgggcactgatcctgatgccgggccggctcagccgatggaaggggcatatcgtgctgcttgatgcgctggccgagcttgggcggcgcgatgtgcaatgcgtgatggtgggcgccgcccccggcaccgagagctaccgcgccgaagtcgagcaggcgatccgggatcgcgggctggaagatgtggtgggcattgcggatgccgaacgcgacatgccggcggcctacatgctcgccgatgtggtggtgtcgccggcgacggagcccgaggctttcggccgggtgccggtggaggcccaggcgatgggccgctggatcatcgccacggatcatggtggcgcgcgcgagaccgtggacacgaatatcggcggcatgcttgtgccgccgggggatgccgaggcgctggcccgggcgctggggctggccctgaccatggatccgaaggcgcgggccgctgcggcgcgtgcgatgatcgcccatgtcgacggccgcttcacccttgcccggatgcaggcatccacgctggcggtctacgaggaggcgctggcccgggggcgaccggtatgaagagggcacagaagatcgtcgtgccgccaatgccggatccgaaggcccgggtgctggtgatcaagcattccgccttcggtgacgtgatcctggcgctggggccgatgaaggcgatccgcctggcccatccggagggccgcatcaccctgctgaccacgaagccttatgccgggctgctggaccagagcgggctgttcgacgagatctggatcgacgagcgccccaaggcctggcagttcggcaaggtccgcgatatgcgacgccggctgaatgccgaaggcttcgagcgggtctacgacctgcagaccagcgatcgcagcagcagctatttccgcctgttcgaccggccgcggccgctctggtccggcattgcgcccggatgcgcgttgccccatgccaacccgcaacgcgaccacatgcacacgctggagcgtcaggccgaacagctggccatggccgggatcacccgggtgccggcgccggatctcggcttcctgaaggcggatctgtccggcttcgatctgccggggcggttcggtctgctggtgccgggtggcgccgcgcatcgcccgggcaagcgctggccggccgcgaagtatgccgagaccgcggggctgcttgccgatcagggcatcgtgccgatgctgatcggcacgaatgccgaggccggggcgatcgatgcggtggtggctgccgagccgcgggcggtgtcgctgcaggggcgcaccagctttgccgagatcgcaagtcttgcccggcgtgcggcgatcgcggtgggcaacgacaccgggccgatgcatctgatcgccgcggtcggctgcccctcgctcagcctgttctcgaaggagagcgacccgcagctgacccgtccccgggggccgcgcgcctcgtggttgcggtcggatcggcttgccgatctgtcggtcggagaggtcgcgaccgccatccgccggctgctcgagacgtgaccggggctaagttgccgttcaagaaagacttgcacgacaccggaccgtgactatccttctgtcatatcggcgacgcgcatgtgcgcgtcgaccccgcctcatgccctgttgcctggttcaagaaccatcccgtcgtcaccatatccggttctgatcgaccggtgtcgtgcccgggcatgggcttcctgatccggcccgcagggtgcgggtttccggtcggcaatcgaaaggggactgaccatcgctagaagaccaatgccggtggcgccgaacgcgaatcgcgacgcccatcgcatcaatgaagccatccgcgtgccgcaggtgcgtctgatcgacgccgacggcaacatgatcggtatcgtctcccgggacgacgccctgaaccgcgctgccgatgccgggctcgacctggttgaagtcgcggctcaggccgaaccgcccgtgtgcaagcttctcgactacggcaagttcaagtacgagtcgcagaagaaggcccaggaggcccggaagaagcacaagacgatcgagatcaaggaactcaagttccggccgaacatcgacgacaacgactacaacgtcaagatgaagcatgccgtcaagttcctgaccgaaggcgacaaggtgaagatcaccatgcgcttccgcggtcgtgaagtgacgcaccaggatctgggcatgcgcgtcctgatgcgggttgcgggtgatcttgtcgaactgggcaaggtcgagcagcgcccgacccttgaaggtcgtcagatgaccatggtgcttgcaccgctcgtccagccgggcgagaaggccgaaggtgcggacaaggccgccgaaaaggcatgagctgaccggtctcgtgcctgctggcttgcgatgggcgccgggacccgtgggatcccggctgccttttcggcagcggcgtgcgtcctgcacttgccaagtgccggtggcgtcgctataaagccggcttcgaaacgccgggacgggcgaccgttccgcgcgacatggtggccgtggcttctggcatgcccgtccgccatggatgctccgcatcgtcccatgccgttcctgacggtcccgggggatgcgacctgaacagacggagagcaaaatgccaaagctgaagagcaagagcggcgccaagaagcggttccgcctgactgcgagcggcaaggtccgccgcgccagcgccttccatcgtcactgcatgtcgtccaagacgcagaagcagaagcgcaacagccgcaagacccagatcctgacggctgccgacgcgaagatcgtcaagcagttcctgccctacgcctgaccggctcccggcggacgacgacagaagatgcagtgtccggccgatgcccggccggctccgaatgatttccatcgggagtacagacgatggcccgtgtgaagcgcggcgtgacgtcccatgcgcgccacaagaaggttctgaagctggccgagggcgcccgtggccgctcgtccaagacgattcgcgcagccaagcagcgcgtcgacaagaacctgcaatacgcctaccgcgaccgccgcgtccgcaagcgccagttccgcgcgctgtggatccagcgcatcaacgccggtacgcgtgagttgggcatgacctacagccagttcatggccggcctgaaggccgcggccatcgagatggaccgcaaggtcctgtcggatctggccgtgcacgagcccgcagcctttaagagccttgtcgagcaggcgcagagcgctctcgccaaggccggtgcctgagagacgcggataccgggcggtgacgcccggtaacccggatccggcacagaaggacgccgatcgaagcgagggggcccgcgcctgcgggacccctcgttttgcgttctgagccaggtttatccggaagagcgcggtgtcatcgaatcgtcaccggtgaacgcgcattctgcccctccgtcggatccaagactccgtcggaactcagacgtccgatccgcataagaccgtcgagccaaactgatcccgaggcctccatgaccgacatcgacagcctgaaggaggagatcgaggggcgcatcgccgctgccgccgatctcgacgcgctcgaagaggtgcgcgttcaggcctttggccgcaagggccgcatcaccgagatgctgaagggcctgggcgccctggaccccgaggcgcgcaaggcgacaggccaggcgctgaaccaggtgcgcgaccagctgcagacggccctggaggcccgccgcgaggtgctgaaggcggcggccctggatgcccgtctcgcggccgagcggatcgacgtcaccctgccggtgcgacccgagccccagggccgcattcacccgatctcgcaggtgatcgacgaactgacggccatcttcgccgatatgggcttccaggtggccgaaggtccgcagatcgagaccgactactacaacttcaccgcgctcaacatcccgccggagcatcccgcccggcagatgcacgacactttctacgtccgcggcaaggccgaagacggtgccaacctggtgctgcgcacccacacctcgccggtgcagatccgcaccatggaggcgggcaagccgccttaccggatcatcgcgccggggcggacctatcgcagcgacagcgacatgacccacaccccgatgttccatcaggtggaggggctggtgatcgatcgcgacatcaccatggcgcatctgaagggctgcctgatcgagttcgccaaggccttcttcgaggtcgacgatctgccggtgcgtttccggccgagctatttccccttcacggaaccgtcggccgagatggatatcggctgccagcgcggcggcggcgaactcaagatcggcaattacggcgactggctggagatcctgggctgcggcatggtccaccccaaggtactggccatggccggcatcgaccccaacgagtatcagggcttcgccttcggcatgggcatcgaacgcatcgccatgctgaagtacggcgtgccggatctgcgcaccttcttcgagggcgatccgcgctggctgaagcattacggcttcgcggcggccgatctgccgacgcttgccggcggtctgacgcgctgaacggagatcactcgcgatgaagttcaccctgtcctggctgaaggaccatctcgacaccgatgccgatctggaccggatcgcgctggcgctgaccgccgtcgggctcgaggtcgaagagatcaccgaccggcgcgcggccctcgcgccgttcaccgtcgcccatgtcatctcggccgagaagcacccggatgccgacaagctccgggtctgccgggtcgataccggcgatggcgaggttcaggtcgtctgcggcgcccccaatgcccgcaccggcatgaaggcggttttcgcccgttcgggcctgaccgtgcccggcaccgggctgacgctcaagccctcgaagatccgcggcgtcgaaagcaacggcatgctggtctcgatgcgcgagatgggcctgtcggacgagcatgacggcatcatcgagatgcccggggatgcgccgctcggccagcccttcgcgccggtgctgggcgtcgacgacccggtcatcgagattgcgatcacccccaaccggggtgactgtctgggcgtgcgcggcattgcccgggacctggccgccgccggtctcggcacgctgaagccgctggaggcgaccccggttgccggccgtttcccgaacccggtcgccatccggatcaccgatgacgccaagtccggctgcccggtctttgccgggcgtaccatccgcggcgtgaccaatggtgtggcgcccgactggatgctgcgccggctgaccgcggtcgggctcaggccgatttcggtgctggtcgacatcaccaactatgtgtcgctggatctgggtcggccgctgcatgtctttgacgcgaagaagctgaccggcgatctgaccatccgcaccgccgccgagggcgaaagcctgaaggcgctggacgagcggacctatgcgctgggtgccggccgcgatgtggtgatcgccgacgatgccggggtgcagagcctgggcggcatcatgggtggcgaggcgaccggcgtcgacgagaccaccaccgaggtggtgctggaatgcgcctggttcgatccgaagcggatcgccgaaagcggccgggccctctcgatcctgagcgatgcccgctatcggttcgagcgcaccgtcgaccccgagacggtgctgccgggcaccgagattgcgaccgcgctgatcctgaagcttgccggtggcgaggcatccgaggtcacggttgcgggcgaggtgccgggcttcgatcgggtcatcggcttccgcccggcgcgggtggaaagcctgggcggcatcgtcgtcgatccggcggcgcaggccaccatcctcacccgcctcggcttcgacgtggtgcaagagagcgacgccctctggcaggtccgggtgccgagctggcgccaggacgtcgagggcgaggcggatctggtcgaggaggtgctgcgcatcaacggctatgacgccgtgccgccggtgccgctgccgcgggtggatgtggtgacccgcaccgcagccaacgaccggcgtcgccgggccggctgggtccgccgcgatctggccgcccgcggcctggtcgagacggtgaactactccttcctgaccgcggccgccgcccggcgcttcggcggcggagcggacgagctgcatctgctgaacccgatctcggcggatctggaagtgatgcggcccaccccgctcgcttctctggtcatggtggccggtcgggctgccgcccgtggcgagttggacggccggtggttcgaggtcgggcccggctggcgcggcatcgcacccgccgaccagcgcaacctggcgaccggtctgcgtaccggccgcaccgggccgcgcagctggaccgggcagccgcggccggtcgacgtcttcgatgccaaggccgacatcctggcggcgcttgcggcggcgggcatggatgccgacaaggtgcagatcgtcgccggcgaggcgcccggccactaccatccgggccggtcggccgcgatgaagctggggccgaagctgacgctgggcttcttcggtgagctgcatccgctggtggtcgaggctcatgacgtgaaggggccggccgtcggcttcgagctggatctcgacgccctgccggagcccaagcgcaaggccgaccggacccgtccggcgttggtgctgcacgacctgcagccggtcgagcgcgatttcgccttcgtggtcgatgccggggttgcggccgaggcgctgatcaaggcggtgcgtggcgccgagaagaagctgatcaccgacgtctcggtcttcgaccgctacgagggtgagcggctgggcgccggcaaggtctcgcttgcggtgtcggtgaccctgcagccggtggagcgcacactgaccgatgccgaaatccaggcggtgtcggaccggatcgtcgcggcggtcaccaaggcgacgggggccgtgctgcggggctgacgggggccggcagctccggacgaaacagccacgacaaaaaaagccgggggcggcacggggtgtgacatgcgtcgcagaccgtgccgcccctgcgtttttgacacgatccatttttgctgcgctgccgtatgattgtcatccgggtgtcattcggaacggttgcggcattgatggcgcccggaaacacgcccatatgcggtcggcctgcatgcggtggggcggctgtaccctccgccagatcgccacatttcttgccatacctgtccgtcagaggctgccggcgcatgtccgaagtcgatcaactgttgcttgcccgggaaaagaagggcgtgcgctttgcgctggttgcccggctcggcatgctcggcatcgtcttcgggttgcacgtcttcctctatcacaccatcggtgaactggcgctggtcggtctgctctgcggcggtgctgcgatcggtaccgcagccctgctgatgcatctggatcgccagggctgtcccaagctgaccggctatctggcgaccattctggatgtgctggtgctgagcgggctgccggtgatctggtatatcggcaccggcgcggatcaggtggtcgggccgcaattcttcctgcagacccgcatgaccgtcggcgtgctgatggtgatggtggtgaatgcgctcgccttccgtccggcctatccgctggtgatcgccgtcggcttcgtggcgatctatgggggtttctcgggcatgatcctgaatgatccgcgcacggcgatcaccacagatccgctcgcggccatgaccggcatgggggtggcgccgaggctggtggtcgccgatatggtgatcgtgatggtggtggggctgctgctcgccgtcatgacccgggtcgcccgccgcatggcggttcaggcggtacgtcagcagcatgcctcggaccagcttcgccgctatttctcgccggccgtggccgcccggatcgccgaaggcggtgacgatttcttccgccccggcggcgtggtgcgcgaggtggcggttctgttcgccgacatccgcggtttcacccacctctccgcccagatgccgcccgcccatgtgctggatctgctgcgcagctaccatgccgagatggtcgccaccgtcttcgcccatggcggcacgctcgacaagttcatcggcgatgcgatcatggtgaccttcggctcggccgaacccgaccccaacccggcccgccgggcgctggagacggcgcttgccatgcgcgaggcgctggagcggctgaaccggcggcggatcgccgcaggggaaccgccgctcgcccaggatatcggcgtgcatgtcggcccggcgctcgtcggcaatgtcggcacgcccgagcggctggaacacacggtgatcggcgatacggtcaacactgcaagccggatcgaggcggcgtgcaaacagcatggccgtgacctgctgatctcggaggctgtggtcgccaaggccggcgggggcttcctgctcgagcggctggcgccgaccgtgctcgccggcaagaccgacccgatccagctctatgcggtgctggggcataccgcggcagatcaggatgaagacgtgatcctgccgggcctccacgccacaccctgggtggtggagatggacgaggccgaagacgaagcgccggccgtggccaacgggctggtgcgcggcgccgcctgaacccggtctgcctgcgccggcccgccgacgccgatcccggttgccagcgccccttgcgggccttatgttccccggcaactcaaacgcttgtgcctgcccggccccttgtgcccatccggctgacggggcccggcccttcggggatgtccatgaccgacctcgcgaacatccgcaacttctcgatcatcgcccatatcgaccatggcaagtcgaccctcgccgaccgcctgatcgagcggctgggcggtcttcagggccgcgagatgaaggagcagatcctcgactcgatggatatcgagcgcgagcggggcatcacgatcaaggcgcagaccgtccggctgacctatgacgccaaggacggcaagacctacgagctgaacctgatcgacacgcccggtcatgtcgacttctcctacgaggtcagccgctcgctgtcggcctgtgaaggctctctgctgctggtggatgccagccagggcgtcgaggcgcagacgctcgccaatgcctatctcgccatcgacaatgatcacgagatcgtgccggtgctgaacaaggtcgatctgccggcggcggaacccgagcgcatcaagcagcagatcgaggacgtgatcgggctcgatgcctcgcaggcgatcccgatttcggccaagaccggtgtcggcatcgacgatgtgctggaggccctggtggcccgcctgccggcgcctgccggcgatccggccgcaccgctgaaggcgctggtcgtcgacagctggtacgacccctatctgggcgtggtcattctggtacgggtgaaggacgggacgctcaagaagggcgccaagatccgcttcatggcgacgaagcgtgcgcatccggtcgaccgggtgggcgtgttcacgcccaagccgctgatgatcgacacgttgggctgcggctcgatcggtttcatcacggccggcatcaaggacatcgccgatgcccaggtcggcgacaccatcaccgaagaggaccggccggcggcggcccctctgcccggcttcaagccgacggtgccggtggtgttctgctcgctcttcccggtcgatgccagcgattacgagcatctgcgcgacagcctgggcaagctccggctcaacgatgcggcgctgcatttcgagcccgagacctcgacggcgctgggcctcggcttccgttgcggcttcctggggctgctgcatcttgagatcatccaggagcggctggagcgcgagttcaatctcgacctcatcaccaccgcgccgagcgtggtctataaggtctataagatcgacggctcgatcatggagctgcacaacccggcggacatgcccgacccggtgcagatcgaccatatcgaagagccgatgatcaacgccaccatcatggttccggacgaccatctgggcgccgtgctgaagctctgcgaagagaagcgcggccggcagaaggagctgacctatgtcggcggccgggcgatggtcgtctatgaactgccgctggccgaggtggtgttcgatttctatgaccggctgaagtcggtcagccgcggctatgccagcttcgactatcagcttcagggctatgaggagagcgatctcgtcaagctgaccatcctggtcaacaaggagccggtcgacgcgctgtcgatcatcgtccaccgtgccatgtcggaggggcgtggccgggtgatctgcgaacggctgaaggacctgatcccccgccagatgttccagatcgcggttcaggcggcgatcggcggccgggtggtggcacgtgagaccgtgaaggcactgcgcaaggacgtgctggccaagtgctatggcggcgacgtcagccgcaagcgcaagctgctggagaagcagaaggaaggcaagaagcgcatgcggacctacggcaatgtcgagatcccgcagtcggccttcatcgccgcgctcaagatcgacggctgatcgaccgatcgacggtcgtccggataaagttgatgctcggggttgatgcaccccgggcatttttcgtcagcgccgccgactgaaccgccgacgccggtcaccctcgccgcttctgccgccggttgccagcagcaggacgcccagcacgcccgccaccgcccagatcggcagttccagaaccgtccgcaccggcggccacaggccgggccacagggcgttctcgatgccggcctgcaggccgatcaggctgttgcggtcgatggctgcccacaggctggacagggggatgatctcccatgtcccctgataccaggccccgacggcttcgagaccgacgagaaccagggcggcgatgagcagcaggaaggcgaggcttcggcgaaccgacatgcggcagacaatctccgttctgcgggtgcaaggaccagcgacgacaagcttagaccatcaacccgtcttggcaaccgccgccgcacttcgtccgccatgcggttccggcatatgccccggcatgtccaggctccgacatgcccttgccattatcccggcccggaccccagatcggcggttgcgccccgccgtcgtccagctataatgcgcgccgccggtcgaccgggatgcacgcaccgcaaagcatcccaagcaagacagtcgatcgggcacaaggccggagggatggccgagcggtcgaaggcgcacgcctggaaagtgtgtatacggtaacacgtatcgtgggttcgaatcccactccctccgccacgcaccaccgatctccgctctcgggtccgatagcgccgccgctcacggcgacgggcggacactcgtccggccttgggatattgcaaggtcgttcgtcatggcaccgcggacgccgtggaagccggcatggctgtccgccgtagcagaacggcgaccattgccagcgcggcgacggcgcagaaccccagacctgccgacatgccgagcgctgtatgaatgccgagctgatgcatgatcagggcgaaggcgaatggtgcgacggatcccacgatcagcctgaccgacatgatctgcccctgacgccggccatagccgtccgcgccgaacagggccagcggcagcgtgccgccgacgatgctgtagaggccgttgcccatgccgaacagaacggcgaaggccatggccccggcaatcgaaggcgcggtcagcgtcaacagtaccagcgcacccggcaacagggctgcggcgaccgcagccaggatgagctgcgacaggttgcggccgaagatcatgttgatcaacctgctcgccacctgggatgggccgaagagggcgccgaccgttaccccgatgaccccgaggcccaggctgcccagcatcggcagcatgtgaaccagcaccgctgagctgacgaagctctggaaggcgaaagcggccgccatcaggatgaacgccgttcgtcggttggcaggcgcgacgctgccctgcgggctctcgggcgggtccgaggcaggctgcccggcacggagcgtcttcgggtccgcctccgccgggcggctcagccaggcgtgtaacggcacgcatagcatgaggttgagggccgcgaagacgatgtagacctcgcgccagctcatgaagccgtgcagccacgacgtgaacggccagaacagggtcgaggcgaagccggcgatcagggtcagccagacgatgctgcgttgggccgtccgcggatgacgctggacgagcagggggaaggccgcgccgtactgcaccatggtcgacgcgatctcgatggcgatgagggctggcaggaaggtgaaaccggagggcgccgccgcgcagaccgccagtgccagcactgcggtgacggaacctgcggtcatcaccctgccggcaccgaaacggtcgatccatcgtccggaccagggggcgatcagaccgcccgtgagcagcgcgatcgacagggcgccgaatacccattcctccggccagccgagatcccgagccatggcaggcgccaggatgccgaagctgtaatagagcgtgccgtagccgatgatctgcgtcaggccgagcgctgcaatatcgctccaggccctgacatccgacctttccgtcaggatctgcatcagccgcctgccgcgctggccggcgcgcatacggcgggatgaccctggcagcagtcacgcatcaggaagtcgacgagatccgagagtgccgggtaggctgcgctgtagaggatggagcggccgttgcgacgggaggtgacaagccctgcctgctgaagctgcccgagatggaaggacatgcgtgatgatgacgcaccccccatcgcctcgccgatggcgccggccgccagcccgtcaggtccggcggtgaccagaaggcgcacgatccggagcctggtctcctgggagagtgccgcgaaggctgtcagtgcctgcggttcgtccatcatcatctccatatctcaatgactcatgagatatggagatgatgatcaagctgtggcggatccgccatcacgctttgatgacatatgcctgcgggggcggtgttccgtgacggagctaccctccggcgatcacgggccgtccatgcacccttggctcatgatccaggtggttatcgtgcatacgacccaccgtgtgggcgagcggcggcccggcgcccggtttcaaggccctcgtcagaccagcgtcaccttgccggttgcgatgtcgtagaccccgcccaccgccttgacacgggtgtcggcgatggcctgggacagaaccggggttgcatctgccagtgtgctgagggtgtggcggacattgccgatggttgcatcggccagcaggtctgcggccgggcggccggtcgcggaggacaggaccaccggctcgatgcccgggcgcatggcatcgatcaggccgggcagatggccgggcaggatggtgccgttgcggatgacgtcgatggtggcggaaaccgcgccgcagccggaatggcccagcaccatcaccagcggtacgcccagcacggccacggcatattccaggctcgcgatgccgtcgtcattggcgaaattgccggccaggcgcacgacgaacacctctcccggcccctggtcgaaagcaagttccggggcgatccggctgtcggcgcaggagatgatcgccgcaatcgggtattgcgcccgggcgcgggcgtcgcggccggccatggggtcgcgcgcttccggtttgccctcggcccagcgggcattgccggccatcagccgggccagcgcggcatcgccggtgaccaccggccggggcagcggatcggcggcccaggacggtgcagtaccgccgacggcgagtgtggttgccccggcgcccagcagccccagaaagctgcggcggccgatccggggatgtgaggagaggtggggggatgacgggtgcggcatcagcgtcgctcctttgccctatcatggttgtgcgagaccgaaggcagagtgcggccggggtgcatccggcatttttccggcggccgatgcacttgatcatggcgctttgtcgcgtcgtgctcgatatatttccccatcagaggtcgccgatcgttcaccggccgacccgcagccgcagacgcaccagaggacgttccgatgccgatcacgcccgagaccaccgtcacccgcaatgacgatctgatgatcgccgaaatcgacggcgaggttgtgctgatgcatgtcgacaagggcaattattacggcctggaccagatcggctccgacatctgggagcggatggccgggccggtctcggtggccgatcttcatgccgccctggtcgccgattacgagggcgatgccgaagagatccgtgccgatctgatggagcttctggagcggatggccgagcacgatctggtgcgcgtcgccgcctgagtggtctcagtccgccccgccgcgggcgcaacttcgcctggacgcagacgaccgctgcgtgggatggtttgacggcgtggccatgatgcatggcctctctcatcccatccgccaggcagtgcctcatgtccgaaaccatgcccgcccccgacctcagtttcgagatgccgccggcgcttgcagcccaaggcttcgccgtccggccgcgcacgccccaggacaccgacttcctgcgcgagctgtacatctcgttccgttgggcggaactcgaggccgccggctggcccgaggccacgcggcgcagtttcctggccgatcagttccggctgcaggacaaccactacaccacccattacaccaccaccgccttcctgatcatcacgaaggacggtgcgccggtcggccggttgtatatcgaccgggggggcgcgcccgagatccggctggtggacatcatcctggtgccggccctcaccggccagggcatcggctccgccatcatccgcgtgctgctggacgaagccgcgcgcaccggccgctatatcgggctgcacgtggaaagctacaacccggcccggcggctgtatcagcggctcggcttcgtcgatcgccggctggaaggcccctatttctatatgagctggggggattatcccaccgatgccgagacggtcgccggagagagggctcagctgaacacgatctgataccgcaccgtcccgtcgggattgcggccgatcggcaccatgaacaggcgcatctggcccatggtttcgtgcgacagcagaacctcctgaccgtcgatggcgatatccgtccggctgccgtccagaaacaggctgaaccgttcccgagcgaagctcggcaacggaggcttacgggtcacgcttttaagcgtgagtcgttcgatcagaacccctgcttcgcccgaggggatgtcgaaggggtgggcggcagcggcttcgaattcgtcggcggtaagatccatgagggatcgcatgattgttccttcatgtgcgctttttgggctgttttatcgacaattcgtcagatattatcgcccaggtgtagtatagtacacgatgcggcgtccggaagccgttcttgttggcttaccggttgcgcttctggttctctcatgtagtgatgcaagcgtacggggtgccctatggaagaaaatcgtagcgaattctgccgtgttagtggcacgcccgctgatgcggagagtgtgtgcgcaacttggcggaagcctgttttggttgtcgaagggacggggacgatcactttgggtaatttctatgtgacaaatactgacggtgattatagtaactcctgaggctcatgcccttttggaggcgtaaagaacatttgaacggcgttgcatttacttcgaggctcgcgctctctggagcgcgggcgtttttctatgtttgcgaataagacgcaatgcgagcccatttaatattttgtgggcacttaatttgtttgcgtctgttagttgagcgttctttaatctatcggtgtggcagccggttgcatgcaaaagcgacacgccctggtgtctgctgggggttcgaaggttgcattcattctacggcccacaatgtttgtttgatccccgcgaggatgacggacgatggatcctttcattggagaaatccgcatctttccgttcggttttgcgccgaccggttggttgccctgtgaaggccaggaactgcaggtaagccagaatcaggcgcttgccgctctgctcggaaacacctatggcggcaactggccaaccacgttcaagttgccggatctgcgcggtcgcgctcctctggggcagggccagcacaatggcttctcctacagcatggggaatgccatcggcagccagaccgtaacgctgacggtcggccaactgccccagcatacccatacgatgtccgccttgagcaccgagggcacgctgcccctgccgacgacgtccacgggcatcaccacactgctcgccaactcacgtgaatcgggctcccagccggatgggcctgagatttatcttacgccgcctccgacggcgactttgacgccgctccgtcccgaggcggtgtcctccaccggtggcggccaggcgcatcctaacgagcagcccagtctcgcggtgtactactgcatcgcgaccaccgggctgtggccgccgcggtcctgaacccgaccatcatctctgcggccgggcatgcaatcaccggatcggtgtgcacaaccggttgatagatcttcatcgacaggatgagacatcatggacggatttctgggcgaaatcaggatgttcgccggcaattacgcgccggaagactgggcgatctgcaacggcgcgctgctgccgatcgtgggtaatgaggcactgtactcgctgctcggcgtcaagtacggcggcgacgcggtgaccaactttgcgttgccggatctgcgcggccggatggcggtgcatgccggacaggggccgggcatgccgtttccgcatccgctggcgcagcaattcggcagcgagacggtgacgctgaccgaggcgatgatgccggcgcacagccatagctggcagacctatccgcagccctcggccaccgaggcgccccaggcgcagatgctgggcaccaatgtgccgaccagcacggcgccgacttttgctggtatctacaggaccacggcgccgacgtcgaccaatgtcggaccgatggcgtctcaagtgatcgggtcgaccgggctcggcggcgcgcatgccaatattatgccggggctggtgatcagcttcatcattgccctgaagggcaattacccgacccgtccgtgaggagaaggcgatcatggcagatccgttttacggtgaaatccgcgcattcacgttcgccttcgcgccggcaaactgggcgtattgtgccggtcaggaggttcagatccagcagtatcaggccctggcggctgtgatcggtaccatgtatggcggcaatctcagtcagaacaagatcaacctgcccaatctgcagggccaggtggcggtcgggtcgggaaccggtgtcgggttgacgccacgcaccgtcgcgcagcagatcgggaccgagaccgtgaccttgtcgatctcacagatcccgccccacactcacacagcccaggcactcaacgaaaccgccacaagtgatcagacactgaccccgtcagccacggcaatgctcgggcgtaccgcgaatgctgccccctatgcccagtatccaaacccgctgccgtcgccctcgccggtagtgatgatggatgtgcgcagcctgacccaggtcggcagctatcaggcgcatgaaaaccggcagccggcgctgacgctgaatttctgcatctgcgtgtatgacgggttcttcccggtccggccgtcctgaccggggacgctttcaacatcctcaggggccgggggcggcaggccgtctccggcccctgatgcgttgcggccgtgacaatcgccacgtcagccgggccctgtggatctgcggtcttgccgcgcgatgtcgtcccgcgacatgttgaagaggctgcggccccggtggccgcacctccggcatgaccgaatgacgacaaagagggcgagatcatgtccgacgccacctcccgatccggccccggcggcgcgaagccgaagggggccctggtctgggatctgccgacccgcctgttccactggctgctggccgcagccgtgatcggggcctgggcgacgggtgaggggccgcgccaggttcatgtctggtgcggctatgcgatcatcgtgctgatcgtcttccgcctgatctggggggtgatcggcggtcgccatgcccggttcaccgatttcgtgcgcgggccgaaggccgtggcgctgcatctgcgcgagctgcgcgatgcgaagacggcgccgcccgaggccgggcacaatgccgccggcggctggatggtgctgctgctgctggggttgatcggcctgcaggtgacgctaggcctgttcaccgacgacgacatcctgttcgtgggcccgctgggagaactggtgtcctatgacacccgcctgcagatcaccgcgatccacacggtgctgggcaatatcctgccctgggtgatcggcgtccatgtcgcggcggtgctgctctactggatcgcccgccgccagaacctgatccggccgatgatcaccggctacaagccctgggtgtcgccggtggaggtgaagccgctgccgccgcgggcgggctccctgccacgcgccgtccttgcccttgcggtcgggatcgccgtcgtggtggcgatcatggtctggggcggctagcgggccgccgtagtctgccgacagcgaaacggcgacacctcggggtgtcgccgtttcttctctgtcaggtagatgcggtttacttcccgcgataatcgttgtggcaggcgccgcaagccttgccgacatcaccgaaggcggccgcaacggcgtccatgtcgcccgaccggccggtatcggccagttcctgggcggcctggcggaaattgctggcggccgcttcgaagcccgcacgatccgtccagatgctggcgagcgccttggtgtcgccgctgtccgatccggccgggaacagggtcgggatacgttcggcataggccaccatcgcctcggccggggcgatcacggcatcggccgggccgccgccctcgaccgctgccttcacggtccccagctgtttgcgcatggtctggaagccgtcctggcgttccttgatcacatcggactgggcgtaggccacgccggccgcgatggtgacggtcagggcgcaggccgcgccgatcctggtcaacaaggtcatctgtctcgtcctcgtggaggcgtcatcgccttcgtgggccggccgactgtctggtggccatgccgtgaactacggtggtgatcccgcgacggatcacggaacgcacacagtctagcccgtcgccgtgacttttcccgtgcggaagaccacaagatcgatctttcgcagcaggctgcggcattgcgtcgcagatgatgccatcaggtctaggctttggcacagatcaaggcgggttcatggtgcaagacctagtcttgcagccgccggacggggtccggcagccgggatgccgtacccaggtccgcaaaggggcaggcatcgaccggttgtcttcacaaaaagaagcaccggctcgtcccccgcagccggtcatgaagatcgggaaggcacatcctatgtcgctctcgttgccgcgcctcaggaacgcgaccatcggcctcaggcttgccgtgatggtcgggctctccgccatcggccttctggcgcttgcgatcatcggcgccttcgaccagcgcacccagatgctggaagatcgcgaaaggctggtccgctcctcggtggatgccgcggccgccatcgttgcggccgaagtgaagcacgccacccccgccaccgccgatcaggccaaggctgcggcgctgcgggcgctggaggccatgcgcttcaatgatggtgaatatgtctggggtcaacgatctggactatcggatggtgatgcatcctatccagccgcggctgaacggccaggatatgagcgacttcaaggatccgaccggcgacctgatcttccacaagatggtcgacgcggccaccgggccggaaaagtcggggctgctgacctatcactggccgcgcccgggcggaaccgagccggtggagaagctgtcctatgtgaagctggtaccggaatggggctgggtgatcgggtccggcgtttacatcgacgatctgaatgccgagcttcaggcggcgatgctgcgcaatgccctgtgggcggggctgctggcgctggttctggtggggctggctacgctcaacgcgcgggggctgtcgcgtgagctgcgcggcctgaccggtgccatgggccggctggctgatggcgacgtgacggtcgagatccgcggcaccgaccggcgcaacgagctgggggagatggcgcgggcgctggaggttttccgcgacaacgcccgtgagcgccagcgcctgcaggcggaacatgatgccgatcaggccgcccgcgatgcccgtgccgcccggatcgaggcgttggtgcgtgatttcgatctggagatcgccgagctggtcgaccaggtcgccggggccgccaacgagcttgaatcgaccgcggtcgaaatgacccgcatcgccgaacagaccaatgcccatgccggctcggcctcggctgcaaccgaacagacctcgaccaatgtccagaccgtcgcggcggccaccgacgaactcaccagctcgatccgcgagatcggccggcaggtgaccgaaagtgcgcgcatcaccgccctggcggtgcgcgaggccgatgccaccgcctctaccgtccacggcctggccgaagcggccgaccggatcggccgggtggtcgacctgatcaacggcatcgccgcccagaccaatatgctggcactgaatgccacgatcgaggcggcgcgggccggtgatgccggcaagggcttcgcggtggtcgcggccgaggtcaagaacctcgcccgccagaccagccaggcgaccgaagaaatcgccgcccagatccgcgccgttcaggctgagaccgatgcggcggtggatgccatcggcggtatcggccgtcgggtgtcggaagtcgatgccattgcgaccaccatcgcctctgccgtggagcagcaggcagccgcggcgaccgagatcgcccgcagcatttccgaagcggccaacggcacccgcgacgtggcggaaaccgtggtcaaggtctcggccgaagccagccgcaccggtgccgccggccgccaggtgctcaccgccggcggcagcctggcccagcgtgccgacgtgctgcgcggcgacgttacccgcttcatcgaagaggtgaaggtggcctgaggagggccacccgccgcctgcaacgaagaacgcccccgtcacccgaaggtggcgggggcgtcttcgcgccggaccggagcttggatcggaacaggaccggcgaagggatgaaaggctgtcgatcaggcggcgtagcggttgatcgccagatcgtgggtgtcgatatcgggcctgtcgcccgagatcagatcggccagcacccggcccgagccgcaggacatcgtccagcccagcgtgccatggccggtgttgagccagaggttgcgatatttcgtgccgccgatgatcggcgtgccgtccggcgtcatcgggcgcaggccgcaccagaagctggccgccgccacgtcgccgccctcggggaagagatccgagaccgaatgctccagcgccttgcgacgaccgtcgcgcagcgcaaggtcgaagccggcgagttcggcggtgccgccgacgcggatccggtcgcccagccgggtgatggcgatcttgtaggtctcgtccatcacggtcgagaccggtgccagttggctgttggtgatcggcaccgtgatcgagtagcccttcaccggatagatcggcgccttgatgccgatctgcttcagcagcagcggcgaatagctgcccagcgccaccacatagcgatcggcggtcagcacgccgcggctggtcgagacgccggtgatccggtcgccttcggctgcaagcgcctggatgctggtgtcgtagaggaaggtgacgcccaggcgctcggcctctgcggccaggttctgggtgaagatgtggcagtcgccggtctcgtcgcccggcaggcgcagcccgcccacgaatttgtcgcgcacgcgggcgaggcccggctcgaccctgatgcagccgtcgcgatccagcacctcgaaggcgacgccgctgtccttcagcaccttcacgtcgccatcgatgccgtccagctgctcctgcttgcggaacagctgcagcgtgcccatggtgcgctcgtcataggtgatgccgatctcggcgcgcagctccttcaggcagtcgcggctgtattcggcgatgcgcaccatgcgggccttgttgaccgcatagcgctcgctggtgcagttggccagcatctgcgccagccacgaccactgatgcatcgacagcttgggccggatcttcagcggcccatgctccatggtcagccacttgatcgccttcagcggcacgcccggcccggcccagggggccgaatagccgggagagacttcccccgcattgccgaagctcgtctccatcgccgccgccggctggcggtcgacgacggtgacctcatgccccttgcgggccagataataggccgacgcgacaccaaggacgccgctaccgaggatgatgatcttcacaggctctgcccagtcttcgaaggtggcggcagggggccgccggggtgcgtggggtgtgggtggcgggacggctcggcggtgctcagccgttcaggtagcggcggtgatagcggttgcccaggctggtcagcacctcgtaaccgatggtgccggccagggccgccacggcatccggggtctgatcggggccgatcagctcgaccaggctgccgggcttcacggcctcggggggcaggtcggtcacgtcgacggtaatgctgtccatcgacacccggccggcgatcggggccgcccggccgtcgaccaggacggcgccgcggccgctcaggctgcgcagccagccatcggcatagccgaccgaaacggtggcgatgcgggtcggacgatcggcacggaagcgccaggaatagccgacatgggcacctgccgggatctcgcgggtctgcaccaccttggccatcagccggaccacgttcttcatcgggttgggcagatggggctgcgggttcaggccgtagagcgccgcgcccggccgggccagatcgaactggtaatccgggcccaggaagatgccgctcgaattggcgaacgaggcgggggcgtcgggcagcagcgccttgcggcggcggaaattcgccagctgctcggcattggccggatggtcgggctcgtcggcacaggccagatggctcatcaccgcctcgacgatgatcccgtccagcaggtcgggcgtggcggcgatgcgggtgatgtcggcctcgggcaggcccatgcgcgacatgccgctgtcgatctgcacgaaggccggcagccgccggcccagcgcccgggcgagaccaccccaggcctcgatctgctccatggaattcagcaccggtaccagcccggcatgggcgcaatcggcttccgagcccggcatcggcccgtgcagcaccatgatggcgcagtcgtcgggcagtgcctgcttcagggccaggccttcatccagatgggcgacgaagaaatgccggcagccggcctcatgaaagaccggcgcgatccgtgcggcccccagaccataggcatcggccttgaccaccgccgcgcaggcccgcccgccaaggcggctgcgcagcgccaggtaattctcgcgaagggcggcaagatcgatggtcaggaaggccccggcgcgggctgccgcggcatcatccgcggtgcgggggcgtgtcgtctcccggtcggacagggcggcgctgacgctcacattcatggcatgcggctttcgatcggcggtcggctcgggcggggatggcactccacacagcgtatgaacaaagatcgtcgattgtcttgccgatctgccgcagaatcatcgaagatatcggggcatacacaattttctgcgagggaaaccgcagatcatgccgctgcatctcgacccggtcgacgaccgcatcgtccgcctgctcaggaaggacggccgcatgagcaatgcgcgcctcgccgaggccgtcggactgtcgcaatcggcctgcctcaggcgcctgagactgctggagaaatccggggtgatccgcggctataccgcgctcatcgacctgcccgccgacgaggaaccgacggtggtcatcgtccagatcaccctggagcgtcagaccgaagaggtgctgaaccggttcgagatggcggtccgtcgctgccccgaggtgcgggagtgctatctgatgaccggcctgtcggactatctgctccgcgtcgagaccgaggatgcggccgcctatgagcgggtccacaaggaggtgctctcacgcatgccgggcgtggcacgcatccagtcgagctttgcgatccggacggtgatccgcaaccgccagccggtgtgatgcggaacctcggatgccgtgaccgcagccggatggccggccgtcgatcccatggcgatgctcctgccatcgacaacgcaggaggagcgaccgatgtcgcagcttgatggaaaggtggcgatcgtgaccggggcgagttccgggatcggttacgaggccgcgaaactgtttgcggccgaaggcgcgcggctggtggtggtcgcccgccggcgcgaggaactcgaccggctggtggaagaggttgccgcccggggtggggaagcggtggcggtcgcaggggatgtgcgcgatgacgccgtggcccgggcggcggtcgaggccgccgaggggcaattcggcgggctcgacattgcgttcaacaatgcgggtctgaccggactggcggtgccggtgaccgggctcgacgaggccgactggcggatggtgctggatgtgaacctgaccgcggccttcctgggcgcgcggcatcagatcccggcgatgatcgcccgcggcggtggctcgttgatcttcacgtcgagctttgtggggcccgtcgtcggctttccgatgatgggcgcctatgcggcggccaaggcgggggtggtcggcctaacccgggcgatcgcggcggaatacgggcaccagggcatccgcgccaatgcgctgctccccggcggcaccgacaccccgatgggccgcggcgccatgccgacccctgaagcccgcgctcatgtcgaagggctgcatgccctgaagcgtctggcggaccccgccgaaatcgcccgctctgccctctatctggcaggcgacatgtcgagcttcaccaccggcacggcgctggtggtcgatggcggggtctcggcggtgcgctgagatcagtcgtcgagcgggatccagatttcgtaaccgccgtcgccggtggccccgtcgaagctttcagggtagcgctcgaaatccggcgcccgggccggggtcacgccatgggtcggcagccagtggttccagatggtatggaccaggttgcgaacctcggagatgtgccccggccaggcgaagaccagatagttgcgggccggcagttccagacgggtcagttcttccggcaggccgtcgaagccggtgacctgggcaccggccagatagtcgaagccgccttcggcatccccggcatggcacacccccagcgatacgccgtccagccgcccgggcagtggctcgtattccatgaccagtttctgccagagggccgggatggtgccgatggtgctgatgtcgtagtggctgctgaggccggcgatgcggagcgggccggtacgttcggtgcgcggcggcggcagatcgtggatgatggtcggctgcatgatggcggtctccgaaaacacattgtggacgggggaatggcgcaagggggcggcgagggcggccgtgcggaagcggacgggggtgaccccgaaccggtcccggaaggcccgggtaaaggcggcgtgggagccgtagccgcagtcgagtgccacggagaggatgtccggcgcaccagccgccagcaggcgggcggctgcgtgcaggcgtacctcccgcagccgccccgtcaccgtgccgccggtggcggcggcaaaggcccggcagaggtgaaaacgcgacacgccggcgacctcggccatgcggtccaggtccagcgcctcgcgataatggccgtcgatgaaccagagcaccctgtccaccggcgtatcggccatgctttgcctctcctcgacgttctcgaccacatgatgatggcatgatcggccagggccggtttgatcgcgcttgccgtcatcgccattctttccagagaaagcgactctttccggagaaggcgaccaggaccatcacgaaggacaggttcaatgacgccggctgacgacccttatgatctcgtgcgcttcgtgaccgcccaggcgccggtcttcgatcaggcgctggcggagctgcgggcaggcgcgaaacgcagccactggatgtggttcatcttcccgcagctgcgcgcccttggccgcagccccacagcgcagcgctatggcatcggcgatgccgacgaggcccgagcctatcttgctcatccggtgctgggcccgcgactggtcggtgcggtggagacggcgaccgccgcccccgccgcatctctgcacgcgcttttcggcagcccggacgacctgaaattccggtcctgcgtcaccctgttcggggccgtctcggggcggccggtcttccagaccgccctggaccgctggtgtggcgggatgcccgatcccgccacacgcgatctgctcgcctgatccggtcgccggatcctcagacccggattctcaggccctgatgccggccaggaagcggtcgagctgggtctgcagggcgcctgcctgacgcgacagctcttccgatgcgccgagcagctgggcggcggcgctgccggtgcgcgaggccgcttcgccgacgcccgcaatcgcctcgctgacctcaccggtcccacgcgaggcctgatcgacattgcggccgatttcgccgatggccgcattctgttcctcgaccgccgcggcgatggtggcggcgatgccgtcgacctcgcggatcgcagcagcgatcgcctggatggcgccgacggcgtcgcgggtgaccgcttggatgtcagtgatctgggcggcaatgtcgccggtggcggtcgccgtctgggtggcgagcgatttcacctcgttcgcgaccacggcgaagccgcggccggcatcgccggcgcgggccgcctcgatggtggcgttcagcgccagcagattggtctgttccgcgatgtcggagatcagcttcaccacattgccgatccgctcggccttctcgcgcaggccctggaccacggcattggtgccctcggcctggtccgcggccgtgcgggccttggcggcactttcctcgatccgccggccgatctcgttgctcgatgccgaaagctggccggtggcggcggcgacggtctgaacattggtggaggcggattcagccgaacgcagcacctgatgcgcccggcgttcggtgtcttcagcagtgcccgaaagggcgcgggccgagctgcggagctggtccgccgagccggagagccccgtcaccacgccctgcacctggctttcgaagctctgggcgaggcttgccatctcggccttcttgcgcgcctgggcgtcgcgctcggcggactcctgccgggcccggaagtcggccgcctcgatcgcattggccttgaagaccgcgaccgcgccggcgatgtcgccgatctcgtcgcggctggcgaccttcggtacctcgaccgtcaggtcgccgcgggcgagggtgagcatcaccccggtcagccggcgcaacggcctgagcgccgccaccgaccagaggccgaacagcaggcccaccgccagcgccactgcacaggcgatgatcatcagctcgcgaaagccgctcgccttggctgccgcaatggcgcccgcctcctgattcttgacctcctgcaggtcgatgaaggcgttgatcgccgccagccactcggtgaaggcagggcgtgcgctggtgatcagaacccgggttgcgccggcggtgtcgcccgtctcgctcagccggatgatctgtgcggccatgggcatcgtccgggcttccaccgccttgatccggtcgagccgggtgcggtcttccgccgtcatctccacaccggcggcgatcatgccgtccagggcgcgtgccgcctcggcataaaagccttccagccggcggatgtcggccacgaccttgcgacgttctgcggcatcctggatcaggacgaggtcgcgcagcgcaatggcgcgatcatggacgctgccccggaaattgatggcgtggcgctgcttgaccgaattgacggtgttgatccgggtgagggtatcgtcgatcgtatcgacctgagaaatacccacggccgtgagcgccgccagcatcatgagcaggacggcaaagcccaggatctgcctgacgcgcaggctggtagcggtaaggaactgcatcgggcgccttgcaacggaggtggacgcggcagaagacgagacggcaggatcacccgtccggtcaagccttcatcgctgcaacgctgcgttcctctcccggatcttgtgcctgatcgagcggtcacttatttccgtgggctgtgaatgcgagtgccgccagccccgaggcgccggtgagcacgacagccatcgccagggtgggcggcagcggcagcgcggtgacaagcagcgtggcaagcgccgccatggccatctgcaggaagccgagcagggccgaggcgaggcctgcccggctgccgaagggctgcagggtgatcgcggtgccgagcgggttgaccagacccatcccgaacaggaacactgaaagcgccgcggtaaagatcccgatgtccggcgtgctgccgcctgcggccagcgccaggccgccggcgagcgccagcacggcgccggcgcgtgcgacacggccggcgcccaaggcatgggccagacgcggcgcagcgaagccggcgccgaacaccacgaacaccgtggcggcgaagaacagccccagctccagcgaggtgaagcccatgccggtcatcagaatggcgggggtggcgccgaagaaggcatagagcccgccgagcaccagcgagacggcgctggccggcaggatgaagcggcgatcgcgggcaagctcgacataggcccgggcaatgccgccgatgccggcagggcggcggcgatcggccggatgggtctctcccaccacggtcagatgtgcgatggcgagcaggatgcctgccgccccgaccagcacgaaggccgcccgccagccgaaggccgtgtcgagggcactgcccagcagcggcgagaagccgggggccgccgccatggcgaccatggtcaaggccagcgcccgggccagggcctcgccgtcaaaaaggtcgcgggcgatggcgcgggaaagtaccgaggcggcacagacgccggccgcctgcacgacgcggccgatgatcaggatgttgaagtccggtgctgcccagcagatggccgagccgatcacgaacaggatcagcccgcccagcaccagcggccgccggccgaagcggtccgaggccggcccgaccaccagctggccgagggcgaaggccaggaagaagctggtgagggtgagccccagagcccttgccgggacatccagtgccacagccatcgaggggaaggccggcaggatgatgttggtcgagagcgtgcccagcgcggccagcccggcgagcagggcaagcatgccgccggtcaggcgccggggggctgccgtggccgtttcggggatggcggtttcggcagccgacatgaccggactcctgaagattatatgtcagatatcatgattatgggcccgctcaggccgcgcgaccggccagatagcgggccgccggccgatcgtgcgacaggttgggagcaagcgtcgcacgggcggcatcataggccgcccagtcggccgcatcgggcagggatggaatggtgaccagctcaccggcatccagcccggccagggccgcatcgaccatatcgccggcctccatcaccatatgggcggggaagtggtccaggctgccgccggcacgctcgaagatctcggtgcgggtgaggccgggcagtaccgcctgaaaccggacgccgctgcccgccaattcagccgccagcgcccgggtcagctccaacacgaaagccttgccggcgacatagggggcgttcatccgctccgggatcagggcgaccaccgaggcaagattgatgatcgtgccccgtccacgcccggcgaagacctgcgccgcggtcagcgtcagccgctgcagcgcgcccacgttcagggcgagcatcgcgtcatagccctgcggcggggtcgccagcgccggcccggcgggacccagccccgccgcattgaccagcagcgacagagcggtatccgtctcgatccgtgccgccacggcgcccagcccttcggacgtcgccagatcggcggccagaacctcgaccgcgaccccatgagctgcggcaatccgttccgcagccgcttccaggcgcgcccgatcgcgcgcaaccaggatcagatcatgcccgcgttgcgccagcctctgggcgtaaaccgccccgatccccgaagaggcaccggtgaccagtgccgtgcccttgcctgccgtcatcgtccttgtccctccaagccgtcccgttcggtgcgggttcggattatatatgacgatcatcattaaaaatggcaaggacatccagggcgaaatgttctgcgccaccatcgtcacccaagccagagggtgaagttatagcgatgccagtctgccggaacatcgcgcagcggatcgacgccatgcgactgatcggcatcgacatcgaaaaggatcgcccgattgggcaaagggtcgatgacccgttccccccgggcggtgaagacgcgaaaggtgccccccatgccggggtgccagtcatcattgaaataaagcagcagacaaagtctgcgttccgaggcgcggtcgtcatgccgggtggaaaaatcatcccggcccatgcgccggaccaacagatcggcgatcgccccggtgtcgatgccggtcagtgtgccaagccagtgcctgaagtcggcgcggccggccaggagtttgaaacccacgatggcgagcatgccgggcgccagctcccggcccttcttgggggcccgatagtttccgtgacggaacaggcgccgatccgccggggtggcattgaaccgttcggccgaggtcagttcgccgctggcgtcgaccccataatgggtcgtccagtcgcaatccgtccgcagaccctgggagatccgcgcatatcgctctggcagcaggacatcgtccagtatcagcatgcggaccgggtccgcttcgaaatcggcgcgcagctttgatgtccgcgtgtcatcgaggtagatgggattgatccacttttccaacatcgctcggtaaaattctcctgtgagatgattttgtcaggggctgtcgagcaagtgctgcaagactgtgatgtgatgcctgccctgtcgggaaaatatgacgcctccggagtccatcgatactcgtccataggctatgctctgctgaagggaggcgtaagggggcgtctttcagtgtcggaattgggagcagaacatgagcacgagcattgaacaggttggcaagcagggtgaggcgacggccgatgtgacgagggcttccgtgaagcgggtgtggtccgcaccacagttgcagtgcgtggacctcgacgtggtcacccgggcgcaggccggtatcactggcgatgggatcaccgtctcctgattctgacggagcaggtgcggcgattgccaccgccgcacctgctgatttgacgggagcggccgagcgctccgaagcagacacagctgtttagggcctgatcggcggcgtctgtactcattgaattccgcaatgcggccacgcattccgctgatttgacccatgcccgcgcccccctctatcgtttcgggcgatgaggacggcggccggttgcgatacccctccgccatccggcgacgtggcggccgccgttctcgtctgcagccgtgctgcgatccccgccgcatccgcttccgcccgcgttgaggaattccccgaaccatggccctcgatcccgaaactctggaacagctggtcggcaccgtccggcgcttcgtgcgtgagcggctggtgccgctggagcagcaggtcgccgataccgacgagatcccgcatgaggtggtcgccgagatgcgtgagctcggcctgttcggtctgtcgatcccggaggagttcggcgggctcgggctgtcgatgtccgaagaggtgaaggtcgccttcgaactgggctggacctcgcccgccttccggtcactgctcggcaccaataacggcatcggcgcgcagggcatcgtgatggacggtacggccgagcagaaggcgcagtggctgcccaagctcgcctcgggcgaggtgatcgggtccttctgcctgacggaacccgaaagcggctcggacgcggcgagcctcaggaccagcgcccggcgcgacggcgacagctatgtgttgaacggcaccaagcgctacatcaccaatgcgcccgaggccggcatctatacggtgatggcgcggaccgacccggagaaacgcggggcctcgggcatctcggccttcatcgtcgagcgcggcacccccggcctgacggttgcgaaacccgaccgcaagatgggccagcgtggcgcccataccgccgatgtgatcttcgaggattgccgcgtgccggcctcggcggtgatcggcggcgttgaaggcgtgggcttcaagacggcgatgaaggtgctggatcgcggccggctgcacatcgcctcggtctgtgtcggcgtggccgagcgcctgatccatgacgcgctcagctatgccatggaccgccgccagttcggccagccgatcgccgagttccagctgatccaggccatgctggctgacagccgcaccgaggcctatgccgggcgctgcatggtggaggatgccgcccgccgccgtgatgccggcgaagacgtcaacatgctggcctcgtgctgcaagctcttcgcgtccgagatggtcggtcgggtggcggatcgggcggtgcagatcctgggcggtgccggctatatcgccgattacggcgtcgaacgcttctatcgcgatgtccgcctgttccggctctatgaaggcaccagccagatccagcagatcgtgatcgcccgcaacatgatccgcgaggcgcgttcatgaccgccgctgcgcctgctgcgacatcgcgtttcgaggatcatgtcggggacccgcatcgctatcgccgcctgcacgaggtgatggaggcggccgcccgcgcccatccggacaagcctgcgatcatccatgacgacggccggatcagcttcaccgaactgatggccgagagcgaggccctggccagccggctcgaccgctggggcgtgcggccgggggaccggctgctggtggtgtcggagaatgcccccgccctggtcggcgcgatcctggccgccagccgccgcgatgtctgggtcatcccgctcaatgcccggctgaccggagcggaagtcgatcgcatcgccgcccattcgggggcccggcgcatcctctataccagcggtgtctcgcccgaggcggcggcccatggcgcgcgtgccggggcggaggagatcgatctgggcgcgctcggccgggtgatgctgtcgcccgaaaaccctgaggcgatgcccgagccggtggacgaggggccggggcaggtggcggcgctggtctataccaccggcaccaccggcaaccccaagggggtgatgatcacccatgccaatctgatcctggtggcggatgaatccggccgcggccgccagatcacccatcgcgacgtggtctatgccgtgctgccgatgtcgcacatcttcggcctgtcgtcggtgctgaccggatcgatgatgcgcggggcgacgctgcgcctggcgccgcgcttcgaccccgatgccgtcttccgcgccctggcggacgagggcgtcaccatgttccagggcgtgcccgcgatgtatcagcgcctgctggcggtgctgaaatcgcgcggccagacctcgatcgcgcggccgcatctgcgctattgctccgcaggcggctcgccgctggatccggcggtgaaggcggcagcagaggcgctggtcgggacctcgctccacaacggctatggcctgaccgagacgacctccgccgtgtcgcagaccacgccggccgagcccgccatcgacgacagcgtcggccggccgctgccgaatatggcggtgaaggtggtggacacagaggaccgggaactgcccgacggccaggtcggccggctctggatccacagccccggggtgatgaagggctattacaaggcgccggaattgacggccgaggtgatgaagccgggcggctggttcgacaccggtgatctggcacgcctggagggtggccggatcttcatcgccggccgggccaaggagctgatcatccggtcgggcttcaacgtctatccgcccgaagtggagggggtgctcaacgctcatcccgatgtggcgcagtcggccgtggtcggccggacggttccgggcaatgaagaggtggtggccttcgtccagccggtgccggggcgggtgctgacccgcgaggcgcttgccggctgggtggcggaacggctggcgccctataagcggccggccgaattcgtgatcatggatgccttccctgcgaccgccaccggcaaggtgctgaaggcgcagctgaaggatatggccgcgcagggttgatggtcgggttgatggcggggatcaacccccatcatcaaccccccatcatcaaccctacctctgcgccgggcatcaccccgccgcccgcctttgcccggcggcgcggcgggtttccagccacaggcaggcactgacgatgatcgccgcccccaggatcgatgccaggcccggcgtcgtccgccagatcgcccagtcatagagcacggcccaggcgaaggcggtgtattccagcggggcaacccgctgcacttcgacccgggccagggcccaggaaatcagcgcgattccgctgacgctcaacccggccaccaccagatagccggcaagctgggcggccgagaccggcgtccagtcgatcagcgccaccgggatcgcaaccgtgcccgccaccaggttggcgctcagagccagcgctccgatcccctccgacggcgccagcttgcgggtggtcacgatgacgccggcatagcccaccgttccgatcagggccgccacatagcccgtcagcggaccatggccctgaccgtcctggatcatcaaccccggcgacgccaccaccagcacgcccagaaagccggccgaaagggcgatgcccgcccccttgcccggccgttcgcccatcagcgcccaggcgagcagcacggtgacgatcggggcggtgaacaggatggcataggcctctgccagtggcagcagggtgaaggcggtgaagaagccgaagcctgcgatcgcgagcagcaccccgcgcagcagatgggccccgggccgtgccagccgccaggtgctccgctcgggcctgagcagccaccagagcccgacccagggcagagaggccgcggatttgagcagcacgatctggccgatgccatggtcgccgcccagcagcttcaccacgacatccatggtcgagagcaggcagaccgccagcagcatcgcgccgaccggccgggccccggcggtttccgcccggtcagacgcgctcatgcgccggatccgagcggcagatcgtagcggtattcgaccgaacggctcagatcgtgaagcgcgcgggtgagggggccgcgtgtgaagccctgcgcctcatagaaggcatggccttctttgaagcgggtgtcggtccacagcatcagatggcgaccgccggcatcgcgggcgtgttcgatcgcccgcaccagcatccggcgggcaaggccggaccgccgggcccgtggcgagacatagagcttgaacagctcgaaatggcccgcgggctcccgctctgccgccatcacggcacaactggccaggatcgtgtccgccgtcgccggggctgcgggatcgctgcctgcaaccgccacccaggcggcgccgccacgggcgccgacatggctggcatagtggcgcagctccggcagttcggcgtcgacatccaggatgcagcccggataggcggaccagcagagatcgatcagcgcgatcagcccgtctgcatcggcgtcgacgagtggccggatgaccggcaccggcagcgggctgacgagcggtgtctgagcgggggcggcgtcgggcatgggggcgcgtatccggcgatggcgggggacgtctgaagcctcgcccatctgcggtcgcgggtccatccaggatttctgggggtgaggggcagtgccgctgaaccacagccggaccgtcatccgcgcgtcacggttggtgtgatagagcgggcacatgacatcgacggagggcgacatggccggacgcggcatcttcagatccctgcgcctgcgcatcctggtgctgggcggcggtatcctgatcgtcggcttcgggctggcgaccgcctatgtgctgcatacccaggaagaggcggccaggcttgcggccgaccggattctggcggaaaccgcagccggccaggcggcggtggtggccgaagagatcggacgtgcggttgcgctggccgagaccatggcggccgggcagaccggtatgctggcggcgggcaccaccgatcgtgcggtcctggcggcggcactgcacggggtgatcgcggccgaagcgggggtggtcggcggcggcctgggctggcagcccggcctgcccgacggccggggtgccgatttccgcaacaccgaactcggcgatgccgatggccggttcgtgccctacatgtcgcgcaccgccgatggcggcgtggtgaccgagccgctgatcatggatgcggcggccgatgcctggtatggggcgccgatgcgcgccggccgcagcctggtgaccgaaccctatctctaccccgtcgcgggccgggacgtgctgatgaccaccgctgccgccccgatcctgcgggcgggcaagccggtgggtgtcgccaccgtcgatctgggcctggatgaccttcagcgccggatcggatcggcccgtcccttcggcagcggccaggtggcggttttgtccgccgacgggctctgggtggtgcatcccgatgacgcgcggcgcggcaggccggcgacggccccggcgatcgccggcatcctgaaggcggcggcccgccgccccgtggagcaggcggtcgacggtgccgatgtggccggccccgccggtccggtcctggttcgggcgctgccggtggatctgggccatggcgcggcgaaatggacggtgctggtcacggtgcccgaagcggcggtgttcgccgaagcccgcgccgtcgagcggcggctgtcgatcgggctggtggtgatcgccctcggcgccgggctcgccctgttctggatgggccatgccatcgccgcaccgatccgccggctgaccggcaccatgcatcagctggccgagggcgatcgcgcggtcgaggtaccggcaaccgtccgggccgacgagatcggcgccatggcccgcaccgtggtcgtgttccgcgacggtctggcccgggccgacgaactggcccacgaagccgaacgccggcgcgaggcccatgaggcggagcttgcggccgagcgccggcgcatcgccgatgccttcgaacgggaggccggacggatgctgcaggagctgatcgcggcggcggcacggatgcgcgacacctcggccgagatgggccagatgtcggcgacctcgatcgatggcgcgcgggcggtggataccgaatctcgggccgccgccgccaatgtccagaccgtctctgccgcggcggaagaattgtcggcctcaatcggcgagatcggctctcaggtcggccgtgcccgtggtgccgcggatcgggcggtcgaagaggcgggcagtgccgacagccaggcgaagcggctggccgaaaccgggcgggtgatcggccaggtggtgtcgctgatcggcgacatcgccggccagaccaatcttctggccctgaatgccaccatcgaggcggcgcgggccggcgaggccggcaagggcttcgcggtggtggcagccgaggtgaaggcgttggccgaccagaccgcgcgggcgaccgccgacatctcgggccgcctgggagagatccagggcgctgccgccgatatgggcacggcgatcgaccgggtgacggtcagcatccgcgagatgcacgagattgcgctcaccatcgcctcggcgatcgacgagcagggggccgccactgcggaaatcgcccgcaatgttcaggaagcggccaccgccaccgatcgggtgtcggtgcgcgcggccgaggtggggcaggcctcggaccggaccggagatgccgccgatgcggtgctggccggcaccgaggagctgacggccaccatcacccggctcaaccaggtggtgcgcgagatcctggcgcggatccgcgccggctgatcggcaacccccggcagatcgttcttgacgggaaggtgcgccatcgcgcaggcttccccgcatcggttcatcacgcgcaggagaggagggcagtcatgatcaccggcatctgcacgcatgcccgccgcttctcgtctgtccgtggccgctgcctggtatcggtatcgattgcgcgaatttcccgcccggtctctgcggaggccgggaccggcgccgtcatagggcgccggagcgacgatacaggcaccgcctgaccgttcggagacgaggtcccggtttcacaccggagggaccgcccggcggggcggtacgaccgacgggacccgatcatgaccgagctgcttcttcaggccaccgccgcgcccttctctgccgacctcacggccggcgatccgaccttttctcccgaagctgatcccgcacgcgaagcccggctcgtcgatgcctgggcggagatgcgtctggaccgccgggcccgcagtgcctgcgccgggcgcccgcgtgcggcccttcccgagatgtccgcgcttctgccggcgggggctggcgtggtcgaggcggcgctctgccgggacatgctggcgcgggcccggcgcatggccggtttcgatacgccgccgccgggcggggcggcgcatgcggccggacggcgccttggcctgctggcggatgccgatgccgcggcgggtgatgccggtgccgactggcggcgctgggccgcgcgtgcggaccaggacggcgcagatctgctccgtgcacgatttgcagccggtgacactgtcgatgcgtccggggcgatccgcggcatccgcgcggccctggggcgcttgctcgatcatctggcggtggcaccagccgggctgctgccgccggccgaccggctcgacatgcccgagatcctgctgctcgcccggctggtcgaaatcgatgccgagttgcgcgacgatctggaggcggctgatctgccggcgatgctggcccggctggcccggttctgcgccgacgagttgaccgccggctgggccgggctccgggccggtctgctggcgggggatgcagatgcccccgggcggcgggcggttgcggcggtcgcggcgcgcagcttcaaccatctggtcgcctggatcgcgccgcttctgcccttcctggccgaagaggcctggctggcgcgctggggtgccggtgccggcagtgttcatgaacgtctgtggccgtcggtggatccgctctgggcgacgccgggaaccatcctcgccaaccggcgcctggaccggctgcgggccctggtgcgcgatgtggcgggcgggcgcgagatcacggcggatgccaccgtcgagctggatctgcccgccgaccggcggccgccattccgtgaggccgagctgggcgccctgctgggggttggccggttgcgcctgcgcagcctgcccgccggtgcagcacccgcagcccgcttcgccgccgctggaccggtgcttgccgccacggcatgatcggggcatggctgatgctccgctccgcgatcccaatcccgaaccggggggtgcccatgccgatccggcgcttcggcccgagatcgcgcgggcgcgcaccattgcgcgcctgccgctgaacgcgatccgggcctttaccgccgccgcccggctgggcggcatggcggcggcggcaggagagcttggcctcacccccggcgccgtcagccagcaggtgaagacgctggaagaccggctggggctgaagctgttcgaacgtgaagcccgcggtgtccgcctgaccgccgtcggtgccgacttggccgatgccgcccatcaggcgctggacgggatggcccatgcctatgaacgggcgttggcccgcacggcgcccggcatcctgaccgtcggcgtggcgccgagttttgcaagcctctggctggccccccgcatcggcgggttcctgaaggcgcagcccgatctggccgtgcgcctcgacagccagcgtcaccatgtcgacctcgcccgcggcgaggccgatatcgccctgcgctgggggcgcggggactggcgcggtctggtggtgctgccgctcggccccgaacccctcaccccggtggcggcgcctgctttggctgccgcgctgcgtgcccgcatcgatttcggacccgcctgcctgctggatcaggtgcggctgcacttcgccgaactcgacgactggggttgttggttccgggcggcgggggtggcgatgccggaggtgatcgccgccgggccgggcggaccggtcttcagcgaatcgaccgccgtgatcgaggcggcggaggccggccagggcatcgctatcggccggccgtcgctgaccgccgatgctatcgcagccggcaggctggtgcagcttttccccgacatccgtgccgatgacggctggggctattacctggtggcgaccgaggtggggctgcgccggccggcggtggcggcctttcgcgactggctgatggcggaaattgcgaagatgccgcgctgaaccggccaacgctccatcaggcgccgccggtccagccctgccaggccggccagccttcgatcagcgcggcgaggcgttcatagcccgcggcatccggatgggcgccgtcccccgcccggacctctgccatccacaccggatctgcggccagggcatcgaaaaccggcagccagggcacacccaggcgccggcagatcggaccgagggcgtcgctcagtgcccggatgcggagattggcgtcgtcttcggcgatcggcggcgggccgatcatcagcaccggacgacgggcgccggcaacccgcagaatgccctcggcattggcgagactttcggccatcggcagcctggtgccagagggtgtgggcgcctccatgcggtcattgaccccgaaggcgaagatcagccggccgtcgacgccctccggcagccgggtgcggctttcgctcagccagcgttcggcgatgtcgcgactggtgtcgcggcggatgcccagattgtagagggtgagatcggcaccgcgggcgatggcctttgccgccacccggcctgcccagcccaggcaggtgctgtcgcccgcaccggcgacgaagctgtcaccgatcacgcagatccgcaggggcagacgctcctcgccgcccgccgtcatccgcgggcgatccggtcgagggcggtgcggtcggtgatcgtcacccggccataggcgcgggcgatcagcccgtcgcgggcccaggcgccgagcaggcgattgacggtctggcgcgacgtgccgagcatgtggcccaattcctcctgcggcagatgcagtgcgatccgtgtggcggtgccttcgacctctccataggcatcggccagcgccagcaggcgcttggcgagcctgcgatcgagcggcaggaaggcttcgtcttcaagggccgagaaggtcatgcgcagccggcggcagagcaggaccagaagatgagccgacagcggcggatgctccgtcagcaggcgcacgaaggcggccttgggcaccacgatcagctcgctttcgcccagcgccaccgcatcatgggtgcgccggccgccgtcgatgagagcgatttcgccgaaccaggcgccgggctccagcacggccagcaccagttcacgaccgtcatcgccggctgaggcgatacggaccgcgcccgaaatcacgccgaaaagggcgtcagcctcgtcgcccttggcatggatcagcccgccatccggcacccggcgccggctgcctgcatcggtcaggcgccgcaccgtgtcttcaggcagggacgaggagaggaagccgctctggtcggcgaaggggatggtcatctgacggggcggggctcgacgaagagacaggacaacgccttgaactgtcgcaggaccgacagacggcgggcagcgcatgatcctagcatgtttgtcccggaaccatcgtccgggcaaggggcgacaaccggccccgtcaaagaccttgagggaggacgtgccgtcacatgaacgccatcaccccacccgatgccgaggctcgtgccggctttcgccgcatgcaggagggtaccgccgaggattgggcgaagatcgccggcagtttccgcggctatgcccgggcgctgcccgaccggatcctggatcacctgaaactgctcgacggcgatttcggcggctttccgatcgaccggctgcatcattcgctgctgaccgcgacgctggcccaccaggccggcgagagcgaggaatacgtggtctgcgccctgctccacgatatcggcgacacgctcggcagctataatcatccggatatcgcggccgcgatcgtgaagcccttcgtcgagcccgaacatcactggatggtggagaagcacggcctgttccagggctattatttcttccaccatatcgggctggaccgcgacatccgggaacagttccgggggcatccgaatttcgaccgcacggcggccttctgcgagaaatacgatgcgccggccttcgatgccgatgccgcatgcatgccgctcgaggccttcgagccgatgcttagacgggtattcgccgccccgaagcagtcggtctacaagaaggcgatggaggactgatgccatgaccgcccagcatcccgccccgacgtccgatcctgcggcgaagcgccctgcgaccgatccggggccgatgagcgccgccgcggcccgctacggcaacctgccccgcccgccccgcttcgagcgggtggaagaggcccggctccacgccaagcagcgccttgccgcaggcttccggatcttctcgcgcttcggcctggatgaaggcgtcgccgggcatatcaccgtccgcgatcccgaacatccgaccactttctggaccaaccccttcggcgtgcatttcagccagatcaaggtgtccaacctgatccgggtcgatgaagaggggcaggtggtcgacggtgacgcgatctgcaatgccgccgccttcgccatccattcccgcatccacaaggcccgcccggatgtgatggccgcggcccatagccatggtgtctatggccgcgcctggtcgacgctgggacggccgcttcagccgatcacccaggattcctgcgccttctggaacgatcatgccgtctatgacgatttcggcggcgtggtggtagaactcgatgaaggtgaccggatcgcccgggcgttgggcaataacaaggccgcgatcctgcagaaccatggcctgctcaccgttggcgcctcggtggacgaggcggtgtggtggtatgtggccatggaacgctgctgtcaggtccagctgatggcagaggcggcaggcacgcccaaggtcatctccgatgcttcggccgcccaggcctattcggtcaccggcaccgcccaggccggctggttccagttccagcccctctatgcccggatcgtcaaggagcagccggacctgctcgactaggtcgtcaacgcggattggcacattcccgtggatgcagcgtttcgcgtaagacgctggtcgacgaggggatatcaggccatctggcaatggaagcggtggcgacgtccaccgcgccccttgccggagatccagaaaaatgaccgatcattcatctgatctggcgagcctcgtgccgcctgtggacgtcacccgccgcggcttcaccctcggctctctggcggtgggttttgcgctggccgccaggcccgtgcgggcggagacgcggatcacgaccgatgccgcggggctggaggcgggcgccttcaccctgccggtctcgggcttcgacgtgccctgctatttcgcccggccggcagggggcgaaaggctcgccaccatcctggtcgcgcccgaaatcttcggcctgcacgagcacatcgccgatgtctgccggcgtttcgcgcatgagggctttctggcaatcgccttcgatcccttcgcgcgtcagggggacgtcaccacgctgcccgacgtgcagaccatcatctcgaccgtggtctcgaaaacgccggatgcccaggtgatggccgacctcgatgccatcgcggctcacgctgccgccgaacgcggcggcgacccggagcggctgggcatcaccggcttctgctggggcgggcgtacgacctggctctataccgcccataatccgaaggtgaaggccggcgtcgcctggtatgggcggctggtcgggccgtcgaacgagatcacgccgcaccagcccgtggaggtggccgccgatctggcggggccggtgctgggcctctatggcggggccgatagcggcattccggttgcgacggtggagcagatgcgcgccgcactcgccgcggccggcacgccggcggcgcaggcgtcggagatcatcgtctatcccgacacgccccatgccttccacgccgactatcggccgagctaccggccggaggcggcaaaggatggctgggcgcgctgcctcgcctggttccgcgaccacggcctcggctgacggtcataatctgccatgtttcaggccggcggcgccgcacaggccgtcgccggccccagctgtcccacgcggcgggtgatgacccccgcccggcgttggatatagcgcgtgggctccgaggcgctccagcggcgtggattgggcagaaccgcggcgagcagtgccgcttcccgtgcggtcagcgctgcggcgggcttgccgaaatgggcctgggcggcggcttcggcgccgtagatgcccggccccatttcggcgacgttcacgtaaagctcgatgatccgccatttcggccagagggtctcgatcgcgaaggcgagcggcacctccagcgccttgcgcagaaagcccccgcccggccagaggaacagattgcgcgcggtctgcatggtgatggtgctggcgccgcgcagcggccggccgtcgcgccattcgtcgatcgcctcgccgaccgcgttccagtcgacggcgaaatggctgcagaaattattgtcttcggcggcgatcgccgaattcggcagggcgcgggcgatctgatccaggtcgcgcggccgataatccagccgcccctcttcgaccaggcggatcagcatcagcggcgtcgccggcgggtcgatccagcgataggcgaccagcatcgccgcccagaccgccagtatcgtcagcaccacggcccgtaccgcccgcaaaacccggcgcagcaggccaggcgctggccgggcggatcggcccggacgcggcttcgggggttggtcggtggtcatgcgcaggccaatcctcggtgcatggccgccagcatgcctgagcggggctgatgtcgccacgggaaaacctgtgtcagcttcggggcgcggctcagggttaaggcgatgtaaacccgggttgacctgtcgatctgtgggccttccggcaccggttgcgctcggacatgttcaatgttcggtcggagcgcccggctccggcgtcggatcgtcttgcccgaaggatgtgcgcatcatggctggccacccccgctctctctgccacgaggtcgacctgtcccgccgtctcatccatctgaggcgccggctgatggccggtgccgcgatgaccgtaatggtctggggggcgggcagccgcgacgaggttctggccgagaccattccggtcggctcgggtgatacccccctcaggcttgaagagctgtcggatctgccgacgacggtggagatcactgcgggggccagccggacggtgaccggcgatgcaccggcagtctcgtccgagacggcgggctggacgcttgagaatggcggcgagatcaccgcggaggggctggccgtggggctggtcggcagcaccctggtcaacggcagcgatggccggatcaccggtgctgccggcgtgcagatggccgatccggacggtactgccgggcttggggtcgagaatgccggcgtgatcaccggtcaggcaggtgccggcctggtggccgggggaagcggcctcttcgccctcgacaatcagacgtcgggtgcgatcttcgccgctggaccggctctggctgttcaggccgccgaggcggtggtgggcaatgacggcacgatccagagcagcaggaccgatggcgccctgatcgatgccggcaacgtgatcctcgccaatggtgcaaacggggtgatcatcggcgacgccatcggcctcggcatcaccggcggtgcggtcgaggtgacgaatgctggcaccattgccggcggggtcaacagcgcccagcccgtggcgggcggcattgccattcaggccgacaccgcaaccgtgcggaacgaggccggcggcatggtattggggcgcgaggccggggtcacggtcgaggcggccgatacggcagaggtcgtcaatggcggcgtgctgaacggcgtgatgatcgacggcgaggcgcaggccctgctgcgtaatctcgctggcggctcgatcactgccgaaaccgacaatctcgtcacgggccgcggcatcgtgcgggtggaaaatgccggcacgatcgaggctggcaggcccgggcggagcagcgaaatcggcctgattgcgggcacccgcgaaggcgcggaccggccggccgagaccatcctgatcaatgaaacgggcggccggatcaccggcttcaacggtgcggccgtgctttccggtgacgtgatccggatcgaaaaccggggcacgatcgacggtatcctggctccggccgtcagcgccactgccgatgtcacccatgccgtcaacgagggcctggtcgccggtggcaccggcttcctgatcgatggcgatgccactctgaccaacgctgccgcgggcgagattctgacctgggggacggcggttttcaccaccggcgccgccgatgtggtcaatgccgggcagattgtcaccgtccacggtgtcgtgcccgccgatgtcccggacggtgcagtggccgtgggcagtggcagccatgtcgacaatcttgcgggcggcgtgatcctcaaccgacgctggtccggcattgccgtgtcggacggtatgggggacgaggatccggccgaccgtgagacggtcatcgagaacgccggcctgattcgctccgaaggctccggtcgaggggtgattgttgacgtggcgggacgggtgacggtctccaaccgtcagggtgggaacattctgtcggctggcgccgaaggtatcctgcttcaggccggcacggccatcatcgataatgcaggagccattatcggcggcagtgccgatgaggacgcgcagatgatcgcgggcctcgccgtcctcggagacaggaccgtggtgaccaaccgggtgggggcgatcatcgccggtgacgggatgggagtctccctcgccgccgcggatgaagcggcgatcgagaatgccggcttcatcaacggcatgatcgtcgacggtggcatgtccacccggctggacaacgccgcgacaggtgttgtggctgcctatgaacagaacgggctgctcggcgaggcgatcacggtcgacaatgcgggtgtcattcagggtggggtctctgccctggttcttgggggcgacgcgggtcgggtcgtcaatacgggaaccatcgaagggggcagcggcgccggcctcgcgagcatcacgacggccggaaccagtgttgccaacagcggggcgatcaccgggggcgtggtcggcatcggcaccgagggggggctcacgctcgagaatagcggccggatttcaggcggcttcgttgccgtcaaggcggtgggcggttcaaccatcgacaaccgggccggcggcgagatcgtctccgaaggctctgcaatcgagatcgtgggcgaagcgctgatcaccaatgccggcctcatccggtccgagcagggcattgcgatcacggtcgaaggcgatgcggtggtcgacaatgctgcgggcggtgtcatcgaggccgccggcccggctcttctgctggcgggcacggcatcgctcaccaatgccgggcgcatatcgtccaccgatccgaccttcggcggcgacgatgcggaaggggtcgccattctggccggcagcggcgggctgatcgcgaataccggcgtgatcgaaagcggcgccggtgcggtgatgatcggcgatgtggccgatgaagcgaatgaatttgagaccgccgtcgccaatgatggcctgatccaggcgcgtggtgccggcgtggcactggcggccgatatcgtcggcgggctggagatcgccaataccaacaccatcgttgcagctgatggacccgccatgcaggtcgtcgccggcgaggtgctgctgggcaatggcggggtgatcgtcagtgacggcggcaccggggtccggctgcaggcgaataccgtgtcggtctccaatggcgccggtgcgctgatccgcggcggcggtggtggtgaggagaatggcggcatggccgttctcggcaggacggtcgatatcagcaatgccggtgtcatcacgggcgtgttgaccggcctcggggccgccggtgaagaggttactgtcaccaacgatatcgacggggtaatcgccggtgatatcagagggctcggcctggccgccgcacgtaatgcgacgatcgacaatgccggctacatctccggcctcatggcggcggccggcgatggggtgctcagcctgcaaaatggcgaaaccggtgtcattgccggcaacgcccccaacatactcgccggaccgcaggtcgtcgtcgacaatgcggggctgatcagcggcaacacggggctgttgatcgaggccggatcggtcgtgatctccaacagcggccggattacgggtgtggacggcccgactgatggtctcgaagatatcggcgacctggacagcagcatcggaatcgtcgctctggtcgatggtaccgccgagatcgacaacagtggcacgatcagtggcagtgtcgcgggcgtcctgatcgaaggtgatctgcttctggagaacaccggcacgatttcagggggcgaagccggcgtctcgtttgtcggtggctcgatccataatgccgagggaggcgtcatctcgggcggcagcggcattgtactccttgatccggaagctttggcgggattgatcaatgccggcgtgatccaggcgaccgaagatgtggccgtcaacttcggcagcggggccatctacaattcgggcagcattgtttcgctcggtcgctacgatgaggatgaccctctggccgacccggacgagatctatgccgccgttctgctggagggcggcagtctggtgaacgcggccggcggcgtcatttcgggcgcggaggccggggtggtggatctgggcgacgcctatggcgacggcgccaccgttcgcaatgaggggcagatcctggccggcgtggccgtgaccagttttggtgacggtttcgtcctggaaaatatcggtggccggattgccggcagcatccgtgccgtcgacctttcgggggaagacgtcacgatcgtcaatcaggccggtctgatcgatggcggactctggctcagcggcaatggtgcggtggtcgacaatcgtgccggtggcgtgatgatccggaccggtgcacgcggtgaagacggagagcccgactccgccgtgatcgatctgctcgatgtcgatggggccgtcgtcaccaatgccggattgatcgcgggcaatgatgccgacggcatcgatgccggcctctcggacgagtctgcctgggcgtcgctcgaggtgaccaacctgtcgggcgcgcgcatcgccggcgtcacggccattgatgccgatgtcgatacgctcgacatcgacaatgccggcttcctgaccggcgaggattatggcgtctatgccacggccgatgatgtgtcgatcgtcaaccgggcgggcggtgagatcaccggcgggatcagtgccatcgatgtcgaaggtggcttcgacgtcgagaatgcgggcgccatctcaggtgggaatgacgagcggcatacgcccgtcatgttcctggtcggcgacggcacactgaccaatgcggccgggggccggatcagcggtggtgtcgccatttctgccgatgccgacggtctggtcgatgtggtcaatgcgggcgtgatcgaggcagagcgcctggcgatccaggtcggcggcgagtcttacgtcgagaatcaggcgggtggcctgatctccggcgctctcggcattgccttcaccaactcgatcgacccggaggccctgctgatcgacacaccgaccctgatcaaccggggggagatcaggggtggtgtggtctatgacgcgggtatggtcaatatcgccgatatcggcggcaggttgggcgccaacgaagaaggctgggccctgttgttctcggacgatgccgacgagcgctggctgaccgtgcgcgacggcgccgttatcgatggcgatattctggccggggagaccaatgatctcgatgcagcccgcgaccgggaagacagcgtcgccaccttcgaaggcggcggcagcttcgcccatgacctcatcggtttcggtctgatcgagaaggagggggccggcacctggcgcttctcgggcaatctgctcgctgccgccttcgatgtgaacgaggggggtgtccgcctcgacggccgcttcaccggcgatgaaatgacggtcgggaccggggggacgctttccggcaatggcacgatcgacggcgatttgatcaatgagggccgggtggcgccgggcaattcgatcggcaccatcaccgtcaccggcgatttcacccagaccgcaaccggcacgctcgccatggaatatgccgcggacggtgccggtggcaccgttaccgaccggctggtggtgggtggtgctgccacgatcgagggcggtacgctgtcgctgacctcgttcgacggcagtactccccgctatgccagtaccgaactgatcacggcagcggacggcattaccggcaccttcgatgcgatcgaaaccgatcgggccggcctggtcggtcggttgctggccgatggcgatgtgatctcgctcaggctggtcgataccgagaacggcttccgggcgctcgccaccacccgcaatgcccgcaatgtcgcaaccgtgctggagacccaggggctgacggcgaccggggatcgcgaccagctgttgagcgagctggcggccctgggcgatgccgatgcggccgcggccctcggcgatctcgccggatccgaatatgccggccactggcgctatctgcgcggaacgggccgcgccttcgttgatggggcggcaaatgccggtcgtgccggtcatcgtggcgcctggatcaccggtttcggcaataccggccggaccagcggcgaggatgacgcgggcgatctgcgctggcggagcgccggcacggcggtgggcatcgactttgcggtgggggagacggcgcgcctcggcatcgcagccggcgtgaccgatggccggaccaccgctcgcagccgggatgcgggcatcgataccaccggctggcatgtcggcgcctatggtgcagtgccggccgggccggtgacgctggatgcggtggtcgcctatacccggtcgtcttcggatgccgaccggtcgatcaccggtaccggccgcacggcccggggcagcttcgataccgatcaggtgactgccgccatcggcgtttcgaccgatcttgtggtgccgggggcgaagcccggcacgcccgaggcggcggcgggggccccgagctggaccgtcaccccgatgctgcgcctgatctatgaccggcagaagagcgacgacgtcaccgaaaccggtgccggcgccgcagcgctggtcgtccagggcggcacggtcgaagggctggaggccttcgccggcgtgcgcttctccacggcctatggcgatgcggcgaagggcgagaccgtgatccggccgagcttcaccctgggtatcggccaggaactgctcgatcgggatcagacgctgaccgcgcattttgccggggatccggcgaaccccttccaggtgaccggtatttcgcagggccggaccacgggccggatcggggctggggtcgaggccgatgtcgcgccgggcgtgacggtgggggtcggctatgccggtgcgatagacgagaccggcggggatcatcggctgacggccgggctgcgcttctcctggtgatccgtccgcgatctgtggctggtcatgttcgggcggggatcaccccgcccggcgtgacagggggaagatggcgcaggtggtcgtgccgtgtgcatacaacttgcctgcctcgtcggtgagcgtcgcctcggcggtcgcaaagctgcggccgacatggatgaccttgccctcggcccgcatccggccggtcgccgtggtcaccgggcgcagatagttcaccttgatctccaccgtggtataggccgatccggcggcgagggtgctgtgcacggcgcagccgagcgcgctgtcgagcatcgccgcgatccagccgccatgaacggtgccgatcgggttgtaatggtcgaagagcggcgtgccggcaaagaccacccgaccgtgctccaccgtttccgggtcgaaattgagcgtggcaccgattggcgggcggggcaggtcgccggcggcgaggcgctgcagcatttcgagccccgagatttcggcgatctcctcgaggctggcgacgccgatgccccgcccctcggtcgcttcggttgccgcggcgttgatctcgctcgtcatggacggaactcccggtccggcttgtgcccacaaatacgtgtatatacactcttatgctgcagactaatgcggtgcagcatagacggcaaggggagagatgatgacgggcgggacggatcttccctgcacctgtctgcggctgcggcaggcggcgcggcaggtcacacggctctacgaccggcggctggagccggcggggctccgcatcacccagtttccggttctggccctgctcagggccgacgggccggcgccgctcggccagctggccgagcgtctggtgacggaccggaccacgctcacccgcaatctgaggccgatggaacaggccgggctgatcgaaacccgggcggacccggaggatcgccgtcgtcgcctgctggtcatcacggaacagggccgggcggtgctgcgccgggcggcaccgctgtggcgggccgcccaggacgagcttgcgacgctgctggggccggaactgcgcggccggttgacgggtgatctggacgaggtcatcgcccggatcgattgaggcggctcagcgctcttcgatctcgatccatttgtgctcgaccttcgggcgataggccgcgaagcgttcgatcagccgggccgggtcggtgtcgaccagcaggatgtccagatgctgcggcttcatgaagccgcgctgggcgacatggtgcagaaagccgagcagcggctggtagaagccgtcgacgtccagcagccccaccggcttggcatggctgccgagctgggcccaggtccagacctcgaacagttcttcgaaggtgccgatgccgccgggcagggcgatgaagccgtcggcgagatcggccatcatcgccttgcgttcatgcatcgaccccaccacccggaggtcggtgatgttgcgatggccgacttcgcggtcctccagcgatttggggatcacgccgatcacctcgccgcctgccgccatggtggcgtcggccacctggcccatcaggccgacccggccgccaccatagacaaggcccagctgccgccgggccagctcgcggcccagctgccgcgctgcctcggtaaaggcgggggtgtcgccggggttggagccgcagaagacgcagagccggttcattctctctcctcggtatcaggcccgcggcggggcgcgggccgtcttccattcatcgggcttgtcccgatatacgaaacaaatcgcccgaaatcgcgtttcgacgagaggttgaccgattttccattccggccgaccgctcaggtcgtgctacatcgggcatgtggggatgataacatcccgtcatcaaggcgtcgtgacggtccgggaaaaacaacggccatgtccggggagcgatccccggccagagcctccgggggacgagggtccggaccgcataccagcgcctgaggagccgttgatcaggtccaggggaggaaccgatccatgcgcattttcgcgtcgctcgccgtcgtggcgggcctgctggccggtggcagtgccatggccgccgatccgatcgtcatcaagttcagccatgtcgtggccgactccacgcccaagggccagggcgccctgatgttccagaagctcgtcgccgagcggctgggcgacaaggtgaaggtcgaggtctacccgaactcgcagctcttcggcgacggcaaggagatggaggccctggcgctgggcgacgtccagctgatcgcgccgtcgctgtcgaagttcgaccgctataccaagaagcttcaggtcttcgacctgcccttcctgttcgacgacatcgcagccgttgaccgcttccaggcgagcgatatcggccgcagcctgctgcgctcgatggagaagaagggcttcatcggcctcggctactggcataacggcatgaagcagctgtcggccaacacgccgctgcgcatgccggaagatgccaagggcctgaagttccgcatccaggcctccgacgtgctgctggcgcagttcgaagcgctgggcgccaacccgcagaagatggccttctcggaagtctatcaggcgctgcagaccggcgcgatcgacggcgccgagaacccctactcgaacctctacagccagaagttcttcgaggtgcagaagtatatcaccgagagcaatcatggtgtgctcgactatatggtggtgaccaacaccgaattctggaacggcctgcccgacgatgtccgtgccgagcttgagaagatcatgggcgaggtgacgacggccgtgaacaagatggccaacgacatcaacgagcgcgacaagaagcggatcgccgaaagcggctcgtccgagatcctgaccctcaccaaggatcaggtgtcggcctggcgcaaggccatggcgccggtctggaccaagttcgagggtgagatcggcaaggacgtgatcgacgcggcccaggcgtcgaacggcgccagctgagcggccgcgacccggttcacgggatcaccgcaatgatcgcccgcatctggggacggctggaggaaggcgcgatcgccttcctcctggctgccatgacgctgctcaccttcgtccaggtggtgctgcgctacgtgttcaacagcggcctggtctgggcgcttgaggcgaccttctatcttttcgcctggctgatcatgatcggcatctcgtactgcgtgcgggtccatgcccatatcggcatcgacctggtggtgaagatgatgccggccgccccccgcaaggtggtggggcttgtggcggtcgccctggcgctgctttacgccggcctgatgttctggggatcctggaactataccgaccgcatgatgatgctcggcatcgaggccgaggacatccccgtcgaacgctggatgctgtcgatcatcctgccggtggggtttgccctgctgggcctcaggctgatcgagcagggctgggcgatcctgaccgggcgtgccgagggcttccagctggcggacgaggcggccgaggccatggcgctcgaccagcggggcaaggacgaccccaccgacgacgcatctgcacggggagggcggggccggtgaccacactcttcctgttcgtggcgctcttcgccttcctgatcatcggcatgccgatcgccatctcgctcggcctgtccagcctgctcaccatcctgctcttcgccaatgacagcatggcgtcgctggcactcaaattcttccagaccgccgaactctacaccctgctcgccatcccgttcttcgtgctggccggcgccttcatgacgaccggcggcgtggcgcggcggatgatcgccttcgccaatgcctgtgtcggccatatgtatggcggcctcgcgatcgcgtcggtggtggcctgcatgctgttcgccgcggtgtcgggctcgtcgccggcaaccgtggtggcggtgggctccatcgtgatcgcgggcatggtccgtgcgggctatacccagaccttcgcggccggtgtggtctgcaatgccggcacgctcggcatcctgatcccgccctcgctggtgatggtggtctatgcggcggcgaccgaaagttcggtcggccggctgttcatggccggtgtgatcccgggggccctgctcgggctgatgctcgccaccgcgatctacatctcggcgcgcgtgaacaggattccgcgccagcccagggcgccgctggccgaagtgatccgaaccggccgtaacgcgctctggggcctgctgctgatcgtgatcatcatgggcggcatctatggcggcatcttcacccccaccgaagccgctgcggtgtcggcggtctatgcggcggtggtggcgctgttcgtctatcgcgacctgaagttcaccgatgtgccgcatgtgctggtcgatgcggcgaaggtcacggtgatgctgctgttcatcatcgccaatgccttcctcttcgcccatgtgctgaccaccgagcagatcccgcagtcgatcgcccgcggcatcaccgaagccgggctggcgccctggcagttcctgctggtggtcaacatcatcctgctggtcgccggcaacttcatggagccctcggcgatcatcctgatcctggcgccgatcctgttcccgatcgccaccggccttggaatcgacccgatccatttcggcatcatcatggtggtgaacatggagatcggcatggtcacgccaccggtcgggctcaacctgttcgtgacatcgggcatcaccggcatgccggtgttgagcgtggtgaaggccgcatggccctggctgatgatcctgatcaccttcctgatcatcatcacctatgtgccggaaatctcgctctggctgcccaacaccctgttcggcaacgccatggtcggctgatggtgtgcagggcctgaaacgggaatggccgctgctccggtcgggagccgcggccatttttttgcgggggcggatgtgggggtcaggcgcgccagaagggcttgttcgcctcccgcgatgcatcgatcgggtcgatgtccagatcgcgcagcagatgcgcatcgagcgtcgcaaggcagcggcgttgccggtggcgctcggcccagaggccgagggttgcaatcatccgctcgagcacgccgtgaaccggcttcacggcagcctgggcgcgaacggggggcagtccggctcccgcgcaggcgtcggcgcggtgccgcagggtcacgacggtcatcttcgtcatctccggctggaagggagccgccggatggggggatgagggacggctccggcggtgactgcatcttccgtccttggccgattgcgggcaaacgaggctttctcgtacactcccttaggaaaactattcgtgggtcacgacgggcggcgacgggcacgatgaaggcccgcccgtcctctacccccgccgggccggctcgccgcgccggcgggatgcccggtccggacatgccatgccgcgcaaattgccgcccctgaacggtctgcgtgccttcgaagccgccgcccgtcattccagttttgcccgtgcggcggaagagctgcacgtcacgccggccgccgtcagccatcagatcaaggggcttgaggcctggctcggcgtcaccctgttccgccgcctgcccaacggtctgctgctgaccgcggcgggacgcgcctatctgccgggactgaccgacggcttcgaccgcatcgccaggtccacagccgaattgcgcggccggactctgggcgggcggctgaccgtgagtgtgctctcgtccttcgccggtctctggctcgccccccggctcggccggttccgcgaggcctatccggatgtcgagctgttcctgcgcgccgagacccggttggtggatttcgatcgcgacacggtcgatcttgccatccgctatgtcacggcgatcgacggcgggctggtttccgagcggctgatggaggaaacgctcgggccggtgatgagcccggcgctgctggaacggctggggccggtgacggaacccgcggccctgctcgatctgccgctgatccacgatgccgatgtgacgggcggcgaggtcgccgtctcctggcggagcttcttcgcaaccgccgggattgatccgcctcaggatctggaccggcaaatgcggatcaacgacaccggcgttgccgttgcggcggccgttgcgggccagggcgtgatcatggggcgcagcgcgctcatcgccgatcacctggcggctggccggctggtacggccactttcgattcagatccaggccgcacaggcctatcatctggtgtcgaccgagaccggctggaacgatccgcgggtcctggccttcaccgactggctgcggcaggaagcgctgaccggtcagccatccaggcgggagtgagtggtcctcccgcgatccaggagtatccgacgccatgggcatccgcagcacactcgccgccggtctgatcgccggtctggcgtggtcggttcccgcctctgcgtcgtccgggacggcatctgcgcctttcgacccggccatggtccatcctgcctgtttcgacagcctggtctcgcaggcctataccggagagacggcgctggaacgcctgccgctggccggctgccccgggagcgagatcgcgccggacccgcgccaggacatgatggtgatggtccgcccgccggccgagccagagggcaacaatcccggcggctggtcgcggggctgggtgggcagccgcctggtcggtcgtttcgatggcgatcgtctggtctatgagttggtcgagaatggtggcggtacgggtgtgttctcgatgctgctgtcggggcggcttgccgcggcggaaggcgtgccggtgctggaggatctggttctggcaccggcgggggaccgctgcaacgggggcatccataccgcaacccgcgtcgacggcagggcgctggacgtggcccagtgggcgaccccttacgatctgatttcgctgatcctgggcctggcgccggatgacgcgcccgacggcgtgcccgcggccctgggcaaggctgccgaagacctgcctttctgcgccgcctgctgtgccggcaccgtgctgctgcgtctcgacgctgccacgctcgccccccatggcggtgccgccgatgcgccgccgctgccgggagaggtggtgacggtcaccgccgacgggcttggggaatacgacgatcccgccagccgctgtcttgcccgaaccctgatccccgacgggagcaccgatccgcaggcggagctgtccctgcccctagagcgcctgccggggctgaaggcggcgctgctgtcctgcacgacggggaaatcacacaaaaaatgacgtatatagaagatcgcatcgccgatatgcgacgcatacgactgtaaaataatttgactctcgccccttccccacggacaattcggttcgtggtggaaaaggacacgcacgatgatcgagatcaagggcctctccaagcggttcagcggctatgacgcgctggtcgatgtcgacctgaacatccgcgatggtgaacttgtggcactgctcgggccgtcggggtcgggcaagaccacccttctgcgcatcattgccgggctggagaccgccgaccgtggcgcgatccgcttcggtggcgaggatgcgggtcgcctgggggcgcgcgagcgccgggtgggcttcgttttccagcactacgcgctgttccggcatatgaccgtcttcgacaacgtcgccttcggcctgacggtgcggccgcgtgccagccgtccggggcgggccgagattgccgagcgggtctcgtcgctgctgcgcatggtgcagcttgaaagcctggcggaccgtttccccaaccagctgtcgggcggccagcggcagcgcgtggcgctggcgcgcgcgctcgccatcgaaccccgggtgctgctgctcgacgagcccttcggcgcgctcgacgccaaggtccgcaaggagctgcgccgctggctgcgccgtctgcacgacgatctgggcctgaccggtgttttcgtgacccacgaccaggaagaggcgctggaagtcgccgaccgggtggtggtgatgtcccagggccggatcgaacagatcggtactccggccgaggtctatgaccggccggcgacggccttcgtctatcagttcttcggcaacgtcaacaagctgccggtgacggttgatgcagggcgcctgaaggtcgcgggcgtcagcggggccggcacggcggggctgccgctgccggtggggctggaggcgacccgcgccgaacagggtacgctttatgtccggccgcatgatctggcggtgctgccggcggggaccgccgacgcgctgccggcgaccgtgcgccatctggtggctttcggcgcctcggtgcgcatcgaactcgacgtgcccgggctggatctggtcgaggccgaactgccgcgcgaggaagccgacgctctcggcctcgccactggccggacggtcgcactccgggtcaagcgggggcggttgtttttcgacgacgataccggctgggatgtcggtctgaccgagccggtcgccgcctgacccgtgtcatgccccggcccccgtcataccctggcccccgtcacgcccggatcgagcgcagcccccgccggcagatcctggccgtggcagggcaggggctttcagtctgccagcggccggtgagcgccagcaccgtctcgggccggtccttggcggcatcgttcagccagttgccgaccgagtcctgcacatagctttcagggtccgccttcagcggctctagcagggcgaagcccggggtcgggtccgccttcagcggtttcagatgggcacaccagaccccgcgcggccgggtcgcctcgctcgcgaagcggcgcaggcgcggcgaggtctcggccgtccagggcatcagcgccgcgatggcacccggaatgtcggcggcgatccggtcacggatcgccagccaggcccattccctgacgccgaaatggccgtcgtcggcgaaggggcggatggcctcgcaccagaggtcgtgatctgcgggggcggtccggcccacggcgaaacaggcccagccgcggacggtatccgatgggtgatcggccaggtgccggatcacctcggggccatagcggccgatgatcagctccgccgtcagcgccatgcgccgcgagatgccgagtgccgccgtcgcatccatcgcctgcagcacctgaccaccggcatcggggaagaccgaccgcatcaggattgcgaaatcgaccgcaaggcattcggcaagggtcgtggcggcaacctctccggcattgagcgcggcatggcggtcgggggaaagagccgtcggcttcatgatccgtcctcgctggcaagacctgctctcaacttgccgagcagcctgacgaggtctgcctgctcttccgccgaaagccccgccgtcagtccggcgatccagccggcatgctcctggaacgccctggccgtcaccgcttcgccggacgtcgtcagcatcaccctgacccgtctgcgatcctcgggatctggtgtgcgccggacaagtccatcgcgttccagcccgtcgagcagacctgtgatcgtgccacgggtcacaccggcccgatcggccaggacatgcggtgccagcccgtccgtccggtcgcggagcaggaagagcagcacgaacctgccttccgagaggccatggctgccgagccggatggcgcagtcgcgatcgatggcccgcgccgtcgacagcagctccatgcaggtccggagcctgtcgagcccggtgaggccccgccgtcggctctcgtcgatcagggcctgatatttggtgtccattttgttcataaggagccatataatatggtgccttatgaaagatcaagcccgctgcgtcgcgttgcggatcagggtctcgaccgcatccggtgcagtcaccggcagcatgtgtccgccgtcgatcagggtcagctgcagcgccggcagctttgcctgcagggcctggccatgggcgcgccagtcgaggatccggtcgccgcgggcgaagatcatgtggacgggcagggcgatgtcgggatagcgggccgtcatggcgggcaggtcgtcattggccgccaccatgtcgatcgaggccgagcggaaggctttgggcctgaggccgagcaggccgccgccggcgatcgcaaagtccgcgggaaccggatcggggccgaacacctcgtccagcaccttgcggccgcggaggaaggacatcggcgtcgccatcgtccaggcgaccagccgacgggcgatatccgagcggatcgccagccccttgaagatgtcggggggcgtctcctgcgggtgggtgagagcggcgatcagcgccacacccgaaatcgtctccggatgatccagcgccacgcccagcgcgatcgcgccgccgagcgaatggccgaccagcagcggcgggcgcggcagcttcagcgcccggatgaaatccgcgatcacgccggcctgggccagcacattggcgggcgcgtcgtcgggacgggtggaatggccggagcccggccggtcgaccacgatcacccggtgatcggtccggagccggccgagcaggctgtgggtgaagtgatgcatctggccgccgagaccatgaaccatcaccaccgccggccggtcgtcgtccgggccggtgccgtcgtccagatagtgcaggcgattgccccggacatccatgaaccggccgcgtggcggcagcgccttttccacccggctggccgtccagccggtgaacagggcgagcccgccgccggtcgcagccagcgcgatgatcgtttgcagaagcatcagcctgcacctcccgcatctctgcgctgcccgaaggcaaggttgtcgtcgaccaccgaaccgtagcgcagtgcggccatatcgaggagatagttctgattgagccgccagggcttgcggtcgccctgacgaggcaggtccgcggctgcccggcggacatagcccgaggcgaggtcgatcgccggccgggtggcgaggccgggcgcgggcgggcggggcatgaaccagtcggcccccctggcatccatgcggcggatcagccggcagagatgctgcgcggtcagctcgcatttcagcgtccaggatgcgttggtgtagccgagggccagcgcgaaattgggcacgccgctcaacatcatgcccttgtacgaggtcgtttcccccacccgcaccggccggccgtcgaccgagagggtgatatgggcgagcagcttcatccggaggccggtggctgcgaccacgatatcggccgccagctcttcgcccgaggtgaggcggaggccggtttcggtgaagcgctcgatgccgtcggtgacgaccgaggcggtgccggcccggatcgcccggaacagatcgccgtccggtaccagacagagccgctgatcccaggggtcgtaagccggcgtgaagtggcgatcctggtcggggcccagctgatggcgcacgccggccaggatcttcgacttcaccagcgccggcttcctgcgggcgaggttgtagaaatagatcgacagcagcacgttcttccaccgggccgcccggaaggcgagacgttccggaagatggcgacgcagccagcctgccgcggcgtcccgggatggccgggcgacgatataggtgggggagcgctgcagcatggtgacatgtgccgcactttcggccagggccggcaccagggtgacggccgtggcgccgctgccgatcaccaccacccgcttgtcccgatggtccagatccgccggccagtcctggggatggatgatgctgccgcgaaaatccgccatgcccggccagtcgggcatatggcccgccgcataatcgtaatagccgctgcaggcatagagcacccggcaggtgaaacggcgcgggcgccgctcgggcccggcttccacaagcacccgccagcgggctgtcgcactgtcccagtcggcggagacgacccggtggccgaacaggatccgccggtcgatgccgaattcggcggccgtgtcgcgcacatagtcgcggatcgaggggccgtcggcgaaaaccttgtcgccgatccagggacggaagccgaagcccagggtgtacatgtcgctgtcggagcggatgccgggatagcggaacagatcccaggtgccgccgatcgcatcgcgggcttccaggatcgcatagtcgatgccggggcagcgggtctgaaggtggtagccggcggcaatgcccgacaggccggcgccgatcaccaggacgtcgacggcgcgcaggtcagcggcttcggccccggcactgccggagccgatcgtggtggtgtccatgaacgggtatcctccctggcatcgcgggacgggccggatgcttcgggcgggaccctgccggtctctctgatccgcgacggtctgcgtgctacgcttgcacgaaggtcaggctaaggtgtttaccttaggcgagtcaacacgtgccgcaggaggatccgcatggcgacgacgacagggcgcaggtcgggaacgcgacagcggatcctggaaacctgccgggagctgttcaaccggcgggggacggccgacatcaccaccgccgagatcgcggcggcggtgggcatcaacgagggcaacctctattaccacttcaagcgcaaggagcagatcctcgagaccctgttcgcggctttcgcggccgagctgcgcgaggtggcggcggccgatctggcggagggcgaggccgagacccgggccgcgcggtatttccgcggctggttcggcctgatgtgggaatggcggttcttctaccgggacgccatggtcgtccgcaggctggccccgggcctgcaggccgaactggaaacgctggccgatgagggccaggcggatctgcgccgggcgctgcggtcgatggcagcaaacgggctgatcgtggccgatgacgacgaactggagcggatgatggtcaacgcctggatcgtcgcgacctactggatcgactatctgcgcatgcgtcacggcgtcggcgacatcacccgccggcatctcgactggggcgcctggcagctgatgggcatcttcgagccctatctcacggccgagggtcgccggctgctggcggcggcaggcggtgtgcgtcccgggccggttccggaggtgcaggcttagtcttccgggcgcagcaccagccaggtggcgacggggataaggatggccgcagtcccggccagcaccatggtcggtgcgccgagcgcccaggaaagggccaggccggccgtcatcgcgaccacggccgcgatcttcgccttgcgcgacacgatcccccgctcgcgccaggcgcggatcgaggggccgtagcggggatgttccagcagccgtcgggcgagttccggatcggcgcgcatgaagcaggcgacggccagaatcaggaagatggtggtcggcatcagcggcagcaccgcgccgatcgcccccagcccgacgcagatccagccggcgatgcgcagcagccgggcgcgggggtgggcaggcgcagcttccccatcgggcgcggccgcctctggcccgcgctcgtcggccgtgtcgcgcaacatcgggtccggctccgtcgtcatgggtggagagtaggccgcacggccggtcgcggcaacaaccggccgtgcgacgatctcccgcagggaccgggaggcaggcgatccctgcgggcggcggcggacatccgggtgggcacacggaggaaaccaccgccgccgccaccccccggggcgcaatcggggggcgggatggcaggtcaggcagaggtcattcgaccgcgtccctgaggctcagacccagccgtgcggcgaccccggcgccataggcgggatcggccttggcgaaatggccgatctggcggcgctggatgtcttcaggcaccggggccatggcaccggcgattgcggtcatcaggcggtcttgttcggcctcgctcatcagccggaacagatcgccggcctgggtgtaatcgtcattgccctcgcgatggctgtagcggtcggccgggccgtcgagcggcaaaggcggttcgccggccgccggatcctcgaccggcccgccgaagccgttcggctcgtaattgggctgccggccaccattgtcgtcgaagcgcatggcgccgtcgcgatgggcgggatgcgcctggacgaccggccggttcaccggcagctggtcggcattcacccccacccgataccgatgcgcatcgccataggcgaagagccgggcctggagcatgcgatcgggcgaggcggtgatgccgggcacgagattgccggggctgaagatcgactgctcgatctcggcgaaatagttctcagggttccggttcagctcgacgacgccgacctcgatcagcgggaaatccgcatgcggccagaccttggtcaggtcgaagggatcatagggtgtctgccgcgcctccgcctcggtcatcacctggatcatcatccgccagcgcggatagtcgccgcgctcgatcgcctcgtagagatccgcctgatggctctcgcggtcgcggccgatgatgtcggtggactcggcatcggtgatgttgcggatgccctgcatggacttcaggtggaacttcacccagacgcgctcaccggcggcattgaccagaccgaaggtgtggctgccgaagccgtgctggtgacgataggtggccggcaggccgcgatccgagaacaggatcgtcacctggtgcaggctctccgggctgcgcgaccagaaatcccacatggcggtggaattgcgcagattggtccgcggatcgcgcttctgggtgtggatgaaatcggggaatttcagcgggtcgcggatgaagaagatcggcgtgttgttgccgaccagatcccagttgccctcgtcggtatagaacttgaccgcgaagccgcgcacatcgcgctcggcatcggcggcgccgcgctcgccggccacggtcgagaaccggatcagcagcggggtctctttgcccagttctgcgaagatcttcgccttgctgtagcgggtgacgtcgttggtgatggtcagcctgccgaaggcaccggagcccttggcgtgcaccacgcgctcggggatccgctcgcggttgaaatgcgccagcttctcgatcaggtggacgtcgtcgagcgtgaccgggccgcggcggccggcggtgcggctgtactggttgctggcaaccggcgcaccggcggcggtggtcagggtcggccgggtgatcgggatcgcatcgtccttgggcgtgctcatggggtctgcctcctcacatgcatctggcatcggcttcgcgccatctgccttcgcctgtgatcctgcgtcccctgcatagatagtggaaattgattgtggatatgtaattcatagtcagtgactatgaaaacgcccggcgtcagaagggcccgtctcccttcaggtctcgggtgagctgccgggccagcagtcgggccggcatatggcgcagggcgaggttgcgcagacggaagcctgtcgacgtcgccgggatgaacagccgggcaagcttgcggctgcgggcctgaagccgtccgatgaccggacgcaaccgcgcttcgtgctccgtaagagcctttcccatatccagcggatggcgcagcaggcattcggcgagcagggctgccgatgtgatcgccatgcccgctccctggcccgacagcagggtgaggcaatgggcggcgtcaccgagcagcagaagccggcctttcgaccagtgaggcaggacgctcatcagcgtggtgtcgaaatagagcccgtccgccggatcacgggcatcgatcgcggtcagcaccgccggatgggcgccggcataggcggtcttcagggcctggatcctgtctgcctcgcctgccggcaggtcgatcccggtgcgccgccagacatagagggtggcaagggaaccgtcggcgagggtgtagaactcggtcagccggcccggttgggcataggacaggaaatcgcggcccagccccagcgtatcgggcaggcggaaggcggcaacgccgtagccgagcggctcgaacgccaccttgtcggaggcgaagtgccggcggcggagatctgagcgcaacccttcggcgccgatcaccagatccgcggcgagggccgcacccgaggcaagcccgacctggaccggtccttcctgatggtcctcgatctccgtgatccgatcatcgaagcggatggtggccgaggccggcagcgcaccggcgagtaagtcgaccagggcagtacgcgacagggtgatccagtcgatcccctgcagcaggtcgggatagcggatgcgcagcagttcccgcccccggctgtcgagatagaggttctcgtcgatctcgcggctgcgggcttccagcgcgggacgcaggcccatccgggtcgccgtggcaagcccggggcccgagagacccagcatatagccgtcggtacgcaggtcaggggcgcgctcgaccagcgtcgtgcgccagccgatgcggtcgagccaccaggccgcggtgagcccggcaatgccggcaccggcgatgacggcgtgcgagggggaaacgggtcgactggtcatgccggcagggtctccgggcgggcgccgtggcggagcaggcggggggtgagcagggcggcagctgccgcggtgccggcggcaagggcgaaggtggcgtcgaggccgagagcggccgcgatcaggcctcccgacaggccggcaacagccgcgatcgcggcatcggcacattgcagcagggtgaagtcgaccccggcctgcggcgaggccgcccaacccatcatggcgctgtagagtgcaacgaagctcgctccctggatcatcgagaggaccagcagcacggccattatccaggaagctggaagtccggccgggatcgcggctgcgatggcgccgaggagcaccgcctgggtcgccaccagcggtgccagaaggtgctccggcgcaatgcggcggagggcgatgcctgccgccaccgtaccggcgatgctgagtgccatgccgcccgcgccggtcaccaggccgatggtggcgagcgaaaccccgccgtcgaccagcagcggtcccgtcagccccatggcgaggcgcagcccggcctggaccgccagcacgactaccaggccgatgcgcaccggccgccgcgcgaaggcgtgacggagcgaagggcgatggatcccggcgccggcatcggcaccgtcgatcgccggccgcccttcgcgcgtcatcgccatcggcagggtcagcaggatcatgatcgcgaccatggccaggatcgcgacccgccagccggtgtggtcgagcagcaccaggaaggcgccgccaccgatcagggcgcccagatagccgccgccgacctgcatgacattgcccaggccgcgcaatcgtggcggaagctgttccacggcataggcatcgcagccgatatcgaccgtggcggtgatcagggcggcaaccgccagggcggcaagcaccatcgcaggcaagggcggtgcatcaccgacggcgagcagggtgatggtcaggatcgccaggatctggccgccgaggacgatgcgccggctgcgccgtccgccgccaatcggccgccgaagccgttcgaccgcgggtgcccagaggaatttgagcgcccagggcagcatcagcagcgagacgaggctgattacctcatagccggccccgcctgcccgcaggctggtcggcaggccctggaaggtgaggccgccgatcgtgctctgggtgacatagatcccggcgatgacggcgagtacccggccgggcggggtggcggcggaggggatgagggcgcccatcgcctcagaacctccagctgccggtgatgccgatggtgcggccgtcgccgatggtgctgcggatgtcgccgccaccgaaatcgaaactggaggtgcggtagacctcgtcggtcagattgcgggcgaagacccggatcgcgtagcccgcatcgagatcgacctccaccgccgcatcgatcagggcgtaggcgctctgggagagcgtgttggcttcatcgaaccagctgcgcgacacccagtctgtcccgaggtcgaccgccacggcgccgggcaccgtggtctgaggtacgatccagcgcagcccggccctgaacgtggtatccggggcatagggcaggcgtttgccgtcataggggccgccgtcgaattccgaccggccaagggtcgcgccggcgcgcaacatcaggtcgggtgtggcacgaaagacagtgtcgatctcgatgccgtggctgatcgcatcgcccatattgcgcagcacctgggcacccagcgggccggtatagatctgcttgtcctcggcggtgatcacataaagggcggcatcgatgtccagccggccgccggcggcggtaccgcgccagccaagctcgtaattggtcgaggtctcgctgtcatagggcagggcatctgcgggggaggagacggtatggttgaagccaccgggcttgaagccgcgtgcgatggtggcccagaccctgtgatccgccgccagctgccagccgagcgacagctttggggagatgtccgagaagtcgtcttcggcctgaaagcggaagtcgtagggaccagcccccggacggtcataacggatttccgcatcttcccgcgaccagcgcagtccgccggtcaggtcgagcaccggtgtcagcgcataggtggcttcgccgaacagggcataggaccgggtgtcgacctcattgcggtcggggccgtaatagcccggatagccgggggtcgtgcgggtgaagccggtgtcctggacaaagccgcccagcacaccgtcgacgcgcgcgccagcctggaaggcgaggcgcagttcctgggagaaactgtcctggctttcaggtgtgttcacggtgatgacccgggtcatgtcccggctctgccaggaggtcacgctcgacagcctgagcgcgtccgagatgtcgtagtcgccggcgagcgccaatgtggtgacctcgcggtcgagccaggcccggccaccctgtgtggcgctgtcataggtccggtccgcgacattcgtctcgcggatgtacagttcttcgtggctctccagctcttcgcgcgtggcggtgagggtgagggcgagcgggccgccggccggcgcatgacgcagcttcagccgggcgaagcgcgagatgccctcatcgatgccggtggcaccggttgcgatgtcgtcgatctggccctgatcctcactccagcgcaccgccagttcggccgtcagccggtcgggcaccagcgggcccgagatcatcgcttcggcaccgcgttcgggcacgcccagcgtgacggcggcacgaccttcgacgtgatccgtcggtgtgcgggtgatgacgttgatcacgccgccatgggcgttgcggccccagagcgtgccctgcggaccacgcagcagttccacccgttccacattgaccagctcctgggcgaaactggcgggatcctgaggcacaccgtcgacatagacctgcactgagggattgtaatagtcgggagaggtgacgccgcggatggtgacgccggtataggcacgattgccgcgagcgcggatcaccaggccggggaagacccgatcgagctggtccaggcgggtgatgccggcttccgcaagctcttcgccgctgcgcaccgaaactgccgcatccacgctgcccagggcctgttcgcgcttggtggcggtgacggtcaaggcctccagacgctgaacgccatcctcgccgttatccgctgcaagggccggcagaggggcagagatcagcagtggggcgacgaggatcgcagtccggcacctgaacgagcgcttgggcatggcgggtgatccttggcgagcttgagtgacgggatccggacggatggccggtcagagagggcccgtcgtcatcgcgcgttcccgttctcaccgccgcccggatcggggctcatcctgatcgagtcgggactttcttgcgaatcattctcacttgcggaatcatacaggtttcccagccatcccatgcggagccggagcatgacgtcgctgacgacctgggaggtcgatgagaatgccgcgctcaaggccgaggggatcgcagccatcccagcctggttcgccgcccaggcaaatgagccgctcggcgacggcatggcggtcaaccggttcgattttaccgccgaggccgaacagcggttgcgcatcgccggcccgcccacgctttcgatctcgatgttcttcgatggtgcgggcagcctgtcgatcgatggcggacgccccctggaaatccgacccggcacgacggtcctgtatcatgccgaccggccgacggtgggcgaggatctgatccccgcgggtgcccgggtgttctgcctggatttccgctacgaggccggattgctgaccgggctgggcctcgccgccctgccggtgctgatccgtggtttcgcaacggattgcagcgtccgcgacgtgctgcttctggggcgcccgacatcgactgcgctggaagcggtggggcgggcggtacttgcctgccggctgacgggagccgcccggcaggtctttctcaaggccaaggcgctggaggctctggcctggctgatcgccgagatcgacggagccccgcctgtggccaccctgcctgtgccggcggagcgccgccggatcgaacatgccgcccggctgctggtcgagcggcatgacgaggcctggaccatcccgcttctggcgcggacggtggggctgaatgaaaagaagctgaaatccggctttcgtctggtgatcggacgtacggttcatgggcatctggaagccgcccggctcgatgcggcggcccgcatgatcgaggacggggcccgggtgatcgatgccgccgtggccgtgggctacaccaatcccagccatttcgcccgcctgttccggcgccgcttcggcgcggcgccggccgactggcgtcggggcgtgctggtgccacagatcgtcaggccggatgtcccggcccgtccccccggcagcggttgacctcgatgatcgggtggtgcaggtctgcccgctgcggcagtcgcgcgcgataatcgtcggggccggtgtcgccatgcgtgaccaccgaggcgaccagagtccaggcctgatggccgaccgaccagagatgcagatcgaccacctgcgtgtcgccatcggcctcgagcgctcgtgtgatctcgtggcgcatcgcctcgggtgcctgacggtcgagtagcacaccggctgactgccgtcccagatccgccgaccacttcaggatgaccgcagccgcgagcatggcggcgagcgggtcggcccagagccatccggtcgcccaggcaatcccgatcgccgcgatcgcggcaaggctggtcagggcatcggccagaacatgcagcagagccgcccgggcattggtgtcgaggccatggccatggtcctcgtcatgggtatggtcgtggtgatcatgcccatgagcatgagcatgaccatgaccatgttcgtgcccgtgatgatgggtgaggccgagtagcgctgccgagaccagattgacgaccaggccgatcacggccaccaggatggcgtcgccataggcgatcgggcgcggatcgaacagtctggcgacggcttcgcccgcgatcaccagtgccgagacgccgagcagcagggcgctggcgaagccggcaagctcgctgatcttgccgctgccgaaactgtagcggcgatcgagcgcccgggcgcgggtgagcgcataggcgagcgctgcgagccccagggcaaaagcatgggtacccatgtgcagcccgtcggcaagcaacgccatcgacccggtcagccagccggtcaccacttcggcgaccatggtgacgacggtcagcgcgatgaccgcatggacccgtccttcgaccgggcgacgcacggtctgaccgaagctgtgggccggttgccagtcttcaatcggtcggctgtgcatgacaatctgtcttccggtggtggatgtctggcgggcgggcggcacgccctcaaagggtcggagcgaagctgcccaggatcaagagcggcgcgacatgccggcggacgacaccgatccgcgaggccatggccagtatgggcatcatccgcgggaaaggatcagcataggtccagctgtgctcgacccggaagcccgcaatcccggccgcgaagtcgtccaggccggccagcgtgagggcgaagggcatcggcggtgcggtatagccgggtgtcaccttaaggccgcggcgtgtcttgcgggaataccagccggggatggtgtcgaaataaacctgtccgccgggcagccctgctgcgagggccgtcagcagccgtgtcaccgtcatggtatcgggggcatacatcagcagccctgctgcgctgacgaagcacggccggtcggtcccgatctcgctgatccagtcttcgggagtgaaggccgatgcggaaatcatacggttgcgtggatgggcaggcagcagacgtcggcgtagcgcgatgccctcgggcaggtccagcgtcacccaatccatgcggccgtcatcgacccgccagagctgggtctccaatccttcgcccaacgacagcacccggatcgggcggtcatgcagggcggcgaagtcgcggatcaaccggtcgcccagcttcgcccggatcgtatgggcggggtgcgggcggccgaaacgtccgacgaagtcgtaattgatgcggcgcagcaggtccgccgcgcgcggatcgtcgagcagttcttcccgcggcacccgcccggtttccgccaacccgacgcgatgccagagcggccagagcatggtctcgggtacgccgtcgagggagatggcgatgcgaccgccggtatcgccggcggtggacgggaggggtgtcatgggagcctcgtcaggggatgatcccgagccggcatgctcgcatcatatgcaaataataatcaatcgcagattttgcccggaatcgggcggctgatcccggatccggatcatgtgctcagccgtcgactggtctcacttccgggggaacggcgccgcgacagacacggcccatggcagttgcatcggcatcacccgccccacggcgccagacgaggccgatccggcgatggccggcctcaccttcaaccgggcggaagatcatccgccgctccccgccccgctgccaggcatgggctgcgagggcgggcaccagggtggtgccgaagccggcggcgaccagctcgcgcagggtctccaggctggcggcgcggaagtcgtcaccgccggggctggggcgggcacaggcggccagcacttggtcgcgcaggcagtgaccgtcggaaaggaccagcagccgggccgcggtaagctccgcttcgctgattgcgggcgcctcgtcgggcagggggcggtcggtgtctgcgggctcgaccgcgaagaagccttcgtcgaacagcggcgccgcctgccggccgcgcagttcgaccggcagcgcgaccagggcggcatccagccggccgtcgtcgagcagccccagcagattgtcggtcagatcctcgatcaccaccaggtcgagccgggggtgtgcctgcttcagcgccggcagcaggctcggcagcagataggggccgagggtggggatcgcccccagccggtagggtccctccagcggcttcgcccggtgccgggtcagtcgcaggatcgcctgctgttccgccagcgcccggcgggcatgggtcacgatgcgctcgccggccgccgtcagccgcacgcccttgcggctgcgctcgaccagttccacgcccagatagtcctcaagcttgcgcagctgggcgctcagggtgggctgggcgacgcctgcggccgcggcagcccgaccgaaatggccgtgatcggcgatggccaccagatatctgagttcggtcagggtcatgggggtgggctggctccgtgacgatcgggactgcctatcgtgtcgatccgcattcgcctctacaagtccggggcgtgctcctgtatataagagtgaaacttagattcattccagtagatggagtgtcccgcccatgtccgccgatcgtgatccccgcatcgtctccgatccgcgaaaacccgccacggcccgtgctggccgtatcgctgctggccgtatcgctgccaaccgcatcgctgcgggcctggctgcggcacgatccggcctgcccgccaccatcgcggcactcgcggtggtcgtgctggcggccgttgccgtcacggccgtgctggacggcgccgaggcggcggtgacgcttggccttgccggctggctgccggtcgccattgcagcgattgccgtcggtggcggtggctcgggactgaagcggcgcatgatccgcggttatgggttcacggcggtcctgccgctgctgccgcttgcggtgggcgtggcgcttgcctcgcacggcagcctctgagcctggaagctcttgttctcggccctgaaacgtggatgatgccggcgagtatgggaccatgcgcattcatggcgctttccccgccgttcaacagccgtcgtccaacacacagggacctccgtccgatgtccagcgcccagcggaagaccgccatccgtatcagccgtgccgaggattttccggcctggttccaggaagtggtcaaggaagccgagatggccgagccctcgggcgtgcgtggctgcatggtcatccgcccctggggctatggcgtctgggagcagatccagaagcgcttcgaccagcgcatccgcgagaccggccaccagaactgctatttcccgatcttcatcccgctcgacctgatcgagaaggaggcggcccatgtcgagggcttcgccaaggagatggcggtcgtcactcatcatcgtctggtccagaaggacggcaagctggtccccgacggacagctggaagtgccgctggtcgtccgcccgacctcagagaccgtgatcggcgaggccttcgcccgctggatccgcagctatcgcgacctgccgctgaagatcaaccagtgggccaatgtggtccgctgggagatgcggccccgggtcttcctgcggaccagcgagttcctctggcaggaggggcataccgcccatgccacccgcgaggaggcgatggacgagaccgcgaccatgctcgaagtctatcgcgaggtggtcgaggactggctggcggtgccggtgatcccgggtgagaagcccgagagcgagcgcttccccggcgcggtggagacccattgcatcgaggcgatgatgcaggacggcaaggcgctgcaggccggcacctcgcatttcctggggcagaatttctccagggccgccaatatccagttccagaccaaggatggcgggctcgaattcgcctacaccacctcgtggggtgtctcgacccggctgatcggtgcgctgatcatgacccattccgacgatgacggcctgcggctgcccccggccgtggcgccggcgcagatcgtgatcctgccgatcatccgcgacgaggcgagcgaagcccaggtgatgccggcggtcgaggcgctggcgaagcggctgtcgggcgaacgctatctcgacctcccggtgcgggtcgaggtcgaccgccgcgacatgaatgccggtgagaagcgctggtcgtggatcaagcgcggcgtgccggtgatcctggaagtgggcccccgcgacgtcgcctcgggctcggtcgcggtcaccgagcgtacggcgctcgaccagaagaaggcgatcctgccgcaggacgagctggtctcgggcatgtcggaccggctggcggcgatccagaagcggctctatgacgaggcggccgccttccgcgagacccggatccgcaccgacatcaccgattacgaggccttccgcgccttcttctcgaaggagggcagcgacttcaccggcgggctcggcttcgtgcgggccccctggtgtgggacgcgggaaagcgaggcgaagctcgacgatctgggcgtcaccatccgctgcctgccctatgaccagggtgatgtggcgggcaaggcctgtgtgctgaccggtgcgcctgcgaccgtggaagccatcttcgccaagtcctactgatcggcgtcctgttgatcggcacggccctgcggtgaccctgcatcgccgcagtaatattgcgctgcaccagagccattccttcggaaattccgcgaggaatggctttttctttgcgatccggaaaaatcctccggacgggcagggcgggggctgctatcgttgcagaaggccatgaccggccgtgcgaccgccaggcaggcatccgcaatatggacgatttcgcgcgtcagttcgaaaccgacatccttcgcttggcctacgcctattggcgtgggctctgcggcgacgccggcatgccgctgcggcgccagatcgatccgctcgatctgcgccggctgctgccgaacctgttcatctatgacgtcgtccgggcagaggatggcagctgggactaccgcttccgtctggtcgggacgcggatctcagaagcccatggcggcgatcatcgcgggcggctgctgcgcgatgtccatggcgatcagtggtcgcgaatcgaagaggattatcacggcgtggtccgcaccgggcggccgaatttcgcccgccgctctggtttcgccatcggcaaggactacgtgacctatgaacgcatcctgctgccggtgagcgatgccggcgatcgtgtcgatgccctgttcggtgccgcccattactggatggggtgatgtggaggccgcgacgtcgtgtcgcgtgtcacgcgacgaaacgtgcgcccatattgaggattgcgcatccgtcccgccagtttccgggatcccttccgcagtcccgttcccatcagcgatgcgccccagccccgaggagaagagcccatgccgggccagaacatgtcgggccaggaagaaatggtctggaccaatgcaatgaccgaagaggcatccgccgagccggcgccgccgggcttctggcgcgcgctccgtcgcggctttgcccgccgctgcccccgttgcggcgaggcgccggctttcgacggttatctgaaggtgcgcgatcactgcgatcactgcggcgaagcgctgggcagctaccgtgccgacgacgcgccgccctatttcaccatcttcctggtcggccacatcgtggtgccgctgatgctgtgggtggagaaggactggatgcccgatctctgggtgcatgtcctcctctggattccgctcagcctgatcctgaccttcctgttcctgccccgcatcaagggggcggtgctgggggcgatggtccatctgggtatccactagaaccctctgcccgcgcaggtccgggttcccggaacgcccgtgtcctttttgaggggcatgggcgttttttcgtggtttgaccggcacttccgcattcggcggcttggtaatcggtgacgcaggacctatgtctaggtcatggggatgcggtttccgatcggggatctcccgagaagatcacgatcggccgcggcatcccgtccgaatgacgtacccatcctcgaattcgtcctcgaaccagagggaggcaggatgcagcccgtcgaagagcttcgctatctgatcctggcggcacagcgcgaagcctaccgtcagctcgccgaccggctgcggccgctcggccttacgccctcccaggcggaggtgctgacggtcttggcccagcgtgagcccctgtcactggtcgatctgggcgagttgctggtctgcgagaccggcagccccagccggctggtcaatggtctggtcgaacacggcctggtgcgccgggaccgttccgacaccgatcgtcggatgatcacgctcaccctcaccgaccgcggccggtcccaggtccagcggctgaccgatatcgaccgtcagtatcacgccgacatgtcgcgccggttgaacggtgatgatctcgagcacgtaacacacgccctctggcagctggtcggtgaccggccggccggccgggctctgcagaaacggcgctgaggggagcctcaccttcagccgggggaaacgctcagccgggaccgaacatcgcgaccaccctctgccgggccgtgccgatatgatagtcgctcgcctccgcgaaactcgtcgcgtcgcctgaccggagcgcgtcgagcaaaggctcgtgggtgcgggcgatttcgtgcgggtcgtcgtaaagccggccgatcatggcaatgccatagcgggtctcggcggtcagctcgtcgaagaccttgagcaggcggcgattgccggcgaagacgcagatcatgcggtggaacttcagatcctcctcgatctgacggtcgccatcacctgcctcggccagacgatggagcagctgcacctgggccgacagggcggtatccatttcgggcgtcaaccggcctgccagcaatccgcctgcatggcgttccaggcacatgcgcagatcatagatctggtccagatccgccgcatcgaagctgcggacgaagaagccccggcgcggcaccgcgaccaccagcccccggttttccagcaggcgggccgcctcgcgtactggcgcgcgactcacccccagatcgcgcgcgatggtcgcctcggtcaaccgggcgccaggggcaaatccccccttcatgatcgcctcggtcaggacctgggcgatgcggttgaccaggtcgtcctgcgtcagcgccgcaagctgcggcgtggcctgggtacctggggcactatgcggggggcgtgtcggtccggttgcggtcatatgtcacctctcccttgcgactatgcccgaaacatggtcgaatgtcgattgtcgacaatttgcaacgcgacattccgccgcccccgcttcgcgcttgctgaaccagaggctcgtcgaccgccgtttccgcccctgttgccggggcgtcgcattcgtcatctccgcgcgaggtccgcccgatgcagcctgcatcccagctccatcccgtttccgatcccgccgacaagatccgggtcgatctggccgcggcctatcggctggtcgcgcatttcggcctggacgacagcatcttcacccatatctcggcgcgcgtggccgatgccgaggacgggaccgggcggttcctgatcaatccctacggcctgcgcttcgacgaggtgacggcgtcgaacctggtgacggtggatctgaacggccggatcatcgacgacccctatggcgccggcatcaatgccgcgggcttcaccatccacagcgccgttcacgccgcacgtcacgacgtgcagtgcgtgctgcacacccacaccgtcgccggtgtcgccgtgtcatgccaggcagaggggttgctgccgctgaaccagtggtcgctgcagttccacgaccgcatcgccttccatgaatacgaaggcatcgcgctggatctggacgagcgcgagcggctggtgaacgatctgggtgaccgcaaggtaatgatcctgcgcaatcacggcctgatgacctgcggcgccacggtcgcggaggcgttcaagctgatgtacaatctggagcgcagctgcaaggcgcagcttgccctgcaggcctcgggcgcgcctgtccatcgcccgagcgacgaggtggcgcgcaagaccgccgcccagtattcgggctggagcgacaagcacggccacaaccggcccgacccggagtgggaggcctatctgcgcctcctccgtcggacccagcccgatttcgagaactgaccgaccagaacaggatttcgtgcccggcagggaggccgggcgcggatttcgtggccgttcgacgacagatcgaaaccaacgacaccagaacgggatgagccacgtccgaagaccgacgtaaaaccgagacgtcagggggaacaggaatgatcaggggaattctgctcggcggcgtggcagcgctgtcgtggatcttcgcggccaccgcagcacccgtcgagggaggacgggccaatgtggtgatccagcccgaaccgccgggactgatgctgggcatgatccagaacggcccgacgcagatggtggccggcaacatctatgaaggcctgctgcgctacgacaaatcgctgaagccgatgccgcagctcgccgagagctggaccgtgtccggcgacggcacgatctacaccttcaagcttcgccagggtgtcacctggcatgacggcaagccgttcacctcggccgatgtcgtcttctcggtcgacaagttcctgcgcgagacccatgcgcgcctgcgcgcctcactcgcctatgtcgacaacatctcggcgccggacgaccacaccgtcatcttcaagctgaaagagcccttcggtcccttcctcggcatctttgaggtcggcaccatgccgatggtgccgaagcacatctatgaaggcaccgactacaagaccaaccctgcgaacaacacgccgatcggcaccggcccgttcaagttcaaggaatgggtcaagggttcgcatatcctgctggtcaagaacgagaactattacgagaagggcaagccccatctcgacgagatctactggcatgtaatccctgatgcggcctcgcgcgccgtcgccttcgaaaacggcacggttgacatcctgccgggcggctcggtcgagaatttcgacgtgccgcggctgaccgcgatggacaatgtctgcgtcaccgacgagggctgggagttcttctcgcccctgtcctggctgtggctgaacaaccgtgaaggcccgaccaaggacgtgcgcttccgcaaggcgatcatgtacgcgatggatcgcgaattcgccaaggacgtgctctggaacggtctgggtgacgtggccacgggtccgttctcgtccaagatccgcttctactccgacgacgtcacaccctatccgcacgaccccgagaaggccaaggcgctgctgaaggagatgggctatgacggcacgcccgtccgcctgctgccgctgccctatggcgagacctggcagcgctgggcggaagcggtgaagcagaatctggaagaggtgggcatcaaggtcgaactggtcgcgaccgacgtcgccggctggaaccagaaggtcgccgactgggattacgacctcgccttcacctatctctaccagtatggcgacccggcgctcggcgtgtcgcggacctatgtctcgaccaacatcgccaagggctcgccttggaacaatgtcgagggctatgtctcgcccgagatcgacaagctgttccacgagggggccagcgccttctccgacaagaagcgcgaggcggtctacaaggtcgtccagaagaagctggtcgaagacgtgccggtggcctggctgctggaactcggcttcccgaccatcacccgctgcaacgtgaagaacctgatcaccacgggcatcggcgtgaacgacggcttcaaggacgcctggatcgagtgaccggcgggatgtgacggccggccgggaccgctctgtccgggagcggtcccgccgggccggccgtcgcatccgtcccgttcctgccattcccttccgggcgccccgtcgaggagacctgtcgatggcgcttgcacgcttcctgtttggccggctggtgaaggccgccctggtgctgcttgcggttctggtgctgaacttctttctgatccatgcggcgccgggtgatccggcggcggtcatggccggcgaagccggtgccgccgacgagattttcatccagcagctgcgcgagcgcttcggcctcgatcagccgctgcatgtgcagctgtggatctacctctcgggcgtggtcacgctcgacttcggctattcctatcgtcagcagatgccggtcctggatctgatcatggaccgcctgccggcgacattgctgctgaccggcaccgccttcgtgatctcgctgatcatgggcgtcgcggccggagcggttgcggccatgcgccgcggcaagtggtcggatacggccatcacgacggccgccctgatcttttatgcgacaccgctttattgggtggcgctgatggccgtgctgctcttttcggtggaactcggctggctgccgggcttcggcatggaaacggtcgggggcgatgccaccggcttcggccatgtgctcgatgtcgccgaacacctgatcctgccggccttcaccctgggtctgttcttcatggcggtctacacccgcatgacccgtgcgtcgatgctggaggtctcgcggctggatttcgtgaaaaccgcacgtgccaaggggctgaagcccgccgtcatccagcgccgccacgtgctgcgcaacgccattctgccgatcgtcaccctggccggcctccaggccgggcagatggtcggcggcgccatcctcaccgagaccgttttcgcctggccgggcatcggccggctgatgttcgaggccctgctgcagcgcgactacaacctgctgctcggcatcttcttcgtctcggcggcgatggtgatcctgttcaacctggtgaccgacctgatctaccgggtcgccgatcccaggatcgaggtgggggcatgaagaagttcctcgtgcgcttcgcgcagaaccgcggtgcggtcgtcggcatgatcatcctgctggcggtgatcgtgcttgcgatcatcgcgccgctgatctacccggtctcgccctggaagatggtgcagcgacccttcctgccgccgctcgacgtggcgggcctgcccttcggaaccgacacgctgggccgcaacgtcgcagccggcctggcccatggggcgcgggtctcgctgctgatcggcctggtctccaccgtggtggcactggccatcggcgtgccgctcggggccgtggccggctattacggcggcatcgtcgacgacgcgctgatgcgcttcaccgagttcttccagacggtgccgagtttcgcgctcgccatcgtgctggtcgcaatcttccagcccagtatcacctcgatcgtgatcgcgattgctgtcgtcagctggccacccgtggcacggctggtccgcggcgaggtgctgtcgctgcggacccgcgaatatgtcgaggcggcgatgctcgccggccagtcgaacaccacgatcattctgaagcagatcctgcccaacacgctgtcgccgatcatcgtgctggcctcgttgatggtggcgaccgcgatcctgctcgaaagctcgctctccttcctggggctgggtgatcccaatgtgatgagctggggctacatgatcggcgccgcccggaccgtgatccgccaggcctggtggctgagcttcttccccggcgtcgccattctgctgacggtgctggcgctgaacctggtcggcgaaggcctgaacgatgcgctcaacccgcgccttgcgcggcaggacgggtgagggaggcccagatgaccgaggcccagatgaccgaggatgtcctcctttcgatccgcgacctgaagctggccctgcccaagggggccgaccggcccttcgcggtcgacggggtcagctatgacctgaaggccggcgagatcctgtgcgtggtgggtgaaagcggctccggcaagtcgatggccgccaatgcggtgatgggactgctgccgccgggggtgaagccggcgggcggacagatcctgttcgacggccgcgacctgctcgccctcgacgaggccgggttccgcgaactgcgtgccgcccgcgtggcgatgatctttcaggagccgatgaccgcgctgaacccgctgatgcgggtgggcgagcagatcgccgaggtttttgagggccataaccggctgaagcccagggagcggcgtgcccgggccctggatctgctgaccgaggtcggcatcccggatcctgcacgggcgatcgacgcctatccctttcagctgtcgggcggtcagcgccagcgggtgatgatcgccatggcgctggcgctggagccccggctgctgattgccgacgagccgaccacggcgctcgacgtcaccacccaggcccagatcctggaactgatccgcgacctgcagcgccgccacggcatgggggtgatgttcatcacccacgacttcggcgtggtggccgagatcgccgaccgtgtctgcgtgatgcgctatggccaggtggtcgagatcggcacggccgcgaaggttctgggcgcgccggaacatgaatatacccgcgggctgatcgatgcgatcccgggcatgggcgtgcccgatcgcaagccggtagagggcgaggtcctgctcaaggtgcgcgggctgaccaagacctatcacggcaagggcgggctgacccgcaaggcacgggtggtcaaggcggtagacgacatctccttcgatcttgcccgtggcgagacgctgggcatcgttggcgaaagcggatcgggcaagtcgaccctcgggcgctgcatcgtgcggttgatcgaccccgagaccggctcggccgagatcggcggggtcgatctcgcaaccctgaacggggcggccctccgccgcgaacgccggcgggtgcagatggtgttccaggacccctacggctcgctcaatccccgcacgcgggtggggcagatcatcgccgaaggcccgatcgcggccggtgtgtcggccgccgaggcgcgcaaacgcgcgcgggaactgctggaagtggtggggctggatgcctctgccgccgaccgttttccgcatgaattctcgggcggccagcgccagcgtatcggcattgcccgggcgctcgcgctcgatcctgagctgatcatcgccgacgaggcggtctcggccctcgacgtctccatccaggcccaggtgctcgacctcttggccgaactcaagacccgtctcaggctgtccatgctgttcgtgacccacgacctgcgcgtcgcggcgcagatctgcgaccgcatcgccgtgatgcagcgcggccgcatcgttgaactcggtccggtggccgaggtgttcggcgcgccgaagagcgactacacccgcgacctgctggcggccattccgggccgtggcccgggcacgccgctcaagcgcttcgccgcaggtgccggcgcatgaccaccatgccgcgggcgcgccgttgcgtctggttgagtgccaccctggatctcggcgccatcttcggcgccgatttccgggcccatgcgccgcatatcgaactggtcgacgccgtcaccgcggcggaggacccggcctcggtcgatttcgccctggcctggaagccggcggccgatgccttcatccccttcccgaggcttgccttcgtatcgtcgatcgcagccggggtcgacaacattctggcctgccccagcctgccccaggggctgccggtgctgagggtgcgggatgacgatcaggcacggatgatggccgggttcgcggcctggcacgtgctctggcatcaccggagcatgggcgattatctggcccagcagcgcgagggcgtctggcgacgcaagctgcgcaagcagccggcgcgcgaggtgcggatcctgatcctgggcttcggccatatggggcgggtggcggccggcgtgctctcgggcctcggctatgacgtgcgggcggtggcccgccgggcgccggatcccgccctggtgccccatggcgtgaccgtggaggccgggcccgatgcgctcgatcgcctgctgcctgcggcggatatggtgatcaacctgctgcctttgaccgaggacacccgcagcctgctggcggcggatttcttcgcgaaactgccggccggggccgtgttgatccagcttggtcgcggcgaacagctgatcgaggccgatctgctggcggcgctggatgccgggcagttgtcggcggcctcgctcgatgtcttccaggtcgagccgctgccggccgatcaccccttctggcgcgatccgcgcattctgatcacgccgcatgaagcgagcgagccggatgccggggcgcttgcccgtcacatcgccgcggcggcggagcgtctggaccgggggttgccggtcgagacctcggtcgatcgcggcgccggatactgatcgctccggttcctgcactcctttcgggacgtgtgcctcatgaaagtcgtcttcgacccccgccagaccgcccatgcgccggagcagtatttccgccgtggtgccttcattccccatcccgagcagccgctgcgcgcgatcctgctgcgcgacgcgctggccggtgccggccacgagatcgtgacgccggcggatcacggcctggactcgctctatgccgttcatgatcagggctatgtcgatttcttccgcaccgcctgggcgcggtgggtggaggcgaccgggagcaccaacccggccgtgcccaattatcacaccacacggcgtgatgcacgccggcccgaaggcgtgatcggccagctcggctactattccaccgacacggcctgccccgtgaccgagggcacctgggaggcgatctactggtcggcccagtcggcgctggacgctgccgagcgggtgatggcgggcgagcgcatggtctatggcctgtcgcgcccgcccggccatcatgcctcgtgggatgcgagcaacggcttctgcttcttcaacaatgccgccgcggccgcccatcatctccggcgccggttcggcaaggtggcgatcatcgatgtcgacacccatgccggcaacggcacccaggacatcttctacgagcgcggcgacgtgttcttcgcctcgatccatgtcgatcccaccgattacgtgccctattacgtcggctatcccgacgagaccggccgcggcgagggcgcgggtgccaatctgaacctgaccctggcaccgggatcgggcgatgccgagatcggggcggcggtcgatcgggcgctggaggcgatccgggactacggggccgaggcgctggtggtctcgctcggcttcgacatggcccatgacgacccgctttcggtggtccgctgcacggccgagggctttgccgcgacggcaaccaagatcacccgcatgggcctgcccaccgtgctggtgcaggaaggcggctatctgggcccctcgctttcgaacaatgccgtcgtcttcctcaacgcctgtgatgcggcgctgggctgaccggcgtatcgtttcatcgacagttcccccccgatcccaccccaggagccggatcatggcctacagtccgaactcgccggaagcccgcgacatcgcctaccacctccattcctataccgatgcccgccggcatgaagagaccggctcggtggtcctggagaagggtgacggggtcttcgtcgaggacatccacggcaaccgctacatcgaagcgatggcggggctgtggagcgtggcgctgggcttcagcgagaagcggctggccgatgccgccgcgcgccagatggcgaagctccccttcgcccacaccttcagctacaagtccaacggcccggtgatcgatctggccgagaagctgatctcgctcgcccccgtgccgatgagcaaggtgttcttcaccaattcgggctccgaggcgaacgacaccatcctgaagctgctctggtaccgctcgaattccatgggccagccgcagcgcaagaagatcatcagccgggtccgcggctatcacggcgtcaccatcgcctcggcgagcctgaccggtctgcccaacaatcaccgctccttcgatctgccgatcgcgaacgtgctgcataccggctcgccgcatcactggaaggacgcgaacccgggcgagagcgaagaggatttcgccacccgccgcgccgaagagctggaggcgatgatcctggccgaggggccggaaaccatcatggccttcatcggcgagccggtgatgggcgccggcggcgtggtcgtgccgcccgcgacctattgggagaagatccaggcggttctggcgaaatacgatatcctgctgatcgccgacgaggtgatctgcggcttcggccggacgggcaacatgttcggcagccagacctacgacatgcgccccgacatcatgaccatgtcgaagcagctgtcctcgtcctatctgccgatctcggccttcatgatcaacgagaaggtctacgggccgatcgctgacgagagccaccgcatcggcgtgctcggccacggcttcaccgccggcggtcatccggtcgcctcggccgtggcactcgagaacctgaagatcatcgaagagcgcgatctggtcgccaatgctcgcgagatgggtgagcgcctgcgcggtcgcttccatgccctcgaaggtcatccgctggtcggcgaggtccgcggcgtcggcctgatcgcggcggtcgaactggtgaccaacaaggaggcgaagaccgcgctggaggcccccggcgcgctcggcggcaaggttgcggccgccctgcaggcgcgtggcgtgatcgtgcgcaacatgctcgacgccatcgccttctgcccgccgctgatcatcaaggccgaagaggtcgacatgatcgccgatcgcttcgaggccgtgctgaacgacgtggcggccgaggtcctctgatccgcttgacggaaaaagaggaaacgggacacgcccggcagtcgagaatgcgacagccgggcgtttcccattgagagcgagctgtttcatccgtctgactgcgggtgaagcgccttgcagcccaaaagatggggcgcacttccggccgaaggcatagggagcggctttcagcctcgggtaggcgcggggccgcgatttctggccaggccgatgccggcgtttccgtggcggagcccggtaccgcggccccctgatctcgccgagggaggtgatctatctctgatcggccatgtgtagcctggcgcatattttcgacatcatgtgcaggaacttgatgagtcgttccgttgtgtgtcgtattccatgtcgcgctgcaatgcggcagggggccgagacatgtcgcatttcacggcgcgatcatgctatctagcgatgctccgcttgcgccctgacaggacggaaatgagcggacgccaaccggggcgctgccggaagatgcgatcgagacacagtggatatccgcatgactgagcctgtggaaggaattggcaagactgccactcgcagtgtcggatggtcgatggctcagaattgggggggacgattctttacgttcgccttgttcgtcgtacttgcgcgactcctgacgccacacgactttggcgttgtctctgcggcgaatatagttttgctttttattgcgatggtttcggattttggcttcggtgaagccatcgtccagcgccggaacatgaagcacactgacgtcaatttgccattttttttctctctattcatgtcgctgactctggcgtttgtggtctcgatgaatgcagagatcgtgagcggttggcttaacgtagagggcgttgagatcgttctagccacgatctgtttcattgcacccctgacgactctttctcaatttcaggaatacaattatcgtaaacagcttcgtttcaaggcactcgccttccgcgtgtttgtcgcgaatatcatagcgggagctgcatctatcgctaccgtcctggccgggtttggcatttgggcgcttgttgtgcagatgtatgtcaccattctggtcagtctgatctggctttggtcaatgccagtttggaagccgacgtttacgctcgacttcaaggcattccgggaactcgcccgctttgggttctctgtcgtcacgatgcgggtcttcgattttctggcccagagatttgtcgagttctttgttatcggccgctatggggtggccatattcggtctttatgctgtcggcgcccgcgtttatcagatcatgatgcagcttttgcaaggggcgctgagtgatgcctctctcgctgtgctgtccacaattgcccataaccgggccaagatggccgagctgtacctcaaaaccattgtgatttccaatttcctgtttgcgccggtgttctgcttcgtggcggctctctcgccggagatttcgttgattctgtttggcgcgaaatgggagggggtcgaggatattatgcgaccgctgatgatcttgggtgcagtgcaatgcagccagttcatgaacggcccctttctgagcgccatggggcggccgtcgctggtaatgtatgtgtcagcgatcaagaacctggccgcgccaatcgctcttctgaccattccgagcgccggggtcgccgatgtggcaatgatctgggccttttcgcagtttttggggacgcccttttcgtttgggcttaccgcgcgcgaactgaaagtcccgatcctcagggtcatcctgaacgcggcgccggcggtgctgggctgtgtggcggcggatcttgctgtagatgcgcttcgtgatcacctgtcttcaagtattgactccgtatttctgatgggaatcgttctcggggcgtcttatttcgctgtgtatggcatgataagttgcagcctggggtacaggcaggtaaaaaccattgtgaccttcgtgcgcaacagaatgaattcgaggtagtcatgtcggtgaaggccctcgtcaagagtctcattccaacgccgttgatgaagagactttcggcggcgagaactgcctccaggtttgaagccaccctttccgactgggataaggcaacggcgagagtggtgcagcgggacgttcagcgtcctgtacgcagggtactggttgtgccgagcgacacggaaaccctgatcggcgctctcggagacgatgcaatgatctccgccatcggcagcatgtgtcggtccgtcagtccgacggtggagatcgttattgtcatccagggggcagccgccgctgccactgctcgctcgcgagggctggttccgctcgatatctggggtgcgccagattttatgggagaaatcgtcaagatcctgaatgccggcgatatcgatgcagcctttgccttgggggctgatgttatggacggctattacagtccgattgtccctgcaagaattgcagcggtgatggacctcgcttgccgatgcgggatccctgccacaattctcggattcagtttcaacaatgcgcctcatccgggactcagcgaggcgttcgaccgcatgcattctgatgttcaggtctgcctgcgggacgagatttcactcgagcggtttcggcgtttttcctcgcatccggctcgtctcgtcgcggattctgcgttcatgctcgttccatcagaaccggcacaggctgaggcggactggattgctgcgaggcgggctgccggcgacagagtgatcggcgtcaatctccatcctatgctgattcgcaatgcgacaccggagcaggtgaacgagattgttcgggtcggagcggaggcattgcttgccgtcgctgcaaagcggccggtttcgtggttcctgctcccgcacgactatcgtggtgagctcggtgatgcgcgttgcctggagccgatccgcaatgcgatcagcggaagactgggggaacgggtacgttacctggaggggatgcatctggccgcggatctgaaggggctggctggtatcctggacggcattgtcactggccgcatgcatcttgccatcggcagccttgggcaggggacgccgacggtcagcgtgacttaccaggacaagttcgaggggctttaccgacatttcggcctgcccgattggatgttgttgtcccctcagcgctatctcacaccgggcagctttgaagcggcgctgactcgtttcgtcgatgaaatcgatcaggtcacggcgatcgttgagagccgggcaggggccgtaaaagacctctcccgtgacaatttttcgtcgatcctttagacagcctgatccacagcacgcgatgctggttcgagcaccgcgtgctgtgatgacatcaggctgcgggctgatctttgtgggccatctcaatgatggtgtgggcgagcagtccctcccgccgacggagttggtcttcataggcggtgaactgtcgctgcgccagatctgcaagagcctcaggattttgcagcataccggcgatcatggctgcagccgccacggcgtcgctgcgatcaaagattgcatcctggggcatccagggcaggccggcagcaccattctgtgttgtgagcactggcatagcgtgggcgagtgcagcaagcactttcattttgaccccggatcccagttcgatcgggcagatgaatgcgtcgcattcgagatgaagctgctgcagcctttcctccgacacgaagccttgatagtggacattggggtgccgttccgcagcgatatcgggctgtgatgtaccgcaaaggatgattcggagtgatggaattagtgtcgtgagtcggggggcgagctcctgtaccagccagaggatcgcttcatgattgggaaaataaccggatgacccgacaaaaagtagagaatgtgtccctgagtatttccatcggattggcgcgcgcgggaggaattcggggagtgcactgaccttctccgtatcggagcccttgagccggcgcagttcaggaatatccgtagtggcgatacagagaatacgatctgattgtttgatcaagcgcagctccgcttgcttggctttgcgatgctcccaatagtggagataacgtaggggattgaatcggcccgtcatatcgactttttggcgggtaattgtatgttcgacattatgcgcgatatacagcacgggaacgtcgtgttcgagtccgtcgataagcgggacgccaccatagtgatcgatgacgattacgtcaaaggtgcgatttttaagggcatttgacacgaaagaaagagcctttggattggctcttagctcaagatctcttggcagagaagagaacaagacctgctttatggccttcagaatagccgggatgctttgcagccggggcagcgagcgctcgaactcgattgactggatgcccatttccttctgccattcaatcgtgcccagcccctgcaggccaacatcgatcgcaaggacggtgacttcgagccgggcatcggtggcaacttcacgcaaatgattggtgagggccatctttccgccgctcgtggccgggatgggcatctcggacacgacatagagtactttcacttttttgagtggaagtgtttcgcgctcggcggatgttgcgttggccgcagtcatgtgatccagcggacgggtcatacgttcataacgctttcgacggtgcgggacgagggctggcggcgcccactgtagcggcggccacatcctgctgtccacatgccctccggctggacgtatggcgggttgtcaaacccgcttctgcagccacgcctctgccccgcgccccagattgagggcggccagatcccccttcacctcgaccaccatcagccggtcgagttcgtcgtccatatactgggcaagccagccgcggaccatttcggccgaggcctcgaggtcgatcagccaggcatcttccagcgcatgggcatgggccaccgaggcgagcgccttgtgcaggcggtcgtagctctgcccttcggcgcggagttcataggtcaccagatagacggccatccgcggatcgatcccctgtggtgacggcatccgtgccgggacgcggttcgtccggcggtgccgttcccctttcaggtgatgttcgcgggcgacatgtcaaagggcaagccctcgtcgacatgtcggccggtctgtcgatgttccgcctctcaacgttcttcgatgcggtcctcgatcgcccggcccgagagcagccagccgcggcgcagatcctcgatatggcgggccatccaggtcgatgcctcgtcggcatccctgagtttcagggcggccacgatcgcccggtgggcctcgagattgcggcggggggcctgcttcacctgtttgccgagttcgacatagggtcggaacagcagctggccgatcggctcgcgcgacagcatcagcgcgcggttgcccgagaattcggccagcatggtatggaactcggtatcgacaccgtcggtcggctcccccgccgccaccagatgggcggtggcatccaggttcacctccagcgcgtcgatctgtgcatcggtgatccgggcggcggcgagcgaggcggcgagcggttccagaacccgggcgacttcccagagttccttgaacttcacgtcatgcatcagcagcgcgcgttccatccggggcgagatgtcctcctgccccggtatggcgatcaccagccgcttgcggccctcccgccggagcagcccttcgctttccagctgccggattccctcgcggatggtggagcggttgacgccgaaacgggtggcgagttcggtttcgctgggcaattgttcgcccggcttcagccggccgtcgacgatgaggcgctggagctccttcgagacgacctgataggccggcgggatcttcagtttcgcgatctcgagcatgacgaccgtccagcatccggggtgaaaacgcgccgcatcggtgtaaccgaaccgccgggcgggggaaagccgttccggttccgcaatttacccataaaccgcccggcggggctattgcccgccggcggtggggtcggcctctgccgcaggcagcggcgtgccggtcgcgaaatggcggacatgcagggcgatctgccagaccatctcgatcgccatcagcccgagcgccagcggcaccatcatgatgaacggccagaccggaaagaaatccgatcccagctgcatggtccgcccggtcctgaggccggtggccgcatactgggcgaggtaccagaacaggaacaggaagatggcaagctcgaccaccagcatcaggatcgcgactgccgatccggcccgccggggcagggtggtcgcaatcacctccagccgggggaagatcccgtcacgatgggcgagcggcagggcccagaacaccatcagcggaaagagcatgcgttcgatgatgttataggcgcccggcacgagatccgtatgcagggcatagcggccgaagacgctgagcacggtcaggatcatcaccgcgaacaggcagagcccggcgccgatcgaggccagcccccattcgaagcggccgagcaggccgtgaagtctggtcatgggtctcaccgaaggttgccgggcagccaggtgacgatcccggggaagaggatcgtggcgccgatgacgatcacggccgaggcgagcgcgaatttgccggccgggcggaagacttctgccaccggatgacgttgtgccgccgcggcggcataggccgaaaggccgaccgggggcgtcagcaggccgagggcgatcatgaagctggccagcacgccgaaccagagcaggtcgataccggcggcctccagcatcggcagcacgatcggcacgatcagcaggatcaccgcggcgctctccaggatcatgccggcgatgaacagcaccgccatcaataccgcgaccagcaggccgggcgagccgaccagcggctcggcgagcgccagcagatcgcggggcaggcgcgagaaggccaggaagcgggcgaagatctgagccccgatcacgatcagcatcagcatggccgagatcttgacactgtcggccagggccgccgccagatcgcgccagccgatccggcgcatgagggtgagaccgaccagggcggtgaaggcgccgacggcccccgcctcacccacggtgatgatgccggtatagatcccgccgaacaccaccagcatcagggccatcatgaacagcgaggccccgagtgcgccccgctccagttcggagggctgatcggggcgggcgccgggggcggcaccttccgggcgcagttcctcgaacagcgcgaggcagccgatatagaccagcatgcacagcagcccggggccgagcagaccgatgaacagggcgccgatcggcaccgaggtgatggcgccgtagatgatcacgatcaggctgggcggaatgaccgccgagagcgaacccgccaccgccgcaaggccgatcgcgaaacggcggctgtagccgacacgttccagttccggggccgagagggtcgcgagcgaggcggcggaggcggcccccgaacccgagaccgcgcccagcagcccgccgatcaccagcgtggcgacgccgagcggaaagcgccggtagccggccatgcgatggccgacgcggaacaggtcgagcaccagcccgccgcggagcagcagctgggccatcagcaggtagagcgggatgatcgacagcgaatagttcgacgccgtgtagaacacgtcctggccgagcacgccgttcagcacccgcgggccggtccagagcaggatgccgacgatgccggtccccagcaggaccgtggcgacatgctggccgagcagcaggaaaaagacgaaccagccggcgacgatcagcaggatgatgtcgtgggacatgggatccgggccttgcacgagaccttcaggcccgccggtgttgccggcgggagaggggagggggagggccgggcccgctagcgggtccggccggccagcggatcaggcccccttttcgagataggcggccacgccctcgggcagcttgccgccctggtcctgaaccagcttcgcccagaggcgggcggtggcgaggcccggatggccggcggcctcggtctgctccacccagcgccgccaggtcgcggtcgaggcggtttcgatggcggccttgagatcgggggcgatggtcgagagatcggcgaaagtcgaccccttggcggcggccgcttcgcgcacttcggtgtcctgcgcctcgatcagctcggcattgcgcagcgcgatctcgcgcgccgtatcggcccagagcttctgctcatcggcggaaagcccggtccagccggtgtccgagatggcgagatagctgccccaatggccgacggcgacgccggtgacggtataggtcagcacatcctgcagcgaataggaccgccagtcgccgatcgacaggatggtgccttcgaccgtgccgcgcgacagcgcttcataggaggccgaagacggcatggtgacgggcgtggcgccaagctcgctcaggaaaatggtgtgcagggcggagccggcgcggagcggcatgcccttcaggtctgcggccgatttgggcgtcttgttggcgaagctgatcgcataggccgccgtggtgccgaccggccaggcatggatgcctttggcggcgatttcgtagtcgtagaaggtcttgccgtcgaccagttcggtcttgctgtccatcagcgccaggaaggccttggtctgggtgacggagctggtgccgaccgtcggcagctgggtgacgtcggagagcgggaaggcgccctcgtgatagggggcgagcaggggggccgccacgtcgatggcgccgccctgcagcgcatcgagttcacggccgaccgaggtgagttcaccggcgtagaagcgggtgaaggcgatgtcgccatggctccgctcttcgatcgcgtcggcgaagaggtccatgtgcttgccgacccagaaatgcacctggggcagcgatgacgccatgatcagatcggcgccggcctgggcaccggtggcggcgacggagagacagccggcgagggcggtcacggcgaagcggttcatgggcagtcctcccttggcgtccggatcgtcaggcgtccggatcttcatctgtcgggtcgccggatggcggcgatgcggctgtcaggcggtggcctcttcgatgagggccacaccccttgcagccagggccggcgccagccggccgacttcggcggcgtcatcggatgccgcattgccctggcgggcacgggcggcgatgccttcgaagatcaccgcattgcggaacagggcgagcaccagatggaagcgggtgagcgggccggcctggcccgaggcttcgaaataggcccggcagaaggcgtccatctcgggcaggcccagcgctgcgcggtcgagcccggcgaggccccggccgtattcttccggccgcatcatccaggtgtagatgcagctgtgggcgagatcggcgagagggtggcccagggtcgacagctcccagtcgagcaccgccacgatgcggggctcggtcgggtggaacatcacattgcccaggcggaaatcgccatggaccagggtggtgcggtcatcctcgggcagattgcggggcagccagtcgatcagccgctccatcgccggatcggcggcggtggccgagagctgccactgcttggtccagcgggcgatctggcgggcggcgaagccgccgctgcggccgtaactgccaaggccggctgcattcacatcgaccgcgtggatggcggccagcatgcgggcgagggcatcgaaatacgacctgcgctcaccgatcgggatgccgggcaggctgttatcgtgcagcacgcggccgtcgacccgctccatcacatagaattgggtgccgatgacggcaggatcgtcgcagaaatggaccatgcgcggcaccgcgacaccggtatcggccagcgcggcctgcacccggtattcccgatcgaccgcatgggccgacggcagcagcgtgcccgccggccgcttgcgcagcaccagacgccggctgccggtgtcgaggaaataggtcgggttggactggccgccgccgagccgggtgaggctgacggcggggccggcgccgtcgacccgtgccgccagataggcggccagggcccgggtgtcgatatcggcagaggacgtggtgctggaggtcatggcggaaacgggtccggacgtcggccggacatgccggcggtcatgcgagagcggttccatcgcgggcctcgaggggcctgagcgagggaccatctggacgggaggtgtcgggagcggcgttgcgcctgaccggcgcgacatcgtcgttgaactatagctaggaggagggatatccttctgtcaatcggattgtccgacaaacagacgaatcgaggccgcacagaatccggcccgaaggaggaagcccatggtcttcgaggacatcgcctatgcggtggacggcccggtcgcgacgatcagcttcgcgcgtccggaggtgatgaacgcggcgcggaacgagacccatctggagctgcaggccgcgctggatgcagcggatcgggacgatgccgtgcgtgcggtgatcgtgaccggcaccggccgggccttctgcgccggcaccgacatctcggacggctttcgcctgccggccggcggcgatccggcgacgggggatggggtgcctgcggatgtgggcggcgtgaccgtgctgcggctgttccggatgcgcaagccggtgattgcggcgatcaacggggccgcggcgggcttcggagctacgttcaccctggcgatggacatccggctggcggcggcgacggcgaaattcgcctttccctttacccggcggggcatttgtgccgagagctgttccagttggttcctgccccgactggtgggcatgcagaccgcccaggactggatgctgaccgggcgaaccttcccggcctctgaagccctggcgcgtgggctggtccatgagcttctggccgccgaagacctgttgccgcgggcacgggcgctggcgctggacatcgcggagaactgcgccccggtctcggtggcgctgaaccgccagttgctgtggcggatgatgggggcggatcatcctgagatcgcgcacgcgctggagagccgggcggtcgcggcccggatggcgagcgacgatgtgcgcgagggcgtcgacagcttcaaggagcgccgggcaccgcgcttcggcgacgggctggccgatgcgccctacatgaccgcctggtggcccgatctcaaggcttgaggcagggtaggttctgaaactgaagacctgaaactgaaccctgaaatcgaaaagggggcccccccttcccgggcagccccctttgcctaccgagcgtcgcagacgcgacgatcagacctcgctggtgcgccggcgccgcgtccaggacgaggcagtggctcccagggtggcgggaccgagcagccggttcaccggccgcatgttgcgcgatcccatggcgttgccccgcagacggctctcgaccgactcggaccggggaagcggctgcgccatcagcgcgcggccttcgaacccgccgggcagggcaaacaaatgtgcaagacgcacgagacaccttttggtggttgacgatgagaggaagatagcgcacaaacgcccgcttgtgcagagggggccggcaagattccgccagcccctggcgcgcggctgccctgcgcgccccacagccctcgatcgtcttcccctggcccccttaattctgggccgactgcgccagaccgcccgatttgcgcatcatccgtgcggcgacgatcacagcgatcgtcaccagcaccaccaggatggtggcaagggcattgatcttggggctgacgcccaggcgcacgctcgagaagatgaccatcggcagggtgctggaggcagggcctgagacgaagcttgcgatcaccagatcatcgagcgacagggtgaaggacaaaagccagcccgccaccagtgctggggcgatgatcggcagggtgatcacgaagaacaccttggccggatgggcgcccagatccagcgccgcctcttccaggctgatgtcgaagctcgccagccgtgactggacgatgaccgcgacataggcggtggagaaggtgacatgggcgatgatgatggtcatcaccccgcggcccgccggccagccgatcatctgttcgagcgtcacgaacagcagcagcagcgacaggccggtgatcacctcgggcatcaccagcggcgcgctgatcatgcccgagaacagggtccggccccggaaccggccgaagcgcaccagcgccacggcggccatcgtccccaggatcagggccagcgtggcggagatggcggcgatccggaagctgacccaggccgcgttcaggatggcatcgtcacgcagcagctcgccataccatttgggcgagaacccggcccagacggtgaccaggcgcgactcgttgaaggaatagacgatcagcagcaggatcggcacatagagaaacaggaagccgaccagaagcgaggtgaggcggaaccagggaaaacgggtggccatgatgctctgtcgctccccttacccgcgcccggcgccgcgcgcctgtacgttctggaagatcatgatcggcaccaccagcagcagcagcatggcgatggcgaccgcggaggccaccggccagtcgcggttctggaagaattcgttccacagcacccggccgatcatcaccgtgtccggcccgcccagcaggtcggggatgacgaactcgcccatcgccgggatgaagaccagcatggcgccggcgatcacgcccggcatggaaagcggcagggtgatggcgaaaaacgccttcaccggccggcatcccagatccgccgccgcttccagaaggctgaggtccatcttttcgagcgtggcataaagcggcagcaccatgaagggcaggtagctgtagacgatgccgatcaccacagcgaagttgttgttgatcagcggcagcggctcgctgatcacgcccgcccacatcagggcgttgttgatcaggccgttgctctgcagcagtccgatccaggcatagacccggatcaggaacgaggtccagaacggcagcacgatcagcagcagcagcagcggtcggatcttctggtcgctgcgggcgatcgcataggccagcggatagccgagcagcagcgaaacgatggtcgagaccgccgccagttccgcgctgttcagataggcgtggatatagagcggatcgtcgagcagataggcgtagttgccgagattgaccgtgatggtcagcgccagatcgtcgacccattccagcagcggcgtgtagggcggctggccgatgatcgcctcggcgaggctgatcttcaggatgatgacgaagggcagcaggaagaaggcgagcagccagacatagggcatcgccaccacgatgcccttgccgggcatcggcaggcgcaggcgacggccggcatcgggcgttgctgcgggcgtttcgagatcggccatccggtcggtcccttcggctcgggaagaagcaaggagacgggcggtgcgccccgggcaggggcggccgtcaggccatcagcaccacggcattgccgggatgccaggagatgtagacctcgtcatcccacgagatctcgggctcggccaggcgcagcatgttgtgggtggtggccagcaccatcttcccgctcgccaggcgcacgtgataggtcgacacatcgcccagatagacgatgtcctgcaccacgcccttgtacacattgggcgtatcggtgggggcggtcaggctgagccggaccttctcggggcggatggccacccagagcgtctggttctcggtcgcagacaccccgtgtgcgacctgaatccggccgccggtctcctcgctgtcgatcaccgcgccgtcggagtgttcttcggcgatgtagccttcgaacatcgtgaccgagccgatgaagtcggcgacgaaacggctggtcgggtactcgtagatctcgttgggggtgccgatctggtcgatccggcccgagcgcatcacgccgatccggctcgacatcgtcatcgcttcttcctggtcgtgggtgaccatgacgaaggtgacgccgaccgattcctgaatattgaccagctccagctgggtgcgttccctgagcttcttgtcgagcgcgcccagaggctcgtcgagcagcagcagcttcggccgcttgaccaggctgcgcgccagggccacccgctggcgctggccgcccgacagctggtcgggcttgcggcgcatgaagtcctgcatctggaccagcgtcaggacgtcggccacccgctcgcggatctccgccttgggcagcccttcctgcttcagcccgaacgccacgttctgctccacggtcatgtgggggaacagggcgtaggactggaacatcatgttcaccggccgctgatagggcggcacctgggcgacgtcgacgccgtcgatcaggatctgtcccgcggtcggcgtttcgaaaccggccagcatgcgcagcagcgtggtcttgccgcagccggagccgccgagcagcgagaagaactcgccgcgatagatgtcgagcgacaggtcgtcgaccgcgacgaaatcgccgaagcgtttggtgacgccgacgatccgcacatagggcacggcatcgtcatccgcccagggctgggacggggccggccgggcggggcgcgtggcccgctcgcgctgttccatggtcatcgggaacattccctccgcaagctgcgggatctgcccgacccggaccgacatccccatgtccgggccgggccgtcactgccggaacgcgaacggggcgaccgcctcgaccctgtcggacaagacgaccgccccgatcgatcatgaaagctcagccttcgctgccgctgcggatccgggtccaggcgcgggtgcgggcccgctcgtatttcaggtcgtgcggggtcaccacccacagccggttcatcgtctcttccgagggatagatcccggggtcgttgcgcacgtcttccgagaccagcggggtcgccttggcattggcgttggcataggcgacatagtccgaaatcgccgccgtcaccttgggctcgaggatgtagttgatgaaggtgtgggcgttctcggggtgcggcgcatcggccgggatcgccagcatgtcgaaccagagctgggcgccctcgctcgggatcacatagacgatctcgttgccgttatcggcttcctgggcgcggtcgcgtgcctgaaggatgtcgcccgaataccccatggccacgcagacctcgccattggccaggtcgttgatgtactggctgttgtggaatttgcggatatgaggccggatcttcatgtaggcctcggccaccttgtccacatcctcgaccttatgaccgtcgggatcgaggccgagatagttgagcatggccgggaaggtctcgtccgggctgtccatcaccgagacgccgcaatcggccagcttcgagaccacttccgggtcgaagatcagccgccagctgtcgagcggagcgttctcgcccagccgttccttgaccatcttgacgttgtagccgatgccggtcgtgccccacatatagggcaccagatgctcgttgcccggatcgtatttggccacccgcgccatcagcttcgggtcgagattgccgaaattcggaatcttcgacttgtcgagcttctgatagatccccgacttcagctggcgtgccgcatagggcgcgagcgtcgggcccacgacgtcgtaaccggaacggccggcgagcagcttcgactccagcacgtcctgggtgtcatagacgtcgtaattgaccttgatgccgctctgctgctcgaaattcgggaccgtatcctcggccacgtagtccgaccagttatagacgttcaggaccttctcttcggcggcctgggcactgcccagggcgagaagcgcgataccggcggcaaggccggtgacggccgcagatccggtggtcgggcgacgggtgcgtcggttggtcatcgggcggcgcctcatccttatcatgcgcgggcgtctgtccgcgctcggttccgcaacggcagaccgcgggccgtcgtgaacgaccgccgccgcctgcacttcggggcgagccggagcacggcgggacaccgcgctccgaccggcatttttcgacaaggcgcccgccgcggtcaaccgcggccgggggaagagggacgccgctcgtcacgttttccgaaaaaattcgtcttgcaatgacgaacgatcagacgttgagcagcaggcactcccgttcccacgaggagatcacgctggaataggcgtcgtattcggcctccttgacggcgatcagcaccttcacgaagcgttcgcccagaagctcgaccagcggatcgcaatctgccagctgcgacagcgcatcgggcaggtggcggggcaggccatgggcacggacataggccgatccgcgcagcggttcggtgggcgtcagcccctccatcatgcccagatagccgcaggccaggctggcggcgatggcgagatagggattggcatcagcacccggcacccggttttcgatccgccgggcatcgggctctgaatgcggcacgcgcaggccgcaggtccggttctcgtagccccagtcgacattgatcggcgcatcggaatggcggatcagccgacggtagctgttcacattgggcgcgatcagcggcatcaccgccggcaggtatttctgcaggccggcaatgaagccgtagagcagttccgaactggctccgccttcaccgacgaacaggttccgcccggtttcgacatcggtcagcgactgatggatgtgcatggcgctgcccggctcgcgctgcatgggcttcgccatgaaggtcgcatagaccttgtgccggatcgccgcctcgcggacggtgcgcttgaacaggaaggtctggtcggccagctccagcgggttgccgtggttgaagttgatctccatctgtgcggcacccgcctcgtgggtcagggtgtcgatgtcgatctcctgcgcttcacagaagtcgtacatctcttcgaacaggggatcgaactcgttgacggcatcgataccgaaggcctggcgcccggtctcgggccggccgctgcggccgaccggcggctccagcgggtagtcggggtcgtggttgatcttgaccaggaagaattccagctccggcgccaccaccggggcccagcccttgtcggcgaagcgctgaagcacccggcgcagcacgtagcgtggggcgatgtcgcaggggcggccgtcgagataatagcagtcgcacagcacctgggcggtggcgtcgacataccagggaaccttgcggatggagttctcgtcgggcttcatccagacatcgggcatcgcctcgtcggtgatgtcctcgtcggggtattccccggtgaccgtctgggtgaagaccggttccggcagccggagcccgtggctcgtcaggctgcggacgaatttgtcggcgggcaggatcttgccgcgggccaccccgctcagatccggcaccaggcattcgatttcggtgatcgcgttggctttgagccagtccgcaaggctgtccatgaaccacccgaagctgagagaaccccgcatccggtgccatgcaaccggcgccgcccgcctccccacgaaggcgccgtcatccggccgcataccgtgctcccgccgaagggcagccggatcggaccggccgtcggggaggacgtggatgcgaggggcctgtccgccgggtgcggtgggcgcgtaagggggccgggcggccggaaaaacctgaagaagaactggaccgggcgtccggacggtgggcctggcggaccgacacgttacccgtcaaggataagccggccgcgatcgggctggcaaggggcccgcaaagccggtgccccaaaagaaacaggggaccagcctgctcggctggtcccctgaatggcgcaccggggaagattcgaactcccgacccccagattcgtagtctgatgctctatccaactgagctaccggtgcgtatccgtcctcatcttcggtggtgttcggagcatcgtccgggccacctcgtcgggacgggcggaacttaaggcggggcggcggggaatgcaagcgaaatgtggcgatttcttgaaccccccgccatgccggcgtcagacgtgatgacaggcggccaggcgccccccggccacgggcttcagctccgggcgttccgtgccgcagcgggccgtggcgcgggcgcagcggggcatgaaggcgcaggccggcttcgactggccggccgcctggggctgcagagcgggaccctgatccgccgtctggcgggcgcgccgcctgcggctgcgggcgggatcgggcaccggcaccgcccccagcagcatctgcgtgtaggggtgggccggcgcgcggaagatctcggcggtagccccggtctcgacgatccggccgagatacatcaccgccacccggtcggtgacatggccgaccacgcccagatcatggctgatgaacagatagcccatgccgacggccgcctgcaggtccatcatcaggttcagcacctgcgactgtaccgagacgtcgagtgcggagaccgcctcgtcggccacgatcagcttcggccgggtgatcagggcccgggcgatggcgatgcgctggcgctggccgcccgagaactcatgcgggtagcggtcggcatcggtcgggcgcaggcccacctgggccagcgcctcggcaacccggccggcgcgctcgccccgggtgccgacatgcagcccctccatcggctcggcgatgatccgctccaccttgtggcgcggatccagcgagccatagggatcctggaacaccatctgcaggtcgcggcgccgcttcagcaggtcgcggcctttcagcgtgaacaggtcgtcgccgtcgaaccagaccttgccggcgctcggggcttccagcgccaccacggtgcgggccagggtcgacttgccgcagcccgactcgcccacgatgccgacgctttcgcccggcgccatctcaagatcgacaccgtcaagcgcccgcagcaccggcggcgcctgggtcagccgctcgcgcggcaggcggtattcgcgcaccagcccctgaatgcgcagcaggggcgtccgggcggcatcggctgcgggccgggaggcagtctctgcggcgatcatgcggcgaactccggaatatgctcacccttggccaccgggtggacgcaggcgacgccgtgatcgggggcaagcggcacccaggggatgtcgccggcacaggcggcatccgaccgcgggcagcggccggcgaaggcgcagccgggcggcaggcgccgcggatcgggcaccgtgccgggaatggtcgccagccgcggccgggtatgggccggaccgtcgccatcggccgcatgttccagcccgtgggcatggggaatggcggcgaacaggccgtgggtatagggatggcccatctgcgcgaagagcggctcggtcggtgcggcctcgacgatcgcgcccgcatacatcactgcggtcttgtcgaccgtctcggcgatgacgcccaggtcatgggtgatcagcaccagccccatgcgcatctcttcgaccagctccaccactagatccagaatctgggcctggatggtgacgtcgagcgcggtggtcggctcgtcggcgatcagcagcttgggctcgcaggcaagggctgccgcgatcatgacgcgctggcgctgcccgcccgaaagctggtgggggtagaggtcgagcgggaagcgcttcgcattcagccccacccgttccagcagccgccgggcgcggccgtcggcttcggcccggccgatgccgagatgcaggcgcatgccttccgagacctgctggccgatggtcttgaccgggttgagcgcggtcatcggctcctggaagatcatggccatgttgcggccgcggcgcttgcagagctcgggctccgacagccgggtcagttcctcgccggccagccggatcgatccttcgaccatcgccttgtcgggcagcaggcccatgatggcgagcgcggtcatggatttgcccgagccgctttcgcccaccaggcccagcatctggccggcggcgacgtcgaagctgacgccgcgcagaatcggcgccgggccgtcgggcgtgggcagcgtcacccggagatctgcgatcgagagcagaggctcgtcggttgcggtcatggggctggcggtccttcaggcacgggcggggttggacggatgggcgggggtggcgaaccggaagcctggcatcagcgggcccgccggagcttggggtcgagcacgtcgcgcagaccatcgcccagcaggttcaggccaagcacggtgaagacgatggcgagacccgggatgatcgccagctgcggcgccatgtagatgaaggtctgcgcctcgttcagcatccggccccagctgggggtgggcggctgggtgccgaggcccagatagctgaggccggcttccgccaggatcgcgagggcgaactggatggtcgcctgcacgatgatgatcgacaggatgttgggcagcacatggtgcagcgtgatccgcaccggccccttgccggcgagccgcgcggccatgacgtattcgcgcgaccagacggcgagggcggcaccacgggtgatgcgggcgaagaccggcacgttgaagatgccgatcgccaggatcgagttcaccgcgccggggccgagcagggcggtgatcatcaccgcggaaagcagggccgggaaggcgaaggcgaagtcgctgaagcgcatcaccagctcttcgatccagccgcgccgggcggcggcgaggcagccgagcgcggtgccgatggtcaggccgatgccgaccgccaccacgccgaccaggatcgagttctgcgccccggtcatgatcatcgacaggatgtcgcggccgaactggtcggtgccgaagagattggccgccgacggcgcctgcagacgggcgcggacattcatcttggtcggatcgagcggcgtccagaacagcgaggtcgccgcgatgccgaggaagagcagggtgatcacgccgcccacgacgaagttccggctggccagcgcccggcggaagatctcggctgaggccgaggggcggcggatggtgacggtggtggtctggctcatgggatcctccaccggctcagagcatgtcgccgccgcgccggagacgcgggtcgagggcggcataggacaggtcgaccaggaagttcacgaacaccaccacggcggcaatgaccaccaccaggctcttgaccgtgatcaggtcgcgctgggcgatcgcctgaaagatcagccggccgacgcccggcagggcgaagacgttctcgatgatgatcgtgccagcgagcagcgacgaaatctgcaggccgagaatggtgaccacggggatgagcgcattgggcacggcatggcgccagagcgccgcgcgccggtccagccccttggcgcgggcggtgcgcacataatcctcgcgcagcacttccagcaccgacgaccgggtgatgcgcgcaaggatggctgcctggggcagggcgagggcgatggcgggcagcagcagcgcgaccagcgccggaccgataccggcatcccagccggggaacccgccggcgggcgtccagcccagattgaccgcgaacaggatgatcagcagcagggcgaaccagaagttcggcacggccacgccgatctgcgagaagcccatcacgcccacatcgcccagcttattgtggttgcgggcggcaaacacgccgagcgggatggcgatcagggtggagagcgtgatcgcgaacagggcgagcggcacggtgatcgcgacgcgatcggccagcagctcggtcaccggcacgctataggtataggagcggccgaaatcgcccacgatcatgccgcccagccagccgaagaagcggtcggtgagcggctggtccagcccgagctgtgcgcgcagcgccgccaccgtgtcgggctcggcattcaggccgagcatgaccgaggccggatcgcccggcaggatttcgagcacgacgaacacgaccgttgccgcgaccagcagggtcagcatcagtgtgatcagccgtcggaacaggaacagggccatggagccggcgcgtcctcgggtggaagtgtcggtctggaagtgatggtgccgtcgggcaggcggtgctggccgccctgcggccggatcagtccggccgcagggcgaagaccggtcactcggtccagtgcaccttggtcaggtcgttgacctggaagggacggttggtccacaggccttcgaccttggcgttccacacgccgtactgcggcagctcgaacaggaaggcgttgaccgcatcctctgccagcatccgctgcgcatcgccatagagtttgatgcgctcatcctggtcggtggtcgtgtcgagctttgccatcagctcgttgaacgcgggattcttgtagttgaagtagtagttgtcgcgggcatagatcccgatgtccatcggctcggtgtgggagacgatcgtcatcccgtaagccttgttcttgaacacctggtccagccactgcgcccattccagcggtacgatttcggccttgatgccgacctcggccagcatggccgcaatgatctcgccgccgcggcgggcatagcccgggggcggcagcatcagcgcggtcttgaagccgtccggatagccggcttcggtgagcagcgccttggccttcgccggatcgtaagggtagcggtcggtcaggtcgacatagcccggcgcgctcggcgagaagtggctgccgatcggcgtgccatagccgaactggccgtcgatcacggcctggcggtcgatggcatgagacaccgcgcgacgcacgcggatgtcgttgaacggcttgacgccgttgttcatcgccaggatggtctcgccttcggtggtgccgatcgcgaccttgaagcgcgggtcggcctccagctggggcaggttctcgggcgccgggaagttcgagaaggcatcgaggtcgcccgccaggatcgcctgcagcgcggcggccggatcggcgatgaacttgatggtggcttccttcagcgcgaccttgtcgccccagtaatcgtcattgcggaccagttcgacccggtcgcccttgacccactgcttgaacttgaacgggccggtgccgaccggccgggtcttctcggcttcgccggcactctcgggtgccacgatcgcggcgtcgccccaggtcaggttgaacagcatctgaccggccggcttcgacagcttgagcacgaccgtcgaggcatccggcgtctcgatcgcggtgatcggcgcgaacaggctcttctgcgcgttgacgctgttcggcgccatcgcccgctcgaagctgaacttcacgtcggccgaatcgaagctcgtgccgtcgtggaatttgacgccctggcgcagcttgaaggtataggtcaggccgtcatccgagatggtccagctttcggccagcagcggctggatgtggccgccctcgtccagacggaccagaccctcgaagacgttgatgaagacgacctcgtcgatcgccgccgcggcacccgcggtcggatcgagatgcggcggttccagcaccgcaccgatcgagaaggtgtctttcgcggcgaaggccgcggccggcccgaaggcgaccgccgtgccaagaagcgccgcggcgagccacggcttgatggtgcccatgttttttcagcctccctgcgcggcccgattgagccgatgcccgtgaacggaccgatagccgggatagcgtcccagcgtctcggccgcatagacgccgcgggtcagggcacgggcgacgcagtcggccgcgtgcatgccgagccgcgcgacgtccaccaccggatttgcaagcggtcgcttgccggtggcgaggacgaagatcgtatcaccgtcgaacggcgtgtgcatcgggcgcaccgcgcgggcatagccatcctgggccatgatcgcgatgcgctccgcctctccgcgggtcagatccgcatcgatggcgacgatgccgattgtggtgttaccgccggcggtggctgcgacggggtcgccgccgtccagatccgccggcatcttcgtcaccccggccgccctctccccggcagccgtggtgtccagcacctctcccggcacgcctgggcgccctggggtgaaggtgaagtcgtgggtggagggcttggccagctgatgcagcggctgcccgccgaattcgtcgtcgatctcatggggccaggcccagaagcagggcgtgcccgggatgacgggggtgccgaacgcattgcaggcgaccagcgcccccaccgtgtggccttcggccgtcacgatcgatgcggtaccgaggccacccttgtaggcgcccgccttggcgccgtaaccggcaccggcattaccctcggcgacggtcgtgccaagcgcatccatcgcctggccggccagcgcccgatagggcggctccgcaccccagttcttgtcgccgccattgaccaggtcgaacaggatggccgacggcacgatcgggatgatcgcatcgccgatcttcacgccccgcccctcggccgccagccgcgacatcaccgccgaggcggcatccagcccgtaggccgacccacccgagaggacgaccgcatgcaccttctgcaccatcgatgccgaattgagggcatcggtttcgcgggtgccggggccgccgccgcgcacatccactgccgccagcatcggctcgtccggcacgatcacggtgacgccgctccacagccggtcgtcatgcgcctgtccgaccttgatgccggggacgtcggtgatcgcgttcagcggaccggggcggaactgggtcatgtttcgggaagcgctcctgaaaatcgagagggcggaacggtttcgggaccggcggcgatggcaagtcccgacatgtgaagcccgcctgtcggcaggcttcgtccgattgtttccccccttcatcaagtcgggaagcctagcgatacattttttcccggtcaactctttggaaagatttgatcttgtttcttctcgtggatgtttcgtttctgatattgtcttgaggatttctggtggcctatcgtgccgcgacatcatcgccagaggcgcggaacgtatcggtgagcagcaggtgcagggcactgtgatcaagctcgccgcggccctgttcgaccagccgggcgaaggcatcgcgaaccagggtcgaggccggcatggtcaggccattggcatcccccagccgggtggcctgcaccatgtccttcagatggatgcggcacttgccgcccgggaccagattgcccgcgaccatgcgttcgccgtgctgacgcagaatggtgccgtcggcgaagccgccgatcatcgcctcgcgcacccgggccggatcgacgccggctgcctcggccagtgccagggcttcggccaccgcctggatcaccacgccgaccaccacctggttcgcggccttggcgacctggcctgcgccagggccgccgatgcgggtgatccggctgcccagcacctgcagtaccggcagggccgcctcgaaggccgcatcttccccgccggccatgatcgagagcgtcgccgcttcggcgccgcgggtgccgccggaaaccggggcatcgatcaggctggcgccgcaaccttcggccaggcggcggccgatatcgggcgtcgccagcgggtcggtggtgcccatgtcgatcaccacccgcggtgcgggatgggccgccgtgatgccgtcggcgccgaacagcacggcttcgaccgccgcggtgtcggtgacgcagataatggcgatgtcggcgccggcggccgcctcggccgggcttgcggcggcacgggcaccggttgctgccgagacctcatccgccgcggccgggctgcggttccagacactgagatcggcgcctgctcgcgccagattgatcgccatcggccgccccatcagtccgagaccgagcatggcgatccgccggccatccagtcgcgggtgatcggcggtcccgtctcctgacggggagggcggggcaaagcggtcgggggcgctggtcatcggctggctccggcagggaggggggcgtgacatgtcgcggggcgacggatcaccgcatgatggtataagctcggccccgggctcaacgacggcttcatccgctggcccggatggcggccgtccctgacagaaaccgaggatgcgatgaccgggcatgtcgtgaccaccgaagccgaactcgatgaactttatggtaccccggtggaggcgtcgctgatcaaggaagtctcagggttgaccgcgccctatcgcgccttcgtcgaggcggccccgttcttcgccctcgccaccgtcgcggccgaggggctcgactgttcgccgcgcggcgacccggccggcttcgtgcgggtgctggacgaccggacgctggccatcccggatcggcgcggcaacaaccggatcgacagcctgcgcaacatcgtccgcgatccccgtgtcgccctgatgttcctgatccccggcaagggcgaggcgctgcggatcaatggccgggcctgcatctcgaccgatccggcgctgtgcgagagttttgcggtcgacggacacgtgccccgcaccgtgatcctggtcgccatcgacacggtctatttccagtgcgcgcgggcgctcatcaggtccgggttgtggacccccgaaacatggccggtcactgaaaccctgcccaccgccgggcagatgctgaaggcggcccgtcaggatttcgacgccgccagctacgattctgaggccgtcactcgcctgccgcgcaccctctattgatccggccggggccgacgggcaggggacgggatcgatttttccggcagatttttcgcgtcccccagccgatgccccgtcatcggccagggtattgagcccacgggattttccggtcgcggcgggtgcattgcggaaagacgttgcatccgccccgccattatggctaaacaacgggccttgcggctgaccggggcttcgtgcacgctgccgacgtagtcggtttgcgccgtctgcgccacaagatgtggtagccgcctcgaacccgacggcaggccgccgcaccgctggagtgacgatgaactcgtgctcctgcggaggtccggcaggtcgttgtgttctcgcccccaccttcgcgccagcggcggtgtccctcgagaccgccgccgggatccgcggcccgcagccgcccgcccaaggaggcgatcgagcatgtctttcatcatcgcggaagccgaagacgtcgtggccaatcctctcgatctcgttgaacagatcgtcatcgccaacgaatggccgttcgaccgccagaccgaagacgagatggccgtcgagatcaccggcaagttctgcgacttccgcctctggttcgcctggcgcccggaaactgccgcgctgcatctgtcctgcgcactggacatgaaggtgccggccggccgacgtgcgaacatctacccgctgctggcgcagctgaacgagcgcctgtggctgggccatttcgatctctggaccgaggaatcggtgccgctgttccgccacaccctgctggtccgcggcggtccgctgacccctgagcatgtggaagaggtggtggacatcgcggtctcggaatgcgagcgcgcctatcccgccttccagttcgtgatctggggcggcaagacggccgacgaggccatcaccgccgccatgttcgaaaccgtcggcgaggcctgattcccgatgaccagcgcatccgaagccgggacggccggtcagcttctcgtgatcggcgccggccggatgggcggggcgatgatcgagggttggatcgcccgtggccgcgatccgcatagcatcaccgtgatcgacccctctgccgacggccgggcccggctgcaggcccggggtgtgcgcgttgccgccgatgccgatgcggtggccatgcccgatggcggtttcgacgtgctggtggtggcggtgaagccgcagaacttcgaggcggccctgccgcctgcagcccctctggtcgggcctgaaaccctggtggtctcggtcgccgccggcaagacggtgcagaccctgcgcgaccttctcggccatccgcggaaggtgatcagggcgatgccgaacacccctgcggcaattggtcgcggcatcaccggctgctatgcggtccccgagaccgagggcggtgatcgtgccctggccgagacactgctttcggccgtgggtgaggtggtctggatcgaggatgaagggctgatcgatgcggtgaccgccgtttcgggcagcggaccggcctatgtcttccacatgatcgaggcgatgaccctggccggcgaagaggtggggctgccccacgaaaccgcccggcggctggcgcgggcgaccgtgatcggcgccgcagcgctggccgatgcctcgtccgagaccgagaccgcattgcgggaagccgtcaccagcccggccggcaccaccgccgcggccctgtcggtgctgatggaccggcaggtggggctgccgccgctgatggcgcgcgcggtcaccgccgcacgcgaccgcggccgggagctggcaggctgacgatccggggtcgggaacctcgggttgagagacgagggggcggctgcggccgccctttttcgtgcgcccgaggtggggaaatcagggccgcatgacggaccggcccacgcatgggtcttgccccgcagcccggttcgggtcactaatcggcaaagccccacaaaagcggagcgccggagagatgacccacgcgatcaacggcatcgatcatgccatcatcggtgtcgccgacctggaagcggcacgggagcggtttcggcggcttggctttgccgtcaccgaccgcggacgccatgtcggctggggcacggcgaattactgcgtcatgttcgacgacgactatctggaactgctggggttgatcgaccccgccgccttcaccaacggcctggatcgttttcttgaaaagggcgagggcggacttggcgtggtgttctccaccccggatgccgaggcctcgcatgccctgctgggcgcggccgggctggtcgcgcccgaaaatgcgctgcgcaatctgggccgggtgatcgagaacggcccggatggcggcccggtggaactcgccttccgcaacgtccatctggcggacggggccacgccgggcattccggccttcctctgccagcatctgacgcccgagaagatgcgccgcccggactggctggcccatcccaacaccgcccgctgcattctgtcggccaccatcgtggtcgacgatgtgaacgcggcgaccgaggcctattcccggttgttcggcagcggtgcggtcacccccaccgataccgtgatcgcggtgcataccggccggggggtgctgatgttcgccacgccctacgacctgcccaatctgcatcccgatctcgacgacgagccccgcgcccatgatcacggcctggtggcgctgcagatcggcgtcgccgatcgcgaccgtacggcggccgtgctcgaggagaacggggtggccttcgatcgcgagcagaatggcgatcttatcgtcggccccgaagaggcctgcggcgtgctgatcgaatttacctccgtctgaccgacggatctgcgccggaacatgacaaggggcggccccgtcgaggccgccctttgtcggttcaggcgcgggatcttcagatcggcggccggcgcggccccgacaggcggcggtccaggaagcgcagggtcacttccatggcatagcgggcctcttccggtcgatagtccgggcgggcctcgcaattgaagccgtggccggcctgcgggtggacgtagatctcggcaccgggtgccgccacgcgcagcttatcggcggtggggcccgccggaatatgaccgtcgcgcccgcccagatggaccagaagcggcgccaccggcttgatgccctcgtccagatatttcggcacctggccgccgtaatagctgacggctgcgtcgatcgacagctttgcggcggccagataggcgaggctgccgccccagcagaagccgaccacgcccacggggaaggcggcgccgtggcgggcacgcagccgatccaccgcggcggcgacataggtcagggcctcgtcgtcgggcacctggcccttcagctcgatgccgcgcttcaggtcttcggggccatagccgagttcggtatccggcgcgacccggtcgaacagagccggtgccaccacctcatagcccggcagggcaaggcgatcgaccacgccccggatatgggcattcaccccgaagatctcctgcaggaccaccaggccggcccgcgcgggctggcggggcgtggcatgccaggccgagatcgacgtgccggtagcggcatccagacggatgaactcacccatgtgcgaaacctcgtgacgatgttgcggcagggctccgggacgctccggagcctcctctcagatacgacatgatgttggggaacggaagagacgggtatgccgcaaccaggattgacaccgtctggtcgcatgaccggctgcccctctgccgtcatgatgccttgagagatcttcggaagaagaccaccgcttgccgcagaagatctgtacggccggcggtcgacgatgatggatcggacggcacccgtggagaccggaccctttgagaggggatctcttggtcggagcacgggacttatgggtagtcagacgatgacggcggccgcgcaatcgggcggccgccacgaacggagcatcgccgaggtcgcggccgaactgctgggcttcgcgcgggcgatggatgacggccggctggactacgaccggcgggcggtcaggctgaccttcggcagcgccaatggcgacgggatgctcgccgtgatcgtgatcctggcggcggtgtccctggtggccggcgtcgtctcgctgtttctgatcaacgatctggcgctccttggtctttccctgccggattggagcttctttgccctggcgcttgtcctgctctgcctggccctctgggcggcgccgcgctcgggcacgcatttcgatctgcggcagcgggccgtgatccatggcggggcaagcttgcctttcgaccggatcctgcccgcccagctggagctgacgcccgatgacgacggggtggcgctcagcctggagcatccggatctgaaccggcgcctggcgcatttcccggcagcgaagatggaggcggcgcaggccgtccgggcgcggctggtcgagctgctggaacggcggctgcctttcacgcggtccgcagctttcacgcggcctgcaggccccgcctctgcaccccggcagaccaccggtgccgggaccggcctttccgctgatcttccgaaagcgccggggcgtttgaccccggtccagggctggatcatcggcgccggcgcgatcttcgcccgcgccaacggccacccggtcgatcggctgggagaggtgtcggggccgctcggggcgcttggccggcgcaaggccgtggcgttgctgcgcgagggctggggcatttcgggcggcgaggatgtcgaccgcgaagtcatgtccctgatcacccgggggcaccgcgaggatttcggcttcaccgcccgtgtcgcagagctgtcggagggcgagcgggcacgctatggtcgggccctccacgccctcaccgacagcgggttggcgggtgatcccgccgcccggcggcgggcgctcgccgacctgatcgccctgcgctatggcccccagggcttgcaggtgatgggcggcgtgctgcgccgtgctcccgagaccgaccctgccgtggtcgagctggcggagaccgccatgctgggcccgctctgagatccggaggtcgatgcggcggagctcgaaccccattgggcgcgggcacgcgagatggtcggggcggaattcggcgacgagggggtgggtgccttcgacgcctggcgtgcggccttcacgcgcgacgtgatcgaggttccgggggcgctcgagctctatgtccaactccggatcttcctgcatcagctggccgatcccgacttcccggccgaggagttggggcggctgcggctcctggaggcagccggtcccggcgccgtcacccatgaccggcatatggcctgggacttcggccgggcattgatgctgatccgctggggccacatggccggctggatcgatgccgatgatgcctggatgcggatgctgccgatcgcgcgcgagatccagagcgcctatggctcgtggaccgatatggcggcggcctatctggaggggcgggccttgtggtcgggtggtgcggacgccgatcaaccggtcttcgagaaggcggcagccgggctcaacgccgacgccgacggcccctggaaccgattgccctgggatctgccgctcgagaaggactggtgaccgaccattccgtcatcgcttatgtgaaacgcccggcatgacatcatgccgggcgtttcgtgtcaggcgcggtggtcggacgggacgggccgtcagacgttgaacaggaagtggaagacgtcgccgtcgcggaccacgtattccttgccctccatgcgcagcttgccggcggcgcgggcctcgctttcaccaccgcaggtgatgtagtcgtcgaaggcgatggtctcggcgcggatgaagccgcgctcgaaatcggtgtggatcacgccggcggcctgcggggcggtggcgcccttgcggacggtccaggcgcgggcctccttggggccgaccgtgaagaaggtcagcagatcaagcaggctgtatccggcgcggatgacccgggtgaggccggtttcctcaagccccagcgcctcgaggaaatcgcgcttctctgcctcgtcggagagcatggcgacctcgctctcgatcttggcggagaccaccacggccgcggcgccctcggcctcggcgcgggcgaagacccgggccgacagctcattgccctcggcggcggcgctctcgtcgacattgcagacatagagcaccggcttggcggtcagcagctgaagcagctggaaggcacggcgctcctcggcgtcgatcttcacggtccgggcagggcggccatcctgaagagcggtcagcacccggcccatcagctcgatctgggccttggcgtccttgtcgccacccttggcgcgcttctcgatgccggccatgcgcttctcaaggctttcgagatcggccagcatcagctcggtctcgatggtctcggcatcgcgcaagggatcgacgccaccctcgacatgggtgatgtcgtcatcctcgaagcagcgcagcacatgggcgatggcatcgacctcgcggatatgtgccaggaactggttgcccagaccttccccccggctggcgccgcgcaccaggcctgcgatgtcgacgaagtcgagctgggtcgggatgatctgcttcgagccggcgatggcggcaagcttgtcgaggcgcgcatccggcaccatcacccggccggaattcggctcgatggtgcagaacggatagttcgccgcttccgctgccgcggtgctggtcagcgcgttgaacagggtcgacttgccgatattcggcatgccgacgatgccgcatttgaagcccatgggattactcctcgccgccggtcgcacccgcgggcggggcacccgcggcatccggcttcgccggctttgccggcttcagcggtttcggcggccggacggcacccgcaaccttgctcatataatcgctctcgcggccggccagcagcagcggcagatgcaccgccaccgcatcggtcagatcgcggagccaatcctgttcggccttggcgaaatcgcccagcacccagccatggacccgggccttgtcgcccggatggccgatgcccagccgcacgcgcacgaaatcggcccccatatggcgggtgatgtcgcgcaggccgttatggccggcatggccgccgccggtcttcacccgcattttcgagggggcgaggtcaagctcgtcgtggaacacgacgatgcggcccggctcgatcttgtggaagcgggcggcctcggcgaccgaacggccgctctcgttcatgtaggtgaggggcttgagcgcgatcgcgcgctcggggccgatgcggccttcggaaatctcgccctggaacttgcggcgccagggggagaagccatggcggcggacgatttcgtccaccgccatgaagccgatattgtggcgattgccggcgtattcggggccgggattgcccagaccgaccagcaaccacatgatcgtcaggcctcttcgtcgccttcggcctcaccggcgtcctcggagaggccggccggtgccgcaatcgtcgcgatggtgaagtcgcgatcgctgatcgccgggcgggtgcccttcggcagctcgacggcgctgatgtggatgctgtcaccgatctgggcgttcgccaggtcgacggtgatcgactgcgggatcgcgtcgggggcgcagatcatctcgacctcgtgacggacgacgttcagaacgccgcccttcttgatgccggggcaggtcgcctcgttgacgaagtgcacggccacttcgacgcggatctcgtgatcgccggtcaggcgcagcaggtcgacatgcagcggcacgtcggtgaccggatggagctgcacgtcgcgggccagcacgcggatgctctcaccgtccagcttcacctcgatcacggtcgaggcgaggtccggggtacggttgaagaacaggccgaactcgcgggcgttgaacgacaccatctgggcgggctgcttgccgccgtagatcacgccggggacgaggccgtcacggcgggcctgacgcgcggcccccttaccgccgcggtcacgcgccgtcgcattcagcacgggctgagtggtcatgaggatggtctcctgctggccggcggtgcctgtctgtacggcccgccggggggttatgccggttcgctgatgccttggtccggaaatacggcagggcgggcctccaggggtgcccgccctcgataccgtcaggtgtccgggacgtcagtcgaacaggctggacacggaactttcgtcggcaatccggcgcatcgcctcgccgatcagcggcgcgatgctcaggctgcgaatgttgcgggacacgcgcatcgcctcggtggcggcgatcgagtcggtcacgatcagctcttccagtgccgaggaggtgacgcgggcgacggcgccgcccgagagcacgccatggctgacataggccttcaccgagcgggcgccgttcgccatcagggcggcagcggcgttgcacagcgtgccggcgctgtcgacgatgtcgtcgatcaggatgcagtcccggtcctcgacgtcaccgatgatgttcatcacctcggacacgccggcgcgctcgcgccgcttgtcgacgatggcgagatcggcatcgatgcgcttggcgaccgcacgggcgcgcaccacgccgcccacgtcgggagagatcaccatcaggttgcggccggccgacttctcctggatgtcgcgcacgatcaccggtgctgcatagagattgtcgaccgggatgtcgaagaagccctggatctggccggcatgcagatccagcgtcagcacgcggtcggcgccggcggtggtgatcagattggcgaccagcttggccgagatcggcgtgcgcggaccgggcttacgatcctggcgggcatagccgaaataggggatgacggcggtgatccggcgggcggaggcgcgcttcagcgcgtccagcgtcaccagcagctccatcagattgtcgttcgccgggtggctggtcgactggatgacgaacacgtcctcgccacggacgttctccaggatctcgacgaacacttccatgtcggagaaccggcggatattcgccttggtcaggggaaggttcaggaacgtcgcgatggcttcggccagcggccggttgctgttgcaagcgataaccttcatcgacactgccccgcgatgatctgtccgactgtccggatgaggaagatgaggacgcacgtcccgcccgtgggatcatccccgtgggctttgcatgccgatggtcggttcaacctttggtcgcgccggccgtccgtgcgaactgtgcgagaaaaggcaagcgaccgcaagacgttgttcgacgtcctccgggcctgcctttgcgcgggcgcaaaatagcaaggcgtctcgaagctgtaaacatgcaggcggcggggggcgcgtgcccgcccgctgcatgcatggccggaatgacacggtaccgccgccgggtacggtcagtccgggtcgggctggccgacatagatcaccaccgccaggatcgtgatgtagaaccggaaagccggtgcctggccgttccaggtagatgattgccacatggcgaaccactcgccgccgatcaccatgaagcccacgaaccagaccagaaagcccatggcggcgccgaaatggaccattcgcttggcgcggccgaattctccggccgtgccgttgacccggcgcagcatggcgatgccgcccacggcgaacagggccgcggtgatgccttcgccggcgatgatcgcccagtagccgatatgccagaagatcggatcggtgatcgcccgccacatcagcgcattgccggggaaggtgtcgtccatcgccagaacgtgagacacgaaggcgaaattcgatccgtagtcggtcagattgttgaaggtgacgaggaaggcgaaggccgagaggccaagcaccatcacgatcttggccacacgcgacgcagcaggcatgaacgctcgctccctgggaccgggcggtttgcccccggtccggacactcctgaccggaggtccctgtcccggaacggggtccgcctcacatcattatgcaactggccatcatgcccagaagcagcaccaaggtgaagatgatcagatggggcacgcgtgcggctttcttgtggggcgccggtttcttgtgaggcgccggccgggcggttcgggcggcgagaaggtcaggcggcgagcaggcggaagcggtcgacgtcgaccagccccatatcggtgatcttcagatgcgggatcaccggcagcggcaggaaggcgagctgcaggaagggttcggccaggcggcagccgatggcgcgggcggccgcacgcagcgccaccagccggtcgcggacatggtcggcgccggcatcgctcatcagcccggcgaccggcagggcaagatcggccagaacccggccatcgcgcaccaccacgaaaccgccgcccatggcgatcagccggttgaccgccaccgccatgtcggcatcgcccgcccccaccacacagatattatggctgtcatggccgacggaggatgcgatggcgccgtcggggaagccgaagccggtgacgaagccgcggccgacattgcggttggtaccgtggcgggcgagcaccgcgaccttgagcaggtcgcgcgacggatccgcccgccgctcgccgcccgcatagggcagcgccatggtcaggtgatcggtgatcaggctgcccgggcggatgccgatcaccggcgcccccggcccctgggcaggcacccggaagatgtcgggggtgaccggcggcagccggaccgagccgaagcccaccggcgccggcatggcgccatgatcgaagatcccgtcttccaccacccggccgttgcggatgacggttgcgaccgcgcaatgctccaggtcgtcgagcacgacgatatcggcccgcctgcccggcgcgaccagcccccggtccttgagcccgaagccctgggcggccgaccaggtggcggcgcggtagacggcgcctgtcggtgcgcctgccttgatcgccgcccggatcagatgatcgagatggccctcctcggcgatgtcgagcgggttgcggtcgtcggtgcagaaggcgaagaagggggagttgcgccagtcgagcagcggtgccagcgcggccacgtccttcgagacgctgccgtcgcggatcagcacctgcatgcccttgccgatcttctccagcgcctcggcacggttggtgcattcgtggcagttgcggatgccgcaggcgagataggcatcgaggtcgcgccccgagagcagaggagcatgaccgtcgatatgggtgccgtcgaaggcggccagcttgtccagcacctcgtcgtccagatgcagaacgcccggcacattcatgaactcggcaagcccgatcaccgaggggtggtcgcggaaggcgaccagatcatcggcgctcagccgggcgcccgaggtctcgagccccgtcgccggcacgcaggaggaaagctgcactctgaggtccagggccgtgtgcaggctggcatccaggaagtagcgcaacccctcggtgccgagcacattgcagatctcgtgagggtccgagatggcggtggtggtgccgcgggccagtgccagccggtcgaattcggccggtgtcaccagcgtgctttcgacatggacatgagtgtcgatgaagcccggcacgatcacccggttgcgggcgtcgacctcgcgtcggccgcgatagccggggccgacgccgacgatcatgtcgccggcgacggcgacgtcggccacctccagcgcaccggtcgcaaggttcagcacccgaccgccgcggatcaccagatcggctgcctcgcgaccgagggcctgatcgatccggcgcttcaggacggccttggtgtgatcgcgggtggcgtgggaggccccggtctcgcggggggtggcgctggccatcggctttgcctccggatgcgtgcaggatccctgcgaccgcatgaaagagccgcgcggggttcggtggaatctggtgtggcggggcaggggctgcaagcgtcagtgcgtcgcgtgcggctcaatcgagcagcacgatcgccgagacctggcggccgtaatccgcctctccccggtgggtggtacgacgataggagaacagggtgtcgatggcaccataggtgtcggtaccgatggcgtccgccgtgatccggttccgcctcagccgggtgagcagatagccgggcagatcgaaatgcagccggtcgtcgcgtcccgggctgaagaagccggccgcggccggatcggcggccatggcggcgtcgcgcagttccggccccacctcgtagctcgggccggcgatgcaggggccgatcacggcgcggatgcggctgcggctggcgcccagcgcctccatggcctcgatggtcgcgtcggtggcgccgccgaccgcgcccttccagccggcatgggtggcgccgatcacccgggcttcggcgtcggcgaacagcaccggcgcacaatcggcggcaagcgcgccgaggacgatgcccggcagccgggtgaccatgccgtcggcatgggggcggccttcggcaccgcgatcggcttcgggataaagcgccagcccgtcttcgtcgaccgtgatcacccggcggccatggacctggtggttggtcagcaggtgccggggtgcgggcgtcagcgcggcagccacgcggcggcggttctccgcgacggcggccgggtcgtcggcgctgcccgggccgcagttcaggctggtgtagaggccggtggagacgccgccctgccggccgaaaaagccgtgggcgatgccgggcaggtcgagcagatcgtggcggtcatggggcggccggtcatgcatgagggactggggcatcaggttgcctcctcgcggggggcttaaagatcggcgtcgaagccgggcaccggtgcgaagccgggcggtgccggccggccgggtggcgtcagggccagcaccttgaacaggcgccccatctcttccggggccgtcaggcgcttcagggcggtggcgatctgggcgcgctcgccgccgttacgggcaccgcgggccaggcgttcggcacgggcaccgatgccgagccggcccagaaagctgccctgatcgacggggccatgggccagggcgccgccggcggccgcggccgcggccagacgctcgaaatcgacatgaacggtcaggtcggcgcgccccggttcttccagcgggtcggcatgggcatgcgccttcactgcctggaaggtgtcgccgggggcactgatgccatggccgtaatcgacgatcagtgccgcaccgccgagcgcggcaagccgggtgccgatggtgccggcgatcgaaatcgatgccggctggacctcggcgatcgctccggccgggatctcggccagcgaggcccgggcgatgcgcggggtcagcagggctgcggccgggcttggatccggcgacaggccatagcggaaccgtcccgggcggtcgggatcgaggtcgatcatccgttccgaccacaggccgtcggggcgccggaccagctggcggaccggcagggcatcgaagaactcgttggcgatcagcagcagcggccggtcatcgggcaggccgtcgaccgtatcgtgccagactggcggccgggagaggccggcatcggcgaccgcctgggcctgggcctcacgcaggcgcgggctctgttccacgaaatgcagcgacacccgatccagaagccccggcatcatcttcatcgcccgaagcgcgtcggccatcagcgtgccgcggccggggccgagttcggcgagcgtgaccgccggcggctggccggcttcatcccaggcgaccgccagccacagcccgaccagttcaccgaacatctggctgatctcgggggccgtgacgaagtcgccatctgccccgaagggctcgcgggtcgtgtaatagccgtgctgcggatggccgagcaccaggcccatataggtgccgagggtcatcggcccatcgacggcgatgcgtccggcgatgatccggccgagcggggtatccgcaggggggaggggggtggcgtcggtcattcgcggcccggtccggtcgcggcgtcggtccggccgcgggcgcggagcaccagatagacgccgatcaggaacatgggcagggacagcagctgtcccatggtgaggcccgccgccagaaagcctaggaaggcatcgggcatgcggaacagctcggcgatcgaccgggtgatggcatagcccatcaggaaatagccggccagcaggcccgggcgggcccaggtttcccggcggcgggcaatgaaccacagcacgacgaacagcagcaggccttcaagcagcgcttcgtagatctggctcggatggcggggttccggaccggccatggggaagatcatgccccagggcacatcggtggggcgcccccagagttcgccattgatgaagttggcgatccggccgaagaacaggccgatcggcgcggccgcggccaccagatcgcccacggtcagcggattgacgcccttggtccgggcgaacagggccagcgagacggccacgcccagaagcccgccatggaaggacattccgcccttccacaccatggggatctccagcagatgctgggcataatagtccgggcgatagaacagcacgtacccgaaccggccgcccaggatgacgccgaaggcgacccagaccagcaggtcgtcgatcgaccgttcgtccaggcccagggcgtggcgccgggtcaggcccacaacatagcgccagccgatcagcagacccgcgatataggccagggcgtaccagcgaatggcgatcgggccgatggcaatcgcaaccggatcgatgtcggggaaggtcaggccggtcatcggcagcgggcctcgcggaggttcgggatcgggtgtcggcggcagtctaaggggggcgcccctgccgctcaagcagtgccgcccgagagtgtgtcacgcgggtggtgacatcttcgagacccgacgataactgcaggccgggcatgtgaatgtgatactgttaacgaagcggtgaccatgttatggatccgcaaggtccgaaccacgtgcgtcgcccgttctgtcgggtgtcgccggaaggcgcggaccctcagtcctgcaagccaatgtacacgtcctccaggtccgtgtccgccggccgggccgtccgggcgcaagcccggtttccggtcctgtcttcggccaccggccgtccgggagatcgccgatgcagagcaataaccccttcttcgacgacatggcccgtgtcgccagcggtgccatgagcggctttgccggtctgcgccaggaaatggaccagctggtccgctcacgtgttgagcggatgctggccgagatgggcgccgtgacccgcgaagaggcggatgcgttgcgggcactcgccgaaggccaggccgagcggatcacggcactcgaggcgcggattgcggcgctggaagcggcggcgggcccggtcgccgatgcccccaaggcagatgcccctcaggcccatgctccccaggcccatgctccccaggccgatgctccccaggctgacgccccggacgaacggtcggcctcttgaccgcgatgcccggtaccggactggtgccggcccgctccggcatggccgccgccgccctctgggtgggggtgctggcggtgtcgaccggggcgattttcgcgcgtctggcggatgcgccggccctggtgatcgccaccggccgtctcgccatcgccagcctgctgatcctgccgctgatgggcatgcgtcatcgcagtgcgatccgcacgctcggccggcgccatctgctgattgcggtggtgtcgggcgcctttctggcgctgcatttcgcgacctggatcagctcgctctcctatacctccatcgccaactcggtgttgctggtcaacacggtgccgatctggaccgccctcggtggtctcgtcctcggcatcgaccgtctggaccggcggggctggctggcggtggggcttgccgtcatcggaaccgtcatcgtctcggcgccgtctgccgatctgaccggcgacgggcttctcggcaacgtcctggcgctggtcggcggggcggcgatggcggcctatctgctgtgcggacgtgccctcagggccaggctcgatctcgtgccttatgtgatgctggcctatggtgtggcggccgtgatcctcctttcggtcacgctcgcagccggcctgcctcttctgggacacgggacggccacatatctggcccttgtgggaatggcgcttatcccccaactaattggtcacagcacctataactggtcgctgaaggccctgccggcgacggcggtgtcgatctctctcatgggggaggcggtgttcgccagcctgtggggatggcttctctttcacgagagcctgccacccgcgacgctcggcggtggagttctggttctggccggcatcgtattggcccagacccgcctcgaccgaacacggcgcgcgcaggacggtggcgcctgagggaaggatccggtcaccggatttctgcccgagggatttccacccagcctgcgcctgtcatgcgcgacggtccggatcccggatacctgcgcagctctgcctccttattgacacttgttcccgccgggtctcggacccacgatcgagcacatggacgacgatctcatctggaaagcgctctcggacccaagccgcaggcgcatcatcgaacttcttcacgcgcagccccgccgcaccggcgatctggccgcctgcttcgacgtgacccgtttcgcggtcatgaagcacctcgaccttctggtcgaggcaggtctggtcacggtggaacggcgcggccgcgaacgctggaaccggctggcgctcgagcgcctcacgccgaccgtcgccggctggcttgcccagttcgcggtgggggccgaagccgaacagggcaatctgcccggtgcggtcgaggccatggcgatcgaggcggccgtcgagatcgacctgccccgtcggcgcgcctatcagcttttcgtcgaacaggcggaaaactggtggccgcgtgagggcgaggggcgggtccgcctggaagccgcaaccggcggctggctctatctcgaccgcggtcccggccggccccagatgatctgggccgtgatcggcgatgcccgggcgccggcggcgatcgaactgatcggtgcctgcggccagaagggcgtcgaaagcgcccggacccgcctcgtcttcgaaaaggcgggcaaggggcggaccgtggtccatctgcgcaccgatgccctggtgacgctggatcaggcggggcgagagcgctatcgcgcgttctggcgccgtctgctgaccgacgcctatgcgagctatgccgatacacaggcaggcccggcggaagcggacctcgatctcgaggacgacgacgcccatggcgagccgcagagcgcctgggtggccggcgccatccgctgacgcttgagcgtcgtccgcacttggctctaacccccggcgggccggaccatcatccggcaccgtcgggggttcgtgtgtctgcacggaaggccgccggcccggtcgcgggattctccccgccggccctaaatcgctgatttttccttgacgatcggggccggctcgcctaaagacacggtctccgaaaggtgcccggcccgggtgccgccatcgacgacgccggcgcggcgcatcgtccgaaggtttcaacaagcgtccgcccgctgaaggtttccaaacatggcccgtcgttgcgagcttaccggtaagcgttacatggcaggcaacaatgtcagccatgcccacaacaagtcccgtcgccgcttcaatccgaacgtccaggacaccggcatctattccgacgtgctgggccgtctggtccgcctgaaggttgccgtgtcgaccctgcgttcgatcgagcgtcgtggtggcctcgatgccttcctcgccggtgcccgtgaggtcgagctctcgcccgacgcccgccggctgaagaagctgatcgtcgagaagcgtgccgctcgcgctgcggagttcgccgccgccgagtgacgccggagccccatgcgggttccgccgctccagatccagaaggacccgcgccggagacggttgcgggtccttctgcgttcgaacagactatccgggacggcgcagtcacgtgccgccccatcacccgacggcctgtatcgccgtccggacggcagatgaaccgcctgccgtccctttgggaaagagagaccatctcccatggctcatgcgctgcaccgcctctggctgccgatcctggcgatgacccttgcggtcgtcgcctccaacattctggtccagtatccgatcaacgactggctgacctggggcgccttcacctatccggcggcctttctggtcaccgatctgaccaatcgccgctacggcaccgcatccgcccgccgggtggtctatgccggtttcgcgatcgcggtcgtcatgtcgctgtggttcgccgatccgcggatcgcgctcgcctcgggcgcggccttcctggttgcgcagctgatggacgtgacggtgttcgaccggctgcgccgccggccctggtggcaggcgccgctgatttcgtcctcgctggcctcggctttcgatacggtgctgttcttcaccatcgccttcgccggcaccggcctgccctggatcagctgggcggcgggcgattggggggtgaagatggcaatggctctggccatgctggtgccctatcgcgccctgatgcagatcctgctgccgctgccgacggatcccgtgcacgagcatggctgatcaggcctggcccgcccggtagcgccgcggttccagccccagcgcgcggatccgcgaggcgagggtggttgccggcaggccgagcagggcggcggccccgttcgggccgtagacccggccgccacaccggctgagggcggtttcgatcatccgtcggtcacggtcgcggcggccggcttcggtcagcagctcgtcctcgtccccggccagggcaggcgctgcgggcgccgctgccgggccggcatgcagggcggcagatggctccagatcgaagcgcagccgcccgccccgggccaggatcgccgcccgttcgatcacattctccagctcgcggacattgcccggccagtcatagccggtcagccgctcgacatcgccgcgggtcagcctgagatcggggatgttcagccgccggcaggtcttggccagaaaatgggccgccagcagcggcacgtcatccagccgctcgcgcaaaggcacgctctcgatcgggaagacgttgaggcggaaatagagatcttcgcggaaccggccgcggcgtacctgatccttcaggtctcgattggtggcggccacgatccgcacatccaccgcccgggtccgctcttcgccgacccgctcgaaatggccctcctgcagcacccgcagcagcttgctctgcagttccagcgggatctcgcccacctcgtccaggaacagcgtgccgccatcggccaggtcgaaccggccgacccggtcgcgcaccgcgccggtgaaggcgccgcggacatggccgaagaactcgctttcgaacagctcccgcgggatggctgcgcagttcacccggatcagcggccggtgcgaccggcggccggcttcgtggatcgcccgcgcgatcagctccttgccggtgccgctttcgccggtgatcagcacattggcatcggttggtgcaaccaggtcgatctggcgggcgatcgtctggatggcggcgctgcggccgatgatgtggtggtggttgacctcggtgcggatctcttccagcagataggcattctcgcgctccagccgctcgcgcagcgcgtcgacctcggccagggcggcatgcagccgttcctccgcctcccggcggctggtgacgtcgcggaacacgatcacggcgccgaccaccacgccgcggtcgcggatcggcgtgctggtatattccacgcggatcggtcggccatcctttcgccagaacacttcgtcgtcgatctgccggacctccccctcgcggaaggcggcgtagatcgggcattcatgctcgggataatggctgccatcggcatgggtgtggtggaccatgccatgcatgtcgcggcccaccagttcttccgcccgccagcccagcagacgttcggcggccgggttgacgaaggtggtgtggccctcggcattgatgccgtagatcccctcgcccgcggcccgcaggatcagctggttctgtcgctcgacatcgcggaagaagcgttccacccgccgccattcggcgataccgcccttcagataggcgtcggcctcggcatcgacctcgcggcggtggcgttcctcaagatccgtgatggtcagcaggaccagccccgcgcctggcccgtcgagccgtgcgccttcgtactcgaccgccacctcgctgccatcggcacggctgggggccaggccgcgggtcaccgcctggccctggtccagaaccgcctcggtgaagaccaccagcgccggcatctggccctgatgcagcgcgctcatccggcgcgtggcgagcacctccggcggcaggccgaacagccggcctgccgccggattggcatgcaggatcagatcggccacgggatcgaagaccagcatcggccgcgggctggcgacgatgatcgcctccgccagggcatcggcccggcgggcgtggtcggatggtgctgcggtatcgggcatggcgtcctccggacaggaccggaaagggcgcgggggtatgtggaagcctagcacgaaacttcgtgaaaccaaccacgatattccgtggatcacgacatatcgtggtcgctcacgtcgattgggtttcgaaaatttatcgaattatatcagatagataaatggatttcgtccgtctggcccggcggttgcagaacagaagcccgggacgcggcatcccccgcctgccgcccggctgttcagaccgttcatccgtcagggagtgacacatgacgatcaagagcctcggcgacgccttcgatccggatgtcgacctcggccatggccggcagtgcggctgcgccgcctgcgccacgacctctgcccggccgacctccgctcaatctggcccggcgctgcccgtgggcgaagaggcgctggtcgatcgggtggtcgagaatgcggtcgtccgctccatgttcggcggcaacgagattgcccggcggtcgtttctgaagaccgtgggggcgggggcctttgcggcagcgctggcctcggttctgccgctcgaccgggtgaaggcggcggtcaaggacggcatgaccggcggtggtccgctcgagaagacgaagctcaacatcggcttcgtcccgatcacctgcgccaccccgatcatcatggcccatcccatgggcttctatgaacgccgcggcctggatgtgcaggtgatcaagaccgccggctgggcggtggcgcgcgacaagtcgctcaacaaggaatacgacgcctcgcacatgctgacgccgatgccgctggcgatcaccatgggggcgggctcgaccgctcagcccttcctgatgccggcggtggagaacatcaacggccaggcgatcgtgctgcatgtcgatcacaaggacaagcgcgaccccagggactggaagggtttccgcttcggcgttcccttcgaatactcgatgcacaatttcctgctgcgctattacgtcgccgagcacgggctcgaccccgacaaggacatccagatccgggtcgtgccgccgccggagatggtcgccaatctgcgcgccggaaatctggacggctacctgtcgccggatccgttcaaccagcgtgccgtctgggaaaaggtcggcttcatccatctgctgaccaaggacatctgggaggggcatccctgctgcgccttcgcctgttccaaggccttcgccgaagagatgccgaacacctatggcgccctggtcatggccctgctggaggcgacctcctatgccgccgatccggccaatcgcaaggagatctcggccgcgatcgcgcccgccaattatctgaaccagcctgtgccggtgatcgagcaagtgctcaccggccgcttcgccgacgggctgggccaggtgcaggacgtgcccgaccggatcgatttcgatcccttcccctggcattcgatgggggtatggatcctgacccagatgaagcgctggggctacatttcgggcgagatcgactatcgcggcatcgccgaacaggtctatctcgccgccgaaaccggtgcctggatgaaggagctgggcctgaccccgcccgaggtgacttacgagccccacaccatcatgggcaagaccttcgatccggcggatcccgaaggctatctcgcctccttcgccatccggcgcagctgagcctgccactctgggagacccggaatgatgccgtcgctccgcatccgtgccgcgatcctgtcggtggcggtgctggctctgctgctgggggtctgggaactctccagtgcagccccggccgcttcggccgcgcaggatgaatatgcccgtctgatgggcggtgccgacacccaggcccgtctgccggccccctccgacattctgacgcgcgcctgggaagagatatcggatcccttctacgacgccggccccaacgacaaggggatcggtatccagatcggctattcgctctaccgggtggcggcgggctatctggccgcggccgccatcgccctgccgctcggcttcctgatcggcatgtcgccgctggcctaccgggcgctcgacccgttcatccaggtgctgcggccgatctcgccactcgcctggatgccgctcgcgctgttcgtgatcaaggacagccagatgtcggcgatcttcgtgatcttcatctgctcgatctggccgatgttgctcaataccgccttcggtgtcgccaatgtccggcgggattgggtgaatgtcgcccgcacccacgaactcgggccggtctcgaccgccctcagggtcatcctgccggccgctgcgcccaccatcgtgacggggatgcggatctcgatcggcatcgcctggctggtcatcgtggcggcagagatgctcgtgggcggcaccggcatcggctactacgtctggaacgagtggaacaatctcgatctcaccagcgtggtgttctccatcctgatgatcggtctggtcggtatggcgctggatgcgctgctcggcgcgctcgcccgcgccgtggcctatgccgattgaggcggagagaggtatcccatgacgagcgcacgcccctttctcgacgtctcaggcctggcaaaacgcttccccacccggggcggtggcgagaccacggttttcgagcaggtcgacttcaccatggatcgtggcgaattcgtctgcgtgatcggccattccggctgcggcaaatccaccatcctcaacatcctggccggactcgacagcgcctcctcgggggcggtggtcatggatggtcgggaaatctcgggccccggcctcgaccgcggcgtggtgttccagaattacagcctgctgccctgggcgacggcgcttgaaaacgtggtctttgccatccgcgcccgacatcgtgactggtcgcggcagcagatccgcgcgcatgcgctcagccatctggccaaggtcggactgtccggcggggcggagcaccgcaagccggccgaactctcgggcggcatgcggcagcgggtcagcatcgcccgggcttttgcgatcgagccccggctgctgctgctcgacgagcccttcggcgcactggatgcgctcacccgcggcaccatccaggacgagctgatccgcatctggtccgataccgaccagagcgtgttcatgatcacccatgacgtcgatgaggcgatcctgctcgccgaccggatcctgctgatgaccaacggcccgcgggcccggatcgcggagagcgtggtcatcgatatcccgcggccgcgggcccgggacaccatcctgcacgatccggccttctatgccatccgcaaccatctggtcgaattcctgacccggcgctcgcgggagctggccgccggggccgccggcgcgggcaccggtgccccgcgcaccgtgcgtttcggccgcgacggcagtgcccagggcgtggatgtcgtgcccttccagcgtgccgcccgttgagcggctctccgatccgtttcgtcgcacccgttcatcacgacccgcagcgaggacccctcatgaacatgaccaagacctccaccgatgcgccgctgtccaaggccgatgccacggcgctgatcctcgccgccaaggcggcgcatggcctgacctgggaggctatcgccgagggcatcggcatgtcgccggtctggaccacctcggcggcactgggcatgaacagcatgccgctcgagaaggcgcaggcgctggtggccctgctcgacctgccggccgctgtcgtgccggcactggtcgcattcccgaccaaggtctgggaccaggcggtgccgacggacccggcgatctatcgcctctacgagatcgtgggtgtctatggcgagacgctgaaagagatcatccaggagaagttcggcgacggcatcatgagcgcgatcgacttcaccatgcatgtcgacaaggtcgaggaccccaagggcgaccgggtcaaaatcaccatgaacggcaaattcctgccctacaaggcctggtgatccagggccctgaaccgcattgcatagcatgatgcttcaggcgggtgtcgcgaggaaacgtggcacccgtcaaccttgtggataaaaacaaacagtcttgactgtttttttatagagtcgcagtcttgaaacatgacgcgaccggccggggagagggagatgaccggtgcgaaggtgcggcgcacgcaggaggagcggagcgccgaaacccgcgacaagctgctctatgcgacgctcgacgtgctgatggaggccggccatgcccggctggccactcaggcggtctgtgaacgcgctggcgtgtcgcgcggcgcgatgctccatcactaccctacccgcagcgagctgctggtcgcggcgatcgagcggctgctcgacgacgagatcatcgagatgcgcggcatggccgcctcggtgcgttcgggcgcgatcggcctggatgctttcgtggacgatctgtggcggcgcttctcgggccggctgttctacatcacgctcgaacacatcaccgctgcccggaccgatgacgatctgcgcgacgcgctgctgccggtggtgaagcgtttccatgtcgcgctcgacgacatgtggaccgagtttttcgaggcccgcggcacggccgaccgggccacgaccaccgtcctcaatctgacgctctgcctgctgcgcggcatgggcgcccagacggtgctgaaaccggatccggactattaccaggacctgctcagggcctggaagacgatcctcgcatccctcgtggaggggcggggctcaggcggcacgctggcggggagcgtcggcgtgtgaaatccacccgcacaatcgatcggcctctcaagaagggccggcggcagctccccggcggggcggcgggttctcgggatggcaaggagaagacagggatggcaggacggattgaggcccgcatgcgccgggccgtgacggcaggcgtttcactcgcggtgatgtccctcgcgctcggtggcgcggcacaggcggagaccgcacccttcaggatcggggcgctgaacccggtcaccggcgccggcagcccctatggcccgggcatgcagaaggcaatcatcctcgcggcggacgaggtgaacgccgcaggtggcgcctgcggccgcaagctggaagtctcagccgaagatacccagacctcgcccgaagctgccgtgctggcggtgaagaagctcatcgaggtaaacaaggtcgatgcggtgatgggcacctggtcgtcgggcatcacgctcgcggtcatgccgatcaccacccaggccgggctgccgctgctgaacacctcgggcgcgccggcgatctccacggaagacaaggccgatctggtctggcgtttccaggcgaccaatgaccgtttcggtcaggccttcgccaagatcgcaaccgagcgcggtttcaagcgtccggcgaccatggcctataacaacgcctccggcatcggcaataccgagggcttcaccaaggcctggacggccgcaggcggcgaggtcgtctccagcgtggtctacgagcccaagcggccgagctaccgctccgaactgcagcagatcctggcggcgaaccccgacgtgatcgtcatggggtcttatcttcaggacaccaccgtcatcctgcgcgaatggtatcagagcggccagagcccggatgtgaagtggatcatccccggctgggccgccaatcagcagctgatcgatgcgctgggccccgacgtgctcgccaatgtgatcgcggtcgacagcatcagcaatgagagcgcgccgtcttacgcccatttcgaagcggcctacaagaagacgatgggggcagacgccccggccaatgtctatgcggcgatgacctatgacatggtgatcgcctggggcctggccatgcagcaggcctgtcccgacacgaccattgcggcggtgaacggcagcatccgcgcgatcgatgccgccgatggcgcgccggtctacaccttcgccgagggcaaggccgcgatcgaggccggccgcaaggtgaactatgaaggcgcctccagccgcctctccttcgaccagtatggcgacgtcacgcccgatttcagcctgtcggagatcgatggcggcgccttcgtccgcaagggcgtggtctcgttctgatccggaccggccgtgcccgctcaggcgacgcttcggcgcgccgggcgggtcggccgcctcgttccggcctcccgttccggggtccccatggataccgcctattatctcaacctggccttcaacggcctggtcgagggctcgatctatgccctcggcgcgcttgcgatcacgctggttttcggcatcgcccgctttcccaacgcctccaccggcgacctgatgacggtcggcgccttcggcggccttgccggcacgctggccggcggcgggcttctgggggcggcgatcgccggggtcggcgtctcggctgcggtggcgctcgccttccatttcctgctgttccgcaatctggcccggcgctcggcggtggcctcgatgatcgcgtcgatcggtctcgccttcttcctgcgctcggcgctttccttcatcttcggccatgatcagcgggtctacgacctgccgctgacccgtgcggtcctgttcgggccgatccgggtgcagccgacagatctgcaggtgatgggggcggcagctgccgcactggcggtgactttcgccgtgctgcacctgaccccgatcggccgcaggatgcgggcggtcgccgacaatcccgatctcgcccgggcctcgggcatcaatgccgggcgggtgatggcggtgatgtggctgatggcgggcgggctggccgggctcggcggcgttctgctgggcgccaagaccgtggtgacccccgaaatgggctgggatctgctgctgccggcctttgccgccaccatcctcggcacgatcggcaacccgatcggcgccgttctgggcgggctgctgatcggcctggtgcaggagctgtccacccccttcgtcggcttcacctacaagatcggcatggggttcgcggtgctgctgctgatgctgatgatccggccgcaggggctgttcgcccgcaacgcgctggttcgctgagggaggccgcccatggaaagctatctggtcgcggtcgcggtggtcacggcgatctacatgctgatgactttcggcctgaacctgcaatacggcttcaccggcctgatcaatttcggcctggtcggcttcttcgccatcggcgcctatacgagcgccctgctggtgatggcgggctggcccctgctgctgggcttcgctgcggcggccctgctggcggctcttgccgcctggccggtggcgcttttgtcgctgcggctcaggatcgagtatttcgccatcgtcatgctcggtttttccgagaccgtgcgcctggtgatcaccaacgagcgtgcgctgaccggcggcgttcaggggatcccgggcattccatcggccgcccaggcgctgggcgtggagggggtcgacggcaatctgctgaccctgatcctgctggtggtggcggtgatcctggtgctggcggtcaactggcggctggtccacagccccttcggccggatgatccaggcgatccgcgacgatgaagaggcggtgcggtcgctgggcaagcatccgggccggttcaaggtcaccgtgttcatggtcggcagcgcgttcaccggcctcgccggcgccttctacgcccattacgtcaccttcgtgaccccggaacagttcgtccctctgctcaccttttatgtctgggtggcgatgatcttcggcggtgcgggccgggtgggcggggccgcgatcggcaccgtcgtgctgatcggcttccttgaaggctcgcgcttcctgcgcgatgccctgccgggtgtctccgaagtcgagatggcgagcctcaggctgggggtggtcggcgttgcgctgatgctgctgatgcgcttccgcccggacggcattctgggtgcgccgtcggccggcacgaagaaggggggctgaaccgatgagccatcctgacaccatcgccgccgccgatcgtcagctggcggtcgagggcgtttccaaaagcttcggcggcgtgcaggtgctgaccgatatcggcttctcggtgccagtctcggggctttcggggctgatcggccccaacggtgccggcaagagcacgctgttctcggtcgtcagcggttttcagccgggcgatgccggccgggtcagcttcgccggccgcgatctcagccggatggggccagtggagcgggtgcgcgccgggctggggcgcaccttccaggtgccgcgggtcttcggcagtctgagcgtgcgccagaacctggcggccgctgccccggggcaggcgggggagaccctggccggcgtgttcttccgcggtgcccgcattcgccgccaggaagcggaaatcgcggcgcgtgccgacggcattctggaatttctgaacctcgcccgcgtggccgacaagccggcgggcggcctgtcgggcggtcagcgcaagctgctggaattgggccgcgccctgatggtccggccgaagatgatcctgcttgacgagcctttcgccggggtgaaccccgtgctgatcgaagagatcgccgaccggatccgtgcgatccgcgagaccggggtcgacggcagcggcggcatcggcttcctgatcgtcgaacacaacctgccctcgctctcggccctggtcgagcggatgatcgtgatcgatcgcggccggctgctggcacagggcacgccccaggcggtgcttgccgatgcccgggtgcgcgaggcctatatggggggcgcggtatgacccggctgctgaccgtctcggatcttgccgcgggctatggcgaggtcgacatcgtctcgggcatctcgctccatgtcgatgcgctggagatcgtgaccatcgccggcaccaacggctcgggcaaatcgaccctggtcaaggcgctgatggggttgctcacccgggtgcgcggcgagatgcgcctgggcgataccccgctgctgggcgtgccggccgaaaagcgtatcggcatgggcgtggtctacgtgccccaggtcgagaatgtcttcccgaccctgactgtcaccgagaatctccaggtggtggagggcgtcaccgatcgccgccaccggatcgaggcaatgttcgaccgtttccccgccctggctgaacgtcgtcgcacccgcgccggcgcgctgtcgggcggcgagcgtcagcagctggccttcgcccgggccctgatgccggcaccgaagctgatgatcctggatgagccgacggcggcactgtcgcctgccctggtccacgaggtgctggaactgatccgcggcctgccggcgctgggggtctcggccctgctggtcgaacagcgcgcccgtcaggcgctggcgatcagcgatcgcggctacattctggataccgggcgggtggtgatccacgacaccgccgaacgcctgcttgccgatgaacgcatggccgatctctatctcggcacccattgaggatgatccattcatgacctccgcttccaaggccgcgccccagggggccggcaccgtcttccgcaatgcccgggtgctggatgtcgtcgccggccgctatctcgacggccagtcggtctgggtcgagggcggggtgatacgcgccatagcccccgacgccgaccgcatggccggtgccgatgccgaggtgatcgatctcggcggcaaggtgctgatgccgggcctgtgcgacgcccatgtccatgtcacggcgatcacgcccaacttcgccgaactcggtcggatgtcgcccttctacgtcacggtccacaccgccgacgtgctgaagggcatgctggagcgcggctttaccaccgtgcgcgatgccggtggcgccgattgggggctggccaaggcggtcgcggaaggcgcgctgcccggtccgcggctgctctattgcggcaaggcgctctcgcagaccggcggtcatgccgacatgcgcgggcccggccagcaggaactgggcgagtgtttctgctgtgctgggctcggccgggtctgcgacggcgtgcccgagatgcgccgggcctgccgtgatctgatccgcaccggcgccacccatatcaagctgatggtctcgggcggtgtcgcctcgccgaccgaccggatcgacagcacccagttcgcgatggaagaactctacgcggcggtggaagaggccgaggccgccaacattccggtcatgggccatgcctataccgcccgcgcgatcaaccgggcgctggaggcgggcatcacctcgatcgagcacggcaatctgctcgacgaaagctcggtgcggctgttcgtcgaaaagggccgctggctggtgccgacgcttgcgacctattcggccctggccgaagaggggctggcggcgggcatgccggccgatctgcaccgcaaggtctatgacgtgctggatgccggccgcgaggcgctgcgcctggcccatgcaggtggtgtgaagatcgctttcggcaccgacctgctcggcatcatgcatcgccgccagctgaccgaattcgccctgcgggcccaggtccaggcgccgatcgacgtgatccgctcggccaccaccgtcgcggccgatctgttccgcatgggcgatcgcatcggacgggtcgaaccgggcctgctcgccgacctgatcgtcgtcgatggcgatgtccttcacgacgtcgcaccctggtcgcgaccggatgagaccatccggctggtgatgaaggaaggccgggtgctggtggcgcggtgagcagggtcagccggggctgatatctcccagtccctgcaggcgcaaaggcggctgatcgggcaggcggacggtcagctccagttcgcccccgattgcttcgatatagttgcgaagggtcgagaggtacatgtctgcctgcctctcgatccgcgagaccgatggctggcggatgtgaagggccgccgcgacatccgcctgggctttgcccgcgatctgacggagggcgcggaggctctcgacctcgcccttcatctcctgaaaaccggcatcaacctttgcctgatcctctggagggagtgcggccatcatgtcttcaagggtgcgtgccatggcatcattcctgaagtgatgttcgtgcaaggtgatcggtgaaacgtgcatcggcgatggtgatgaggcgggtgtaaaaacgtttctggctctttccggccttgttgccggcaatcagcaagacagcctgtcgtcggggatcgaaggcaaaggcgatacgccatgcgccatcagtcgatctcaggcgtaactccttcatattggggaaggccgatccccggagcgtatcgacataggggcgtcccaggcccggtccgtattccgacagcagtcgtgctcccgacagtattgccagccgcaggtcgtgcggcagcatctcgtattcttccacgaagtcgtcatcgaagatcacctgccacggcatgaaattatagcctccaggctatgttttcaagatgcacaggcttggcatcatgccttccggcatgtcatgcatgaagatgcttaagtagaagctccgtccgaatttctcttgtgaattgagggcgctcggacaggttgaaagacaaagggcgggcctccgtggaggcccgcccttccgtcttcgtgccggtgacggccggtcagtgtctgaggcgggtggggcggccgccgcggccgccctggtcttcgtcgaagagttcggccagctggttcatcaccgtgccgcccagctgttcggcatcgacgatggtgacggcgcgcttgtagtagcgggtgacgtcatggccgataccgatcgcgaccagatcgaccggcgaccggctctcgatccactcgatcacctggcgcagatggcggtccagatagttcgagctgttgaccgacagcgtgctgtcgtccaccggtgcgccgtcggagatcaccatcaggatccggcggttctcgggccgcgccagcaggcggttatgggcccagaggatcgcctcgccgtcgatattctccttgagcaggccttcgcgcagcatcaggcccagattcttccgcgcccgccgccacggccagtcggccgatttgtagacgatgtggcgcagatcgttgagccggcccggcgtctgcggcttgccgccgtcgagccacttcttgcgcgactggccgcccttccagtcccgggtggtgaagcccaggatttcgaccttcacgccgcagcgctccagcgtgcgggcaaggatgtcggcgctcatcgccgccaccgagatcggccggccacgcatggagccggaattgtcgatcagcagcgtgaccacggtgtcgcggaagtcggtgtcgcgctcgcgcttataggtctggctgtagagcggctggaccacgacgcgggccagtttggagctgtcgagcaggccttcgtcgaggtcgaactcccagccgcgcgactgcttggccagcaggcggcgctgcaggcggttggcaagcttggtgatcacgccgtgcagatgggtcatctgttggtcgagcaggccgcgcaggcggttcagctcgtcttcggtcgcaagctcgcttgcctccaccacctcgtcgaattcggtggtgtaggggtggtagacgtcggtggccggttcgttttcgttggagccgggcggcatccaggggcggacccgggacgagctgtcctcgccgccggcgccgctttcggaatcgggatcgctggccgccatgtcggcatcggcctcgccgtcgccggtctcgggcgccccttcgctcgactggccgctgtcgtcgccgtcctgcgactgctcgccgccttcgccgtcgggctgttcctgggcctccgcctcggcctgatcatcggcttcgtcgggctcgcgatcctcgtcgagttcgccttcggtttcggcctcgatgtcgaggtcggacaacaggtcgcgcacgccttcggaaaagcgcttctggtcggccatgatctcgggcaggcgggcgagatcttcgccggccttgctctcgatcatcgggcgccagtgctcgaccaggtctcgggcgatctcgggcgtcggcacaccggtcaggcgctcgcgcagcagcagcaaggccgcttcgcaaagcgattcggggctgccgtcgaccgccagacgctgcggctgctcgcgaagctggtcttcctggagccgggccagattgccgcgtacgccggtcatgttccgcccgcccagggcttcgatgcgcagctgctcgcagctctcatagagccggcgggacagctcgccctggggctggcgggccatgtggatgcgggcgtcatgatggcgcacgcgcagcgagatctggtccgcctcgccgcggatgcgggccacctgctgttccggcaggttgcgcatcggcgcgcgcaggttcacccggtcgccgcgcagccgcggcggttcgaaggtgaaagcgacttcgagctgaggcgtgcccgccatcgccttcacggtgctggtcagggcacgtttgaactgctcgacggattgcgggtcgttgcgcttgcgcatgtccctcaacccatgtggcggatgccggggacgtgcagctcggtgccgaagcagcgctgatagtattcggcgatcagcgggcgctccacctcgtcgcacttgttgaggaaggtgaagcggaaggcgagctgcagatccttgaagatccggtagttctcagcccaggtcagcaccgtgcgcggcgacatgacggtcgagatgtcgccgttgatgaaggcgctgcgggtgaggtcggccagggcgaccattgaccgcacggtcttgtggccgtcggcattgtcgaattccggcagcttcgacagaacgatcgcgctctcttcgtccggcgccagatagttcagcgtgaccaccacgttccagcggtccatctgaccctggttgatctgctgggtgccgtgatagaggccggtcgtgtcgccgaggcccaccgtgttggcggtggcgaagatccggaaatagggatgcgggcggatgaccttgttctgttcgaccagggtcagcttgccctcgttctccagaatgcgctggatcacgaacatcacgtcggcgcggcctgcatcatattcgtcgaagaccagggcggtcgggcgctgcaggcagaagggcaggatgccttccttgtattcggtcacctgcttaccgtcgcgcagcacgatggcatccttgccgatcaggtcgatacggctgatgtggctgtccaggttgacgcgcacgcagggccagttcagccgggcagccacctgctcgatatgggtcgacttgccggtgccgtgatagccctggatcatcacgcggcggttaaaggcgaaaccggcgagaatcgcgagggtgacgtccggctgaaagcggtaggtctggtccagatcgggcacatgctcgctgcggtcgctgaatgccggcacctccatgtcgctgtcgatgccgaagacctgtcgcacagacaccttgatatccggcgtgttcggggtcggggcggccagggtctcggaagccatgatgaagaagatctccactggggaaggcggggacgaaacggatggacatcgcggccggcccccgcacggggaggtgcgggtgaaggccgcggccgacagggccgtcggcgggcaactcctgatctcggcacgcgtatccccatccggtcggggaacggcaccggttcaggtccagtctgacgcgcggtgcatcaaaaaggaataggcctggttcaccgatttcatgcgttcctccgacgcggcgtcgccgccggtgacgtcggggtgcagccgtttggcgagtttcttgtagtggtccttgatctgcggcagatcgcgggtcgggtcgatgcccagggtcttgaaggcctggcgctcgtcgggggtgaagcgggcctcggcggcggcgcgtacccgctcggccgcgcggcctgcggcgccgaacatgccgaaggggtcactggtccggccttcgcggaacatctgagccgcggcacgggcaacctcgtcggcctggtcgcgatcggcgctggcgaagggccaggaggggcggtgccaggtcatgtcgtcatgcaggtgacggtcgatctcggccgaactcagccccttgaagtagtcccagcccttgttataggcgcggacatgctccaggcagaaaaaatagtagtcccgcagacggtcgcgcgatttgggcgcgcggaacgcaccttcctctccgcagccctcgcagtcgcagagccgggttccgtcgggagcgtaggcggcggtgcgccggatgctgaagaggtcgatcgccatgacggcaaaatatgcgtcacggggtgcggtgcggcaagtggtcggaccatgccggccgggttgaaaaatacgcaagcggcccttcttgacgccgaacgcccgcgcgaccggccgttggggcggtcacgcgggcgttccggatccgcaccgggcgtcgtggcgcccgtgtcggtctcgggtgggatcaggaggcgtcggccaggctgcgggcaagggtgctcagcgcttcctggtgcttgccgttctggatcatcgagaagttgcgggccagctccaggcacatgcgctgacgcggggtcatctcaacctgaccaccctgctccagaccctcgaagaagtaggagatggtgacgcccagggcctgcgcgatgtcgtagagacgaccggcggcgatgcggttgatgccgcgctcgtacttgtgggcctgctggtaggtcacgccgatcatgtccgccagctgctgctgggtcaggcccagcatgatgcggcgctcgcggatccgcgcaccgacgtaacgatcgacttcctgggcccggctcttggtggtcttcatggggagggatccctctttgatcagggtgttggttaagaggctgacggggggagcgttccgcctcgtccgcagttcgtccgtggtgtcggcctgggtgcggttccgtgttcccggctggtcgcccctgctccgcccgattacaagcaaacggtgtgccaagaacccctgcgcaagacccgcttgcgttccggtggtatgatgtgcaactggaaacgcgcgttccgggccggttttccggcgcgcgcgccaggatcatcagggatgcagttaatgtgcgcttaacgtttgccggtggatcgggttccccgagcgtccactctgggagaaaagggtttcccatcctatgcttcgccggaccattcgctgtgcggctgtgttcctgtccctgtttgatcgtgaaacgcttgtgccaaaatgatacaggttgtcccggtatgatacttatgcgtgaggcgatgcccctctggtgcgcgcatcaggcttgatacctcgactggaccgcgcgcgaccatgggaattgcggtatcattgggatatgaccttgagaatgcggaggcctgtgccgacatgaccatcagggatcggatcgagaccaagctgacggcggcctttgcgcccgaacggctggtgatcaccgacgaaagcgaccggcatgccggccatgcgggccatcagcccggcggtgaaacccatttccgcgtcgagatcgtggcggccacctttgatggtctgacccgcgtgatgcgtcagcgccgggtttatgacgttctctccgaggaactggcggagcgggttcacgccctggcgctcagcacccgcacgccggctgaggtggaacagaactgacgggcagccgctgccggatgcaaccggcatgcgattgccctttgaaacgcgccgcggttgtgttaatacaaccttaaataaaaagatcgaccaattttcgcgtaaaggtgtcgtcggggagatatccggccggaggggccggagacctaaggggggcgataggcacgatgtccagttcacttatcaaccgcaacgtcgtcgtcgaggggcgccgtaccagcatccgtcttgaagcggatatgtgggatgcgctgaccgagatctgccagcgtgagggctgtcggatccacgagctggccaccatggtcaactcgacccggcgcgagtcgacgctgaccgccgcgatccgggtgttcatcatgaactactaccgggcggcgtcgaccgaacaggggcatgcccgagccggtcacggcaaggcgatgcggccgggtcgggcggatcggacggcggtgcagcggcgtctggagcgtctcgcggctgcgcgtggcggggaggggcggccgatggcgacgctcagccgcccgtataccactcaggataatgctgcctgacgacctctccgtccgctgccagggcgtgacaggtattcaggtgcgcaggcggtttcggcgccggtcgcggcggcagagcgaccggcgccgtatcgtttgttccggtgcgggccatggcttcggtcccggtcatcgcggcgacgcgatcattggcctcacgccgtcggcgttccagcgccggatagagcgtctggaaggcaacggttcccagcgggcgcatcatctcgaccagatgcgtgcagccatgcacgccgccgacccgctggcggatggccttggtccagcccggggcaatcttcagcccgaccaggcgctggaaattgatggcgacgtcgccgcagatcgaatagggcgtgtggtccatcaccgcctcgatcgccttgatctcgaagccgatatcgatggtcagccggatccacatgtcgtggatcggcgtgccggggtcgatctggccgcgccactggttttcgatcgggtaggtcttcacgtcggtcagatgtgcctcgatgtcccatagcccgtcttcgcgctcatagccgcggaggtcgatctggcgggtgtggatgtggcggcggttcaccggctgggacaggggcatggggcgggcttctcctcggtacggccgcggcgcagggtcggggccgtgcctcgcatctgagacgaacgttcgatccaatttcgatgagggtactatacgcggcgagcgcgcggtcgtcatctgcggtgcagcatggacgatcaggcccggccgtcagccgtcaattcatgccggccagatgcagcgccacccacagcagcccgggcagcagcaggaagatcagcagggtggacgtcaccaccagcgaggccacctcggccggagagcggtcgtagcgctgggcgaagagatagttgaacacggccaccggcatcgaggcttcgaccagcaggacgcccagctccacgccctcgaagcggaagaccaccaggccgaggaagagcgccaccacgaagccgcccaggctgcgcagcagggccagccccagcgtgcccagcggccgcaccgccttcatccgggccaggctgacgcccagcgtgatcagcatcagcggaatggtgaagccgccgatgagatgggtggtgttgctcaggaatttcggaaccgggatcccgccaagcacgaagatcagcgccgcgaccaccgaccagggggcgggctggcgcaggatgaagcgcccggccggctcgcccgacagcacccaggcgccgatcgtgaactggctgacggccgagaccgcgaaatagccgatggcataacccagcccctcgggcccgaaggcgaagaggcagagcggcaggcccatattgccggcattgccatagatgatcggcgtcagccaggtccgccagggcaggccggccgcccgcaggatcggccaggcgatgaaccccatcatgaccatggtcgaggcggcggcgagcgcgaattcgccgaaggcaccgggtgcgacctggccgttggtcaggttggagaagatcaggcaggggacaccgatattggtcaccagattggtgatcatgccggtgtcatagggctgccggaacacccggatccaggaaaagccgatggcggcgcaaaccaggatcggggcgatgatggtgatcagttcgccgatcatggccggccggcgtcgtggagggcacccgtctgggcgcgatctccgatgggcgagaggcgcagcttggtcacccggttgcggtgacggcggagcacttcggcctcgatcccggcgatgcggaagcgctggccgacctcagggatcgccttggcctcgtggatgaccagaccggcgatggtggtcgcctcgtcatccggcaggcgccagccggtttcgcggttgagatcgcggatcgtgacggtgccgtcggccagaaccccgccatcggcctgatgctccagcccttcgacggcaatgtcgtgctcgtcgacgatctcgccgacgatttcctcgaggatatcctccagcgtcaccagcccctggatcgtgccgtattcgtcgatcaccagggcaaaatgggcatgacgctggcggaaagcatggagctggtcgtgcagcgtggtgctgtcggggatgaaccagggcgtgcgggcaagcgctggcacgtcgatcttctccacatcgccgcccgcctcggtcagtgcccgcagcatatccttggcatgaagcacgccgatgacgttgtcgggatcgccctgccacatcggcagccgggtgtgcgggctggtggtgacctgggccaggatcgcggcgggcggctggtcggcatcgatcgtggtcatctgccggcggtggatcatgatctcgcccaccgtcagatcgccgagatccaggatgctcgccagcatctccttctcgttgcgggtctcggccgccgtggcttccgggtcgtcatagaggcggatggcgccgcgcaggtcgtcggccgagaccatcagccggtcgccttcgagcttgatgccgatcacccgcgccacaccgcgcacgatcaggccgatcaccttcgaaaacggccccaggatccggacgaccagggtcagcgggcccgacagcgcgagcgcgagccggtccggctgatgcaaggcaaccgtcttgggcaggatctcggcgaagatcagcagcagcagggtcatgcccagcgttgccattgcaacaccggcatcgccgaacagcccgatcagcacgctggtcgcgatcgaggaggagaggatgttgaccgcattgttgccgagcaggatcgagccgatcagccgttcgcgatcggccgtgagcttttcgaccctcaatgcccggacgtcgccgtcggatgcacgctgatgcatgcgggtgcgggaggcggcggtcagggccgtctcgctgccggagaagaaggcagacgcggcgatcaggacaaggatggcgagcagggacagccagagttcggcaggcatcggcgggcgggtctctctcccgatcggattgggccggtatcagccggcgggaacggccgggccctctgggcgatcggccaggatatcgtcgagcagagcggccacttcggcgggggcgacatcatcggcaatgaacgagcggccgatgccacgggccaggatgtagcgcacccggccctcgcgggccttcttgtcctgagcaatcggggccatcagcccgtccacggtccagtcgacgccggtgacatcctgcgggcgggtcggcaggccgaccgccgccagatgggcggtcagccgttccagatcggccatcgggcacaggccgcggcgcaccgacaggcggaaggcggcgaccatgccgatggccaccccttcgccatgaagcaggcggccgtcatagccggccatcgcctcgaaggcatggccgaaggtatgacccaggttcaggagcgcgcgctggccggtctcggtctcgtcggcggcgacgatgcgcgccttggcggcgcaggagcgcgccacggcctgatcgcgcgccgatccggcacctgcaatcacctcggccccgcgccgttccagccagtcgaagaacggggcgtcgtcgatggcaccgtatttcaccacctcggcatagccggccagcagttcccgccgtggcagggtggacagaagaccggtatcggcgaccacaagcccgggctggtggaaggcgccgaccaggttcttgccgtggctggtgttgatgccggtcttgccgccgaccgagctgtcgacctgggcgagcagggtggtcggcacctgaacgaagcgggtgccgcgccgcagcaccgcggccgcaaaaccggcaagatccccgacgacaccgccgccgagggcgattaccggctggccgcgttcgatgcccgaggcgagcaggccgtcgagcagggtctccagcgacccgaagcgcttggtgccctcgcctggcggcaggatgatggtgccatgggcgatcccggcatcatcgagcgcacgtgaaagcacggccagatggtggccggccacggtctcatcggtcaccaccgccgcccggcgcacgcccatggtctcgcggatcaaccggccggtcaccggcagcaggccgtcgccgaccagaatgtcgtaggcgcgatcatccagcggcacccggacccgccgcgcgggagccgcgacgccgggaagggtcaccagctccccgtcatcggacagccggtttctggtgtcggggaggggcgtggcggtctgggcggtcatcggctggcgggctccggaacagacacggaaacggggcagggcaggcgaggagaaccggggcgacggggcgtcatgcggggcgccgcgggcgggttgcggcaagagcgggccattcggcggcaagggccgagatgatcgcatccaccgccacttcatgcggggcctcggtgctctccacggtcagatcggcctcggcatagaccgggtggcgttctctgatcagccgttccagtgtcgccatggcatcgccttcggcgatcagcggccgggtgtggcggcgcttgagcacgcggcgggcaatcaccggcaactcggccttcagccagaccgagatgccgtctcgggcgatggcggcacgggtttcagggtccatgaaggcgccgccgccggttgcgatgacccgcgggcgttcttccagaaggcgggcgagcaccctgcgttctccgcgccggaattcggcctcgccatacaggcggaaaatctcggggaccggcaggccggcggccttttcgatctcggtgtcggcgtcgacgaaatcgatgccgagacgctgggcgagcctgcggccgacactgctcttgcccacgcccatcaacccgaccaggacgatggggcggtcgatcatccggcgatcaaacgtcggggcggttcctgtcgcatcatcgccggcggcgtcgtctgccggtatcgggctgtcgatggcggatggctggtcgtcgtcggtcaaagcggtgaaccggactctgctgtggcggggccgtcccccggatgcgggcccggtgccgcagcccctggaacgggagcgacagaccggcgtgcggcgaatggtgcggtgcgcaaccgttgaaaccatccgaccgaaccgataggcttcgggcgacggcgcccgacccggccagaaataaagcacaggtccggcagtcgcggcaatcgtgcaggccggaggaccaccgatgtttccggcagttgcgaacccccgatgcgaggcgcaggcgtgctgatccgctttatcctgatcattctcctcgttgccgttctgggcggcggggccttcctcatgaccttcgacatgccggcgccggtgcgcacggtcgagaaggtcgtgcccaatgacaaactgctccgctgaccggagcaatccgacacgacgacgcccgccggtgagcgcatcggccgggcggccgctcggtgtcgtgctggcgctggtgctggcggcggcctccgcctcggccatagcccagcctctccggcttgtgcccgacgagccgcaggcggaagagccgcggccacgttccgtcgttccggcgccgggggttcaggtccgtccgcccgtccagccggcgccgcgcctgacgccgccgccaccaccaccgacggcaccgcggatccaggtgacgcccgatcagctgcggccggcaccgcctcctcctccgccgccgccccctccgccccctccgcctgccccacctcctccgcccccgcccccgcccccgcctcaggtgacggaggacgaggcagcggcatcggatgcagaggatgtgccggcagatctctggcagggcagtacggcggcacggattgatgccgcccttgcggcgcttggcggcactgcaccctggccgacggcgcgcgagatgctgcgcgatctgctcgccaccgacggtccggcgccggccggagaggatgccggcgcctttgcggatcgccgggcgacggcactgctcatgctgggcgatcctgcggccgcggtcgacgtggccgacgaggccggccgtccgccatcctccgatgccctgttcctgtcgggcgaagaacagcgtgcctgtgccgcggcccttcccgggccctcgggcatggccacgggggcggaggctgcacccgccgcggcggatgttctggcctgccgtctgtttgcagctgccgacggcacggggacggccgaactggtgtcgaccggacggccggttgcaggtgtgatcgcccgtgcggccgccacccctgggccggtagcgatcgagggcctggatccggcgggcctgacggcggccgatctggcggtgcttgcccggcggggcatcgagccagaggcgacggtcgacgctgtgacggagtttgccgccggcctgaatgacgccggtttgtcgcggctggtgatgagcggcgcgatcacgccgttccatcgcctggtgctggctgaagcggccgccacgcgcggcctgctcgccggtgaacgtctggccggtgcctggctggcggcagcggcggccgagcgcagtgccgccctgtcgggcaatggccgggcgggcgaatcccggcccgagcggcgccgggcacggctgttcgcaacggcggccgccgaacgcaatccgggcgcgcggctctatggcgtcgccaccctggtcaaggcggcggcagaggccgacccgctgctgacggcgaccgcggccgcggccgtggcgccgctgctggaccctgcggccattcgcgggctcgacccggacagtcgtatcatggccgcgcggatcgcgatcgccggcggggcggtcgacgccgctgcggcgatgctggggattccggaaaaccgcccggacgcgctgagcacggcgattgcggccgatccggagctgacggcgctgtctctcgtcgcctttcaggagccgccggcggtgctcggtcgcgagccgcgcacggtggagatcggcacctggctcgccgggcttgccgggccggcgcgagaggtggcgaccgccgcgatcggcctgttctcgcccgaggccctgccatcccccgatccggcggcgccagccgtagaggaggccgtggcaccggtgccggccgtctggttcgccctacgggcggcggccgatgccggccggctgggggagacggcggcgttgtcgctggttctgcttgaagcccggcccgagatcggcgcgatcggccttgccacggcactggaaggtttccgccttgcaggtttcgacgacgagtcccgccggcttgcggtcgagatgatgatcgcggccggcgtggtttcggggctggcgccgggtgtctgagacatcggaggtgctgccatccgagccgctgcctgccgaccggcgcgcgatcgaggcattccttgaaatgctgggggcagagggtgggcttgccgacaacaccctcgtcgcctatgccacggatctggacgacgccgcccgggtcttgagtgcggatggcgggctggtcgccgccgcggccgatgcgctcgcccgctatctggcggtgctggaggcgcgcgggctgacggccgagacccaggcgcggcggctgtcggccctgcgccgctttttccggttcctggcgagcgagggccgccgtcccgatcagccgaccgaccggctggacgcgccgcgccggcgccggccactgcccaaactgctgtcggaagacgaggtcgaccggctgatcgcggcggcccatgccatgcccggtccggacggtcgccggctggcggcgatcgtggaactgctctatgcctcgggcctgcgggtcacggagctggtcaccctgccggccgcggcgcttgcccgcgatccgcaggtgctgatggtgcgcggcaagggcggccgtgaccggctggtgccgctcggcgcgccggccagggcggcggcacgggcctatctcgaggtgcggggcagcttcctgccgccggaccgcacggcccagggttttctgttcccgtcacgtgccgcagaaggccatctcacccgtcagcgggtggggcagctgctgaaacttctggcgctcggcgccgggctggatccggcccgggtctccccccatgtgcttcgccatgccttcgcaagccatctgctgtcgggcggggccgacctccgggtggtgcagcagctgctcggccatgccgacatcaccaccacccagatctatacccatgtgctggatgccgatctgcgccgggcgatcgaacgggcgcatccgctgtcgaccgctgacctggccggctagagcgcccgcccgatttctgccgctgcgtcgccgaccatgcgccccagcagggccagccggtcgtccgagatacgcgccgtcggcccgctgatcgagatggcggcccgggggcttccgctggcacggccggccgggatggccgccgccacgcagcgcaggcccaccgactgttcctcgtcgtcgagcgcccagccctggctgcggatccggtccagctccggcacgatcgtctccgtcccggcgggggcggggagggaaccggccgcgagcagggccttgccgacgccggtcgagaccatcggcacccgcgcgcccggccgggcgaaggcgcgcatcatctcggcacattcgacctgggccagatagagcatccggtcgtccgaacggatcgcgaggttcacggtctcgcccgaccgctccatcagccgctgcatcaccggtcgggcggtctggaccagatggcgggcgggatcgaaggcctggccggtgacgaaggcttcgggaccgatctgccacaggccggtgccgccgtcgaaccgtgcccagccacgattggccagtgtgttcagcagccggtgggcggtggaggcggcgagacccgcacggcgtgcggcatccgacagcccgatgccgtcgggcatcgtggtgagcaccgccatcaggtccagcgcgcgcagcacggcctgcacgccgccggctgtaccggcgccgtcagggcccggtgccgaaggggtgcctgcggccgaggtggaagaagggggcgtggtcatgggctagccataacatgcttccgcggcgttttccatagaatggaaaggtcttccattttcttgcgagcggccgggggctttgttatggtgcaccgcgacaacgggcgcggcgtttctcccctctcaaaagccgggcgcccggacacgaacatccggagagcgagacccatgagcttcacgatcgtcaaggaggcgaccccgcgcctcaaccgcagcgaactcgccgtgccgggttcgagcccgaaattcttcgagaaggcggccaagggcccctcggacgtgatcttcctcgatctggaagatgccgtggcgccggacgacaaggagcaggcccgcaagaacgtcatccaggccctgaacgacatcgactggcgcggcaacggcaagacgatgagcgtgcgcatcaacggcctcgatacgcattacatgtatcgtgacgtcgtcgatgtggtggagcaggcgggccacaacctcgacctgatcatgatcccgaagatcggcactgccggcgacgtctatgcgctggacatgctggttacccagatcgagcaggccaagggcatcaagcatcgcatcggctttgagctgatcatcgaaacggcgctcggtatggcgaacatcaacgagatcgccaaggccagcccgcgccttgagtcgctgcatttcggcgtggccgactactccgcctcgacccgtgcccgcaccaccaatatcggcggcgccaacgccgaatacggcgtgctgaccgaggccgacgcttcgggcaagcgcgattatcactggggcgatcagtggcattacgccctgtcgcgcatggtcgttgcggcccgtgccaacggtctgcgcccgatcgacggccccttcggcgacatctcggacccggacggctatcgcgcccaggcgctgcgttcggcggcgctcggttgcgagggcaagtgggcgatccatccgtcgcaggtcgacatcgccaacgaggtgatgtcgccgtcggagaaggacgtcaccaaggcccgccgtatcctggaagcgatggagcaggcccagaaggaaggccgcggcgcggtgaccctcgacggcaagctgatcgacatcgcctcgatccgtcaggcccagggcatcgtcgccaaggccgaccagatcgcggggcgctgaaccgtctgccggccctgcggccgggcttctgtggcggtgccggatctggcaccgcctttttttttgggctaaggtgcggcccgacatcgggaaaaaccgtcgtttccggccgtctcaacccttgccgccccggtttcgagggggcatgtatggccgcgacgtcccagccatcagccgagagccctccatgaaccatttcctggatttcgagaagccgatcgcggaactcgaggggaagatcaaggaacttcgccacctgtcgggcgagaccggggtcaatatcgtcgaggaggtcggcaagctcgagaccaaggtcgaccggctgctgcgccagatctatgccaagctctcgccctggcagaagacccaggtcgcccgccatccggagcggccgcatttcagccactacctcaaggcgctggtgaccgatttcaccccgctggcgggtgaccgggttttcggcgaggaccaggcggtgatcggcggcctcggccggatcggcgagcgggcggtgatggtcatcggccaggaaaagggccatgacgtcgaaagccgcgtgcgccacaatttcggcatggcccgccccgagggctatcgcaaggcccagcgcctgatgcgcatggcggaccgcttcggtctgccggtggtgaccttcgtcgataccgccggtgcctatccgggtgtcggtgccgaagagcgcggccaggcagaggcaattgcccgctcgatcgaggtcggcctggacctgcgggtgccggcgattgcggtggtgatcggcgagggcggcagtggcggggcgatcgcgcttgcggccgccaacaaggtcatgatgctggagcattcgatctattcggtgatcagccccgagggctgcgcctcgatcctctggcgctcgggcgagaatgccaaggatgccgccgaggcgctgaagctcaccgcacaggacctgttccgcctgaagctgatcgaccagatcatcgacgagccgatgggcggcgctcatcgcgacccggccgcggccatggccaccgtcggccgtgcgatcgaggcggcgcttgccgatctggagacgaagagcggcgacgagctgcgcaatctgcgccgcgacaagttcatcgccatgggccgcgatctcgattgagtacgcgtctggtccccggcgactgggtcgatcccgcgaccggcgcgccgctgggcgaagccaccctgctcgaccggatcgggcgggagagggtggtgcttgccggggagcgtcatgacgatgccgccatccatcactggcaggcctatgtcgcccgcctgctccacgatcgccatggctgtgatcgtgccggccggatggcggtcgggttcgagatgttcccgacccgcgtccagcccgtgctcgatgcctggacgcggggagctattcccagcctcgagggctttctcgaggcggtggactggaaagcggtctgggggttcgatccggaactctatctgccgctgatccgcttctgccgccggccgggtgtcaggatgctggcgctcaactgtccgcgtgatctggtgcggcaggtggggcgcgagggatgggacgctgctgcagagcgcgccgcggctgaaggcatttcccgtccggcaccggcctccgacgcctatcggcgccagctcgctgccatgaccggtcgtgccatggccgatcctgccgaggatcccgaagccgcccgacgcttcgatcgcttcgtcatggcccagcaggtctgggaccgggccttcgcctgcaatatcgcccgggcgctggcggaggcggaaccgccggcggtggtgctcggcatcatcgggcgtggccatatggctttcggcaacggaacaccccatcagctggccgatctcggcatccatgacactgcggttctgatgaccggatctgcagaagacccgtttgccctggcgctgggcgcggcggacgcggtctggcgcttcgacgcctgatccgtctccgccgtcagtccatgggcggtgttctcggcctcgccatggtggacgggcggctcttctaacgcaaacgcccgcggcatcgctgatgctgcgggcgtccggcgggtcgtcgcaggcgggctgttctcagaccagccggccgtggcagtgcttgaacttcttgccggagccgcaggggcagttgctgttgcggggcgtgcgctcccagccggcgggcagggcctccggcggggcgtcctcgcccggggcatcggtcacggcggcggggcccggcagactctcggcggtcggctgcatcggccgctcggcttcctgcggctggggggtgccggccatgcggatctccagatgcgacagcacctgggtcacggtctcgcgcatgcgatcgagcatcgcctcgaacagcgagaaggcctcgcgcttgtactcgttcagcggatccttctgcgcataggcgcgcagcacgatgccctggcggagatagtccagctggagcagatgctccttccaatggtggtcgatgatctggagcagcaggctcttctcgacccggtgcatggtctcggcgccataggcttcgatcttctgcgccatcaccgcatccgatgcctcggtgatccgctcgcgcaggatgtcgggatcgatgccttcctcggctgcccagtccttgatcggcaggtcgaccgccagcaccttgcggcagcgttcggccagctcgtccgccttccactgctcgggataggatttctcgggcgcgtattccgagacgatctcgccgatgacctcgtgccgcatcgacagcacggtgtcgtcgacgcgctcggcattcatcatctcgcggcgctgctcgtagacgaccttgcgctggtcgttcatcacgtcgtcatagcgcagcaggttcttgcggatgtcgaaattgcgggcttcgaccttctgctgggccttttcgagcgccttgttgatccatggatgggtgatcgcctcaccctcttccagacccaggcgcttcagcatgccgtcgatgcgctccgagccgaagatgcgcatcaggtcgtcttcgagcgagacgaagaacttcgaggcacctggatcgccctgacggcccgagcggccgcggagctggttgtcgatgcgccggctttcatggcgctccgagccgatgacatagaggccgccggccgccatcaccttcgccttggcctcttcgagctgggctgtgatctcggcggtgcggcgggcacgctcggcctcgtcggtgacgtcggccagttcgacctccacccgcatttcgagattgccgccgagctggatgtcggtgccgcggccggccatgttggtcgcgatggtcacggcacccggccggccggcctgggcgacgatctgggcttcctgctcgtgatagcgggcattcagcacctggtggggcacgcccgcctcggtgaacagccgcgagatcagctcggacttctcgatcgacaccgtaccgatcagcaccggctggcccttggccgaggcctgcttcacctcggtgacgatcgcctggatcttctcgcgctcggtccggtagacctcgtcgtcggcgtctttgcgctgcaccggccggttggtcgggatggcgacgacttcgagcttgtagatctcgccgaactcgcccgcttcggtcagcgccgtgccggtcatgcccgacagcttcgggtagaggcggaaatagttctggaaggtgatcgaggcgagcgtctggttctcgttctggatcgtcacccgctctttcgcctcgagggcctgatgcagcccttcggaatagcggcgtccgtccatcatgcggccggtgaactcgtcgatgatgatgaccttgtcatccttgacgatgtagtccacgtcgcgggtgaacagcttgtgggcgcgcagcgcctggttcacgtgatggacgatggcgacgttctcgacgtcatagagcccgccctggatcagcccggcctcgcgcagcccgttttcgatccgctcctggccggcctcggtcaggatcaccgtgcgctgcttctcgtccttctcgaaatcttcttcgcccaggccggggatgaaggtgtcgaccaggcggtacaggtcggaattgtcctcggtggggcccgagatgatcagcggcgtgcgcgcttcgtcgatcaggatgctgtcgacctcgtcgacgactgcgaagttgaacggccgctggaccatctgctccagaccgtacttcatgttgtcgcgcagatagtcgaagccgaactcgttattggtgccgtaggtgatgtccgcggcataggcgaggcggcgggaatgatcgtccatgccgggcaggatcacgccgaccgtcaggccgaggaaacgatggacctgacccatccagtgcgagtcgcgccgggccagatagtcgttcaccgtcacgacatgcacgcccttgccttcgatcgcattcagataggcggcgagcgtcgagaccagagtcttgccttcgccggtcttcatctcggcgatcttgccctggtgcagaaccatgccgccgatcagctggacatcgaaatgccgctggcccagaacccgccgcgcggcctcgcgcacggttgcgaaagcgtccaccagaatggagtcgagcgtctcacccttggcgagacgctcgcggaactgatcggtgcgcgcgcgcagcgcctcatcgtcgagggtctgaacctcgggctccttggcgttgatggcctgcaccgcccgctggagcgacttcaccgtccgatcgttggcggttccgaaaacccgccgggcaagagcgccgaacatgtaatcccctgacctgctccacgaaacacgcgaaaccgtccggaccggagcatcggggagcggacggcgacgtcatcatgcgcgcgacagaccatggatgcgagcggaacccgcctccatggacgttcctcaaataaggggtcgtgggtgccctgtcaatcacgcgggggccgtggccggtggttcgccgccgatggcgtcgcacgcttgcaaggtcatgggttttcggcacttgtgatcagcgtgggcctgtgcatcatgagcgtcctgatctgctggcggcgaagtcgtcggcaggcgtcctgacgggccggcgacctctgcccgatccccgcgccccgaccgacccttagggagactgtccgcatgctcatccgcagcgcgcgccggccgatcaccgccgccctcgccgccctgcttctcgcctcggtcacccatgtctcggcgctgcgcgccgaagaggcgaagcccgcagccgacgacccggtggttgccctcgtcgacggggccgagatccatcgctcggacgtggtcgcggcgtacgaaaccctgccgccgccctatcgttcgctgcccttcgcgcagctttacgatacgctgctcgacaatgtgatcagcagccggctgatggtggaagccgcccgcaagcaggggctggaagaggatgcggagatcaagacccgtatccagcgtgccgccgatcgggtgctgaccgaatcctatctgacgaagctgatcgatgacgcggtcaccgaggatgcgctgaaggccgagtatgaggctttcaagaaggacttccagcccgaggacgaggtccacgcccgccatatcctggtggcgaccgaagacgaggccaaggcgatcaaggccgagctcgacaagggtgcggatttcgccaagctggcgtccgagaagtcgacggatcctggtgccgccaatggtggcgatctgggtttcttcaccgccgaccggatggtgaagcccttcgccgatgcggccttcgcgatgaagcccggccagatttcggatccggtccagacccagttcggctggcacgtgatcaagctggaagagcgccgcaagcagccggttcccgccttcgacgagaagaagcaggagctggagatggagctgcagcgcaagaccgtcgatcagacgctcgaggcgctgcgcaaggatgcgaagatcgagcgcgtcgaggaagcggcccccgcggctgccgccccggccgccggagcacctgcatccgaagcgcccgccgcccagaccccggccgcgaagccccagggctgacgcgcgccatcttcagtctgccgatccacacggcgggggatgacatcatcctccgccgtcataccgtccggagagattgcccatgagcgccaagacgtcgccgctggcccctgccgccttccccgatctgccccaggttgcgggggtccgtctcgccaccggcatgaccggtctgcgctacaagggtcgcgacgatctgctctgggcggagttcgcccccggcacggtcgtggccgggtgcttcaccacgtcggcgacccgtgcagcaccggtgcgctggtgcgagacggcgctggccggcggccgtgcgcgggcgctggtggtgaatgccggcaatgccaatgccttcaccggcccgaccggcgcccgcgcggttgcagccgaggtcgatggtgccgcagccgtcctgggttgtgcccgcgaggaggtcttcgtggcctcgaccggtgtgatcggcgtgccgctcgatccgaagccgatcgtcgacatgatggccgatctgtcgggccgggccagcgatgcggccgatgcctgggcgccggccgcgaagtcgatcatgaccaccgacaccttcccgaagggggcctctgccaccgtcaccatcggcggccgcagtgtgagcgtggtcggcttcgccaagggctcgggcatgatcgctcccaacatggcgaccatgctgggcttcgtcttcaccgatgcggcgatcggcgcgacgctggcgcagcgcctgctcgcccgcggcgtcgatcggtcgttcaacgccatcacggtcgatggcgacacctcgaccaatgactgcgtgatgctgttcgcgaccggtgctgcgggcaaccccgcgctggccgaagaggatgccgatggtgcggccttcgccgaggcgctggaagccgtgctgtcggatctggcccgtcaggtggtgcgcgacggcgagggggcgaccaagttcgtcacgctcaggatcaccggcgccgaggatgacggcgccgcccgccgcatcggcctgaccgtcgccaactcgcccctggtcaagaccgccattgccggttccgacgccaattggggccgcatcgtggcggcgctcggccggtcgggtgaacgggtggccgaggaccggctgcgcattcatatcggcggcgtgctggtcgccgagaacggcgcggttcatcccgattatgacgagaaggcctatgtcgccggctatatgaaggggcaggagatcgacatcgcggtcgatgtcggtgtgggcgagggcgtggccacggtctggacctgcgatctgacccacggctatatcgacatcaacgccgactatcggagctgagcggtatggcggcgaccgacacggccggtgacgaggatctttatggctgtgccgcggcaccggccttgccggccggtccggcgaagctgctcctggttgtggcggtcgcacttctcgacgtcgacaaccgggtgctgatcgccaaacgccccgagggcaaggcgatggccgggctttgggagtttcccggcggcaaggtggccccgggcgagcggcccgaggcggcgctggtgcgcgagctgcacgaggaactgggcatcgataccagcacctcgtgtctggcgccggccactttcgcgagccacgcctatccggatttccacctgctgatgccggtctatgtctgccggcaatggcgcggcacgcccaccccgcgcgaaggccaggaactcgcctgggtcaggatctcgaagctgcgcgactatccgatgccgccggccgatctgccgctgatcgcgatgctccgcgacatgatcggcggctgacgcctcagcccgcgtcgccttcggctccaggcacctcggctctcagccgtgccagcatgtcgctcattgccgtatcggcagtgccgcggcggcgcggctgcggctggccggtcgccttcttccagccggcgaggtggatcagatccaacgtcgccggcacccgcccgtcggggcgggcgaagcgctccacatagatttccatcgcccgcatcagggtcgcccgcttcagcggcgcgcgacggcggtcatggagcacattggtggcaccgatcatccgcagctcggtcagaagcttcagcggatgagcataggtcagcgtgatggtgtcgacatcgaccaccggcagctgaaagcccgcccgctgcatcagcccggccgcatcgcgcaattctgcaaagggcgagacccggggcgacagcccgccgtcgatctcgatctcggccgcggtcagcgcttcgcgcagctccttgaggctggagccgccggcgatcgcgcccagaaacagcccgtcgggcttcagcgcccgttcgatctggatgagcgcgcccggcagatcattggtccagtgcagcgagaacaggcccagaaccagatccatcgagccgtcggcaatcggcagcagttcttcatccgccaccaccacggggcccgcatcggcggcggccatggccggagagaggtccagcccgatcagggtttcgatgccccgccggccctgaaagatgtcgcggctggcaccatcgcgggagccgatcatcagcgcccgcgggaaatcccgcagcacatcgtccagccgttcggccagacgctcggcgacttcacggatcaggaagccgtgatcgccgccggcgcgggcggcgcgatcgcgccggcggcgcaggagcgcacggtcgaacaggcggatgggatcggtcatggccgctatatggcacggccggccgcctgcggcaacagcccgtaccggatgagacttgcgcgcgcatgttcatggccattatgatcgcgtggcgacaagttgccagggggaggtgacgccgtggtcgaggatacggtcgatggcggcatgcggccggctgcggctctgggccgtcggatggccggtctgctggccggtgtcgggcgggtgttgctggatgcggccctgccgccgctctgcgggttgtgccgtgcaccggtggaccgcccggggttgtgcggtgcctgctggtcggggctggtcttcgtcaccggcccggtctgtgaccgctgcggcgtgccgctgccatcggatccgggcggcccggccgtctgcggcggctgtgcggcgaagcccccggcctttgccatggcccgggcgccgctgatctacgagggaacctcgaaacgtctggtgctggcgctgaagcacggcgatgccgggcatctggcgccgatgctgggccggctgatggcgccggtggcgcgggggctgggccccgtcgatctggtggtgccggtgccgctgcactggcgtcgacggctgaagcgtcgcgacaatcagtccgctgtgctggcgcgggcgctggccggggagctgggggttgcgcacgagcccaggctgctgcgccgggcccggttcacggcatcccagggcaacaaggggcgcgaggcacgggctcgcaatgtcgccggtgccatgcgggtaccggccgggacagccttgcggtcgcggctggcgggggcccgggtactgctggtcgatgacgtgctgaccaccggcgccacggcggaagcctgcagccgtgccctgatccgtgccggggctgccgccgtggtggtcatcgcggcggcccgggtgccggcccccggcgacgggatccgacacatggtggatcctgcaacgctgccggccgagggagaggcatccgagaggctttgagacggcgcgatcctccctatatcattggaacgtttccaatggtcgcgggtgccgttgcgcccggggcctcccgtccaccagccgaagggatccgaggttcatcgtggccgaggtcatcatctattcgacgccgatctgcccctattgcgcacgcgccaaggcgctgctggagcggaagggcgtgagctacaccgatatcgacgtctatggcgaccggtcgctccgtgcggaaatgaccgagaaggccggcgggcgtaccagcgtgccgcagatcttcatcgacggcgcccatgtcggcggctgtgacgatctttatgcgctggagcgtgccggcaaactggatccgatgctgggggcggcgtgatcacccgcgtcgcctgcatccagaccaccgcaacgcccgatatggcggcggggctcgaccggatcgccggtttcgtcgctgatgcggcggggcagggcgcccggctggtgatgctgcccgagatgtcggcaatgctggcccccggccccgagcaacgcacggctgccctggcggaagcggagcatccggcggtggcggcctttgcgcgcatggcgcgggaggcggggatctggctgcattgcggatcgatcgcggtcggcgcaccggccgcaggcgatgagcggctcgccaaccggacgctggtcttcgaccagaacggggtgatcgttgcccgttatgacaagatccacctcttcgatgtcggcgatctggccgacggccagagctatcgcgaaagcgaccgctaccgtccgggcgatcaggccagggtgatcgacacccccgccggccggatggggctcagcatctgctacgacctgcgctttccccatctctatcaggcgctggccgatgccggggcaagcgtgctcgccattcctgccgccttcaccgtgccgaccggccgggcccattggcatgcgctgatgcgggcacgggcgatcgagaccggctgctgggtgatggcccctgcccaggccggcgagcattatcccggccgtcgcacctatggccacagcctgatcgtctcgccctggggcgaggtggtggcagaggccgatggggagagcgaaggcgtgatcctggccgatctggacaccgatgcggtgacggcggcgcggagcaaagtgccctcgcttgccaaccggcgcagcttcaccggcccctgacccggggccggcgtcagcgggtggtcaggcggcgagcatcgccgccagcactggcgccatcagcacgttgaacaaccctgccagcaccatcaccagacccgcgatcgagccttcctcggtgccgatctgatgcgccttggcgacacctgcgccatgggcgcccatgccgaacagcgcgccgcgggcgaggctggagcggagcggcagccaggtgagcatgatctcgccgatggcggcaccacagacgccggtcaggatcacgaagactgccgtcagatcgggcaggccgccgatatcgtcggacaccgccatggcgaagggcatggtcaccgagcgcggcatcaggctgcgcgccagctggtccgacaggcccagcagatgggccatgccccaggcgctggccatggcgatcccactgccgatgaccacgcccagcgtcaggatcggccagtagcggcggatcatcgcccgccgttcccagatcggcagggcgaaggccacggtggcagggccgaccatgatcgtcagccagtggctgccgcggttgtagtcgccatatcccgcctgcatgatggtggcgagcaggatcagcagggcgggggtgaccagcagtggcgaactccaccagcgcggccggatgcggttcagggcgcgggcgccgatatagaaggcgatggtggcggccggccagaagagcagggtcgccggatcctcaggcagggtcatggcgcgtcctcaggcggaagaagagttcgacggtcagcgccgtcgacaccatcaccatcagcgtgccggtcatgatcacggccagcagcttcaggcccagcgtgcccaggaactcgtgatggtcgagcacggccatcaccgcgggcacgaagaacagcagcatctcggccagcagccatttcgcgccccggcccaggctgtcgggccggatgcaatgggtggcgagcaggaccagcaccgcggccatgcccaggatgccgcccggcaccggcagcgccagttggcgcaccgcagtctcgcccacggcccagaaaccggccagcagcgtgatctgcaccaggcggttgcggtggagcgtgtgacggatggcggcggcgagacgctggcggcgcatgggacggaccctccatgggtttacgagggacagtctatgttgcattgcggcatggcgaaaatgaattgattgcatcttaaggatgcgtataaggaatgcccatggaactgcgcacactcagagcattcgtcgaggtggtccgccagggagggttctcccaggcggccaaggtcgtgaacaccacccagccgaccatcagcaaggcggtcaggcagctggaggacgatctgggcacgccgctgctcgaccgggtcggccatcgcagcgagctgaccgaggccgggcggatcgtctatcgccgggcgctgtcgatgctggccgaacgcgacgacatgatcgccgaactggatgaactccgcgggctgaagcgcggcacgctccgtctgggcctgccgccgctcggctccgccacgctgttcgcgccgctcttcgcaatcttccgcagccgttatccgggcatcgatatcgggcttgtggagcatggcagcaagcggctggaagaggtgctgctggcgggtgaggtcgacatggcggcgtccctgctgccggtctcggaagaattcgactggcaggccatccgcgccgaacccctgacggcgttgctggccctcgaccatccgctggcggatgcgccgaagattgatctgccgatgctggccgagcacccgctgatcctcttcgaaagcggcttcgcgctgaacaagatcatcctggatggctgccgtcgccacggcttccgccccaatatcgccgcgcgcagcggccagatcgatttcatcgtcgaactggcggcggccggcctcggcatcgccttcctgccgcggatgatcgccgagcagcgccgtcatgcggcggtgcgtctggtgccgctcgacgatccggaagcgcagtggcacatggccctgatctggcgccgtggcggctatctctcccatgcggcgcgggcctggctggcactgacccgcgaggttcacggtcacggctgaccacatgccgaccgggcatgggtcgtattcgaacaattcattttaaaccgaacttgctgcggcgcactgtgaacggcccgggtgcaggcgacaagccgccccagacccacaggaagaccaaagcctatggcccgccgcctgtccctgccgctgcccctgatcgcgctggcgatcgcgtccttcggcatcggcaccaccgaattcgtcattatgggcctgctgcccgatgtcgcccgtgatcttggggtcgacattccggctgccgggctgctggtgaccggctatgccctgggcgtgaccttcggggcgccggtgctggcgatctcgaccgcgcggctggagcgacgcacggcgctgctgctgctgatcggtatcttcatcctgggcaatctgctctgcgccatcgcgcccgattatgcgctgctgatggcggcgcgggtggtgacggccttctgccatggcgccttcttcggtctcggcgccgtggtcgcggcccaggtggtggcacccgagaagcgggcccaggcgatcgcgatcatgttctcgggcctgaccctcgccaatgtcctgggcgtgcctttcggtacggcgctgggccaggcgctggggtggcgggcgaccttctgggcggtggtggtgatcggcgtcgtcgcggccgccggcctctgggcctggctgccgcgggggctgcgcatcggctcggccggtttcctgggagaacttcgcagtctggggcgcacccaggtgctgctggcgatggcgatcagcgtgcttgcctccgccagcctgttcagcgtcttcacttatatcgtccccatgctccaggacgtgaccggcatcgcgccgggccgggtcactatcgtcctgctgctgctgggcgtggggctgacgatcggcaatctgatcggcggcaggctgggcgactggcggctgatgccggcggtgatcggcctcttcgccgctgtgatggcggtgctcggcaccttcaccatcggcgtccatgccgtcgtgccggccgtgatctgcgtcattctgtggggggcggtggcctttgcgctggtttcgccgctgcagatgcgggtggtgaacgaggcgcgcggcgcccccaacctggcctccaccctcaaccagggcgccttcaatctgggcaatgccatcggcgcctgggccggtggcgtcgccatcacccatggcctgccctatgcccagatcccctggatcggggtgggtctggctgcggccggcatggggctcgcggcggtgtcgcaccgcctggaccgtatgccgctcttgcctgaagaccccgctcgtgccatctaaatcgcaaataccctgcaatctgcggggcggagagagcgggagagcggatcggcggcatgatcgtcttcgacctgagatgcagcgcgggccatcgtttcgaggcctggttcagggacagcgacaccttcacggcccaggccgcggcgggcgaagtcggctgcccggtctgcggtgatcagaaggtcgagaaggcattgatggccccccggctcaatctgcgctcccacgcccgcgacgaggccgcgccggcgccgacggctgcggcagaggtgccgccggcacagccgcccgccccggccgatccggccgccgagcggctgatggccgttcagggcgaggtgatgaagcggctgcgcgaaatccgccgtgaggtggaggcgaattgcgatttcgtcggcgaccgcttcgccgacgaagcccgcagcatgcatctgggagagaccccggcccgccccatctatggtcagaccaccgaggccgaggcggaaagcctgcgcgaggatggcgtgccctttgccgcgatcccgtggctgccgcgcgaagatggctgagcagacatcgcccgcgatgccgggcgaacggtccgcctggtccctgcttcttgccgcgaccgcgccgaacccgggcgccctgcacctgccggtggccggcggagaacagctggatgagccctgttcccgtgatttccttgcgcttgcctttcggcaccggctgccggggctggcgatggcgggactggcggagctggatgtccgcctgacgccgtccgccgctgccgatctgcggacggcggcactccgcgacgcgatgatggtcacccggctgacggcgcgaatgttcgccctgctcgatgccttcgccgcggcgggtattccggcccgggtgctgaaggggccaccagtcgcggccctggcttatgcgggcggcgccggccttcgccatctgcgcgacattgacctgctggtccccgaaccgtggttcgagccggcgcaccggatcatcctggggcaggggttccggaccctgctggatataggccggctgaccgtggccgaactgccgcgctttgcgcacgaactgccctatgtcgacgaggcgggctgcatcgtcgagctccatgccgcccggtccgctcatggccggggcagcgggcaggccgacggcttcgacggtgatgccggcagcatgttgccggtgacggggcgggacgtgccggtcgatccgccggccgagatcttcgtgcatctctgccgccatggcgcctcgcatgcctggacgctgctgaaatggctggccgacatctcgcatctgatcgcggcggcgccagacgtgttggactgggatgcgatcgctgcgcgcacccggcgaagtgcatcccaacggcatgtgggcctggcgctggctcttgcccgcgacctgcatggggtgacgccgcccgccgtcctggcagagttcatcgataccctgccgcccgggctggcgcagggactggcggccggtctgtctgatccgggcaagggtggcccgacgcccatacagatggcccggctggaggtcgtgcttgcctctggcctgggcgccaaggcggcggccatacgggatttcgtcttcgcccccaccattcaggatgcccgcgactggcccctgccgcgcgggctgctctgggcggcgcggccggcgctttatgtcctgcgccggcgccgcgccccggcctgattggctcaggccggccgttcttcggcgtcagggatgctggcttccggtgcggtcgcccgcttcagccgccggcccagcaccagcggcagcaccgcgaccagggcggccgcgatccagagcacgatcgagatggtgctctcgaacaggatgccgatatcgccgccgctgatggcgagcgcattgcgcaggttgacctccatcacccggccgagcacgaagcccaggataatcggcgccatgtcgaagccggtcttgcgtagcagccagccggccatgccgatgcccagcatcagcagtaccgagaaggcggaggcgtgggtggagtagacgcccacgatcgacagcaccagaatgcctggaaccagcacccagttcggcaccgtcagcacccgggtgaagatccggaccagcggcagattcagcgccagcagcaggatgttgccgatgaagagcgaggcgatcagcccgccgacgatttccggccggtcggtcatcagcgtcgggccgggctggatgttgtagagcatcagcgcccccagcatcaccgccgtcgtgccggatccgggcacgcccagggtcagcatgggcacgaaggcgccacaggaggtggcgttgttggcggcttccggtgccaccagcccgcgcgggtcacccttgccgaaactgccgtcgcggtccgagatccgcttttcggtcatataggcgatggcgctggaaaccgaggcgccggtgcccggcagcacgccgaccacgaaaccgatgccgctggagcgcagcgccgtgccgatgccgcgacggatgtcggaaagccgcgcggtcatccgccccaggccgcggatgatttcggtacccgccgcctgcttctccagcaggatcagcgcttccgagatcgagaacaggccgatcaccagcacgacgaattcgatgccgtcgccgagttccggctcgccgaaggtgaaacgataggcgcccgaggtggcatccagcccgatggtcgccagcatcaggccgagcacgcagccgaccagggtcttcaccggccgggcgcccatcatcgagcccagggtcgagaaggcgaagaccatcagcacgaaatactccgccggaccgaagccggtggcgagaccggccaggaccggcgcgaacagggcgaggccggtcgccccgatgatgccgccggtgaaggaggcgaggccgctcaacatcagcgcctcgccggcacggccctggcgggccatcggatagccgtcgagcgccgtcatcaccgcgccggcatcccccggcacgttgagcaggatcgaggagatccgtccgccatactcggccccgcaatagatcgcggcgagcaggatcatggtgctctcgggcggcagacccatggtgtaggcgatgggcagcagcagcgcgatgccgttgatcggaccgatcgccggcagggcgccgatcatggtgccgagaaagcagccgatcaggccgatcagcaggttctggaggctgagcgcgaccgagaacccgtcccagagataatcgaaggacatgggtgatgaactccccctcagccgaagatggtgccggtcggcagatagacctcgagtgcggccacgaatacagcccaccagagggcggcatgcagcacgccgccgaaggccgccctgacccatccggcgccgaaaacgcgggcgacgccggcggtcaggacgaagatcgcgaccggaaagcccagcggctccatcagcaggacggatgcaaccgccagcgtcgggatggccagggtgcggccgagcagggcccctttcggcagctcctcggcaccttcgggccggcgcgcgaacagcagggcaaggacggcgagcgcgatggcgagggcgacggggaagacccgcggccccagcggatcggaggcgaaggcatagtcgatccgcgcgccgatcaggccataggcgatggcgaggagaaaaaggcaggccgcagcgaccctgccggtgggcaggtggccgcggccggaaccggttgagccgctcatggcctcacatcccggcttcagcggcgatctgcttgaagcgggcgacgtcggcctgaaccttcttctcgaaatccgcgcccagcagggtaaaggggtagagcccgcgggcggtgcgttccgcttcgaattcgggggtcttcgacagggccgcgaactggtccacccaccagcgatagtcgtcgtccgacacgtcgtggccgatatagtagccgcgccagaccggccattcgatgtcgatgccctgttcgcgcgccgtcggtaccccggccagttcccccggcaggcgttccggtgccatcaccgccaggatgcgcaccttgcccgccgcatgatggcgggccatctcggccgcatcgccggcaccgatggccacatggccgccttcaagcgccgtgagcaccgcgccgccgccctccagcgccacatagcgcatgtcccgggccggatggccggccgccttggccagcatcacgcccttcatccagtcctgagagccaaccgcgccgccaccggcgaccgggaacttcgttggatccttggcataggcggcgatcagttcggccagggtctgatagggcgagtcggcggccaccaccagcacgccgtaatcggcgccgagcgcgcccacccaccgcacggcggtctcgtcatagcggccgaacttgccctgggccagcagcagggccgagccggaggatgcagccgagacgagattggcgtcggtggcgcgcttgccgatcacatggttgtaggccacggcaccgacgccgccttccatataggtcacgatcatcggctgcgagatcagcttcgtctgcagcatcgcattggcgatcagccggcaggtgagatcgaacccgccacccggcttggcgccggccagacattccggccggtccggtgcggccatggccggcggggccagggtcgtggcggtgatggcgaggccgaacccgagcccaagaaagggcagcagggtggtgatctggcggcgcggggtgttgcggggcatcttctggtctccgattgtccggatttctggcaaggagggcccgttactctccacgatcgtgaagagatcaagacatgcaggggcaaatgcagctccgataattgcggggctgcagatgctttgattgatgatttttgggaaaactaggtctttgccgcgtcgggcaacatgatatcctccccttcatcttctgacggatccgtctctgcggattgtcctgcatgatggcgggcgaaactgtcaggatcctgtctgacaccggagatcctgaaacgggtcggcagttctcgcgggaagggaatgcccatgcgcatcctgctggtggaggatactcacgatgtcggcgaggcgatctgccggcggttcgaggcgatcggtcacagtgtcgactgggagacggacggtacggcggcggccgagatcctggacttcaccgactacgcgctggtgatcctggatgtgatgctgcccgggctcgacggcttcgagatcctgcggcggctgcggcgggccgggaacaccacaccggtgctgctgctgaccgcgcgatccgaggtggaggaccgggtgggcgggctcgacctcggcgccgacgactatctggtgaagcccttcgactttcgggaactcgaagcccgggcccgggtgctgatgcgccgcacggcgggcgaggcgaccaatctgctcacctgcggtgacgtgatcatcgaccgggccgcccgtcaggtgcggcttggcacccgcgaaatcccgctcaagcgccgggagatgaccctgcttgaactctttgccgcccggcccgggcgggtcttcggcaaggacgaactgctcgaccagctgttcggcttcggcgaaggggcgaacccgaacgcgatcgagctgtatgtcggccggctgcgcaagaagctggagggggcgaaggtgcgcatcgtcactgtgcggggggccggctatcagctggtgaccgatgaccaggtctgagacgggggagatgcgtccctctctcgcatccagactgatgctgcgcatcggtgttctggttgcggccggtgcagtcattctggtcacggccgcctggtattatgcccgggcggcggccgacgatgcctatgaccggctgctggtcggcgccgtgctgcagatgaccgagagcctggcggtggaagagggcgagcttaccgtctccctgccggtttcggccttcgaattgctggggctggcgggccaggaccggatcttctatcgggtgatcgacaccgccggccgcacgctgaccggctatgacgatctggcggttccgccgggggctgtcggggtgataggcgatcagccgctggtcaccggcggccaccatggcggggaagcggtgcggatggcggtggcagcgcgtcgcctgaccgaccccgccatcagcggcacggcgcgggtggtcgtggcacagaccgaacgggcccgccgggacctcgcccgtgaactcacgctccgggtggtcgggctggtggtggtgatggcggcggtggcggtggccggcaccatgcttgccatccgctatgcgctccgccccgtgcggggcatgggcgaggcgctgggccggcgcgacccccatgacctgacgccactctcgcccgaggtgccgcgcgaactcgcgcccttcgtcggctcgattaaccatttcatgggacggctggatcagcgggtgggcgggttgcagcgattcatcgccgatgccgcccatcagatccgcacccccttaacggcgctctcggcccagctggacctgctggagcctgcggtcgcgggagaggacgggcgccggcatctcgcccgggtgcaggaccggctgcgcgagctgtcgcggctgaccaatcagctgctgagccatgccatggtcattcatcgggccgatgtggtgcagctgaaggcggtcgatctggtcgatgtcgccaggcgggccttccgctcggcgatcccgatcaccatcgatcacgacacgctcgtctccttcgacgcgccccagggcccggtgatggtgctgggcgatccggtcagcctgcgcgaagcgatcgccaattgcatcgacaacgctctgacccatggtgtcgtctcgcggctggaggtgcgggtggtggcccgcgacggccgggcgctgatcgaggtggaggatgacggcccgggcatcccggcggaggactggccgcatatgctgcagcgcttcgccaccacccgcgccggcgatggcggtaccggcctcggcttcgccatcgccgccgaggtgatggcggcccatggcggagagcttggtttccgccggcttgaggcgggtggattcgtggtggtcgcggccctgccgcagctggcggccaggggagggcaggcatgatccgccggatgtccgcgatcgccgcgctggcatgggctctgctggcggccgcgccggtggcggcccttgaaggcgagacggtggtcttcgccgccccgacggtcgagaccgaccggctggtcatccacgcggcgacggatgtggcggcgatggggccgctgatccgggactttcaggcccgcaatcccggtgtgacggtcgattatatcgaatatgtcagcaacgaccttcaggcggcggcgatcgcggcctgtacggccggcgaaccgctcggcgatctgctgatctcgccctcggtcgaccagttgctgaagcttgccaatgacggctgcgcgctgccccatctctcgcccgagaccgagcgggtgcccgactgggccaactggcgcaacgaggtcttcggcttctcgatcgagcctgcggtcttcgtctacaacgcccggctggtgccggaggccgaggtgccgcacacccatgtcgaactggcagatcttctacgccggcggatcgatcgctatgccggccgcgtcggtacctacgatatccgggtctcgggcatcggctatctcttcgccttcaacgacgcccgccagaccacgacgattttcggccggctcctggaaagcctgggccgcgcctcggcggtggtgcgctgctgcacgtcggaagtggtggccgaggtggcggcgggccggctgctgatcggctacaacatgctcggctcctacgcctatgccgcggcccggagcgacccggcgatccgggtggtggtgccgacggattacgcgctggtgctggcgcgcggcgcgctcatccccgcccatggggtgcggccggatctcgcccggcgcttcctcgactacctgctttcggcgcgcggccaggaggtggtgcggaacgaggccttcttcttctcggaaaccggtccgatgcccacgggcgtcgccggtccgcgggcgctggatgaggggggcatcgcccggccgatccggatcggcccggccctgcttgcggttcaggacgcggcccagcgccgccgcttcatccgcgactggagccggtcgatggtcgagatgggggtgccgcccgcgccatgatcccggctgcgaccgtgttttcagcccggcttgcgggcggcgatgaaatagttgatgccgagcgaaccgccgacctgccagccggcagccggatcccggttcagtcctaccgcctcgaacggcctgagcccggcattgcgcaggccgcgggcgagttccgagggacgcaggaatttgcgccagtcatgggtgccgcgcggcacccagcgcagcacgtattccgccgccacgatcgcgcccaggaagctcttgggcgtgcggttgagcgtcgaggcgatcagcacgccgccgggcttgagcagccgggcggcgctggtgaggaagaggtccggatcggcgacatgctcgacgatttcgagcgtgagcaccacgtcgaaggcctcggtctcgccggcggcgacaagatcctcgaccgcggccgcacggtaggtgatgtcgagcccggcatcggcggcatgggcggaggcgacggcgatgttgcgtgccccggcatcgagaccggtcaccgccgcgcccagccgtgccagcggttccgagaccaggccgccgccgcagccgatatcgatgatcgcgagcccgtcgagcgggcgcatgccgtcgaccggccggcccagcgtcttgcacaccgtgtcccggatatagccgatccgggccgggttgagcgcgtggagcggcgcgaaggggccggacggatcccaccactcctccgccatccgggtgaaggtgtcgatctcgcgggcgtcgacggttccggtggcgggggcaggggtcatgacctgaattttcctcgggctcggcatcggctggatcaccggtgcgcatccttgcacggcccggcaggggagagtatgaatatgcgccctgcaagcgacaagggcttgacggcggcggcattcgcggaaacggcccgaaaaaacggccctcacaccagaaaacggccctggtcccttgccttgcccggcgggatcggccgacacgacggagcggacccacatggcgcgcatcgtgatgaagttcggcggcacttcggtcggcgacatcgagcggatcaagaatgtcgccaggcgcgtcaaatccgaggtggatgccggcaacgaggtggccgtggtggtctcggcgatggccgggacgaccaaccagctggtcgcctggtgccgtgaggccgatctggtccacgatgcccgcgaatacgataccgtggtcgcctcgggcgagcaggtgaccgtcggcctgctgtcgatcgcccttcaggcgatcggcgtccatgcccggtcgtggctgggctggcagatcccgatccgcaccgacgatgcccatggtcgtgcccggatcgaggcgatcgagggtggcgagctgatcgcccgcatgggccgcggcgaggtgccggtggtcgccggtttccagggcgtttcgcccaccggccgcatcaccacgctcggccgtggcggctccgacacctcggccgtggcgctggctgcggccctcaaggctgaccgctgcgacatctacaccgatgtcgacggcgtctacacaactgatccgcgcatcgttgcgaaggcgcggaagcttgataagatcacgttcgaggaaatgctggaaatggcctccctcggagcgaaggtcctgcagacccgctcggtcgagatggccatgaagcatggtgtacgcgtacaggttcgctccaccttctcggacgcgcccggcaccctggtcgttgacgaggacgagatcatggaacagaagctggtgagcggcatcgcgtacagccgcgatgaggccaagatcaccctggtgcgtgtgcccgaccatccgggcattgcggcacatgtcttcggcccgcttgccaaggccggtgtcaatgtcgacatgatcgtccagaacgtgtcggaagacggccgggcgaccgacctgaccttcacggtcggcaaggccgatatggagcgggcgctgaaggtgctggacgaggcccgggccgagatcggttgcgagcgcgtcgacagcgaccccaacgtggccaaggtttcggccatcggcgtcggcatgcgcagccatgccggcatcgcctcgcagatgttcgacgcgctggcgcgcaagggcatcaacatcatggtgatctcgacctccgagatcaaaatcagcgtgctggtggccgaggagtacaccgagctggcggtgcgcgccctgcatgcggagtacggtctggatgccgcttgatcggccggctgtgcggcccggaacgacgggccgcccgaggcttgaccatatctggcaccgcggcacgtcgtctgcgggagcgcatgatgccggccgggacgatggcgcatcacggatctccgtgcgccatccggccccggcccggcggcgcgcgacccccagccgtcaccgcctgacccgcgcggacggaacatgagcgcgccggcgtcggccatcccgggaccgcgccgcctgctcaggcggctgcgcgacgtcatggccgcgcccgggactgcgcagtcccgtctcaaccaggtcgtgctggtcattgcggccgacatggtcgccgaggtgtgctcgatctacgtccgccgcgccggcgacgtgctcgaactcttcgcgaccgaaggtctcaatcccgaagccgtccacaagacccggctgcgggtgggtgagggcctggtcggccatatcgctgcccaggcgagcgcactctcgctctccgatgcgcagtcgcatcccgatttcgcctaccggcccgagaccggcgaagagatctaccactccctgatgggcgtgccgatcctgcgctccggccgggtggtgggcgtgctggtggtgcagaaccgcacccggcgcaattatgccgaggaggagctcgaagccctccagaccgtcgccatggtcctggccgagctgatcggcgccggcgatctggtcaacccgtcggaattcctggaagccgagggcaatgccacgctgccgcagcgcgccgaaggcgtgcggctggccgatggcgtcgccatgggcattgcggtgctgcatcgccaggcgatcgaggtccgccagttggtggccgaagaccccgaggtcgaggccgagcggcttgccgaggcgctggagcggctcagggcgtcggtcgaccgcatgctggcccggccggacatcgccatcggcggcgagcatcgcgaggtgctcgagacctatcggatgttcgcccatgaccggggctggatctcgaaaatcaacgacgccatccgcaacggcctgacggccgaggctgcggtcaagcgcacgctcgacgacatgcgtgtccggctgaacgcctcgggcgacccctatctgcgcgagcgggtgctggaccttgaagacatcgccggccggctgctcggcctgctgaacggcgagcccgagccccagacccgcgagctgcccgacgacatggtggtcgtggcccgcgccatggggccggcggagctgctcgactacgaccgcacccgcctgcgcgggctcgtgctggaggaaggctcggccaccgcgcatgtggcgatcgtggcccgggcgctcgacattccggttctgggccgggtggacggggcgttgagccgcatcacacccggtgacccggtgatcgtcgatgccgacaacaaccagctgatcatccggccgggcgaggatgtggtcgatgcggtgcagctgacgctggccgcccgggcggaacgcaaggcagccttcgccgccctgcgccacatgccgtcgatcacccgcgacgatgtgcgggtcaacctgctgatgaatgcgggcctgcttgccgatatgggcatgctggccgaaagcggggccgaggggatcggtctctaccgcaccgaattgttcttcatggtgcggtcgcagatccccgatgtcgcggcgcaggcggatctttatgcccgcgtgctcgaccagtccggggagaagccggtttatttccggaccctggatgtcggctcggacaagcagctgccctatttcaaccatcgcccggaagaaaacccggcgatgggctggcgttcgctgcgcctgacgctcgaccggccggcgatgctgcgccgccaggtgcgggcgctgctgatggcgagcgccggccggcagctgaacatcatgttcccgatggtcgccgaggttgccgaattcgatgccgcccgccggctggtgcagatggaagtggcgcgggcccgccgccagcaccagcgcctgccgtcccaggtgcgggtggggacgatgctggaagtgccggcgctggcctggcagttgaagcctctgctggagcgggtggatttcatctcggtcggctccaacgacctgctgcagttcttcttcgcctgcgaccgtggcaatccggaactggccgaccgctacgacctgctgtcgcccgcggtgctgggcttcctgcgcaatctggtcgatgcctgcgcccgggccgatgtggagctgtcgctgtgcggcgaaatggccagccggccgctggaggcgatggcgctgatcggtctgggtttccgccggatgtcgatgccggccggtgcgatcgggcctgtgaaggcgatggtccgcagcctcgatcggggccatctggcgtcctatatggacacgctgctcgatctgcccgaccactcggtccgcgatcggctgatggcctttgcccacgatcacggtatcgcgatctgagcccggttttcactggtttatcccaggtttgcgcttcgggccggtgggcccgccatcccagccctccccttgcactcgggcgcgacggggagtagggtctgcgcaattcggcaccgcaaaaaagacagggtgcgtccgctgcgcaccgccatccggccgggccggcggcgatgatgtccgcattgacggctgcctgcccctgccccaccttgaaactcacgcgggtgccgcccgcatcctgaccctgcgaccggagcgatcgagacagccgatggcgcgccaaacgtccaacagcagccgcctgcacctctacgacgtgaacgccggagaggccggagggtccggtggcggccccaccggcggatccggcgactatgccggtgtcggcgcgctgttgaaacgcgagcgcctgcgccaggggcacgacatcgcccaggtcgccgaccagctgcgcatccgccgcctctatctggaggcgctggaggaaggccgctatgccgagctgccggcgcctgcctatgtgatgggcttcctgcgctcttacggcgccttcctcggcctggatgtgcccgagttgctgcgtcgctacaaggccgaggggcagcatgtgccccagaccaacacgctcgattttccgacgccggccgaagaaggccagatgccgcgcttcacggtgatcgtggtcgccgtcgtactggccgtgatcgcctatggcggctggcgctatttcggcgagaccccgaaccagatcgccgataccgtcgccgaggtgccggcctatctgctccagtcgggcggcgaggggcgtgatgccgcccaggtcggtgccggcacgacggccgggcagacggccaccacggccgacgaccgcgccgctgccgaggtgaccgaccgccagaccgacgaggccgagactgccgatgccgcatcctcggcggcggcaccggtcacttcgtcgcctgcagccccggcacccacgacctcggcacccaccgctcaggcacccaccgctcaggcacccaccgctcaggcacccaaccctcgggcccccacgacctcggcccccgcagcgcaggccccggcgcctgccgcggctgcgccgactgcgactgcccaggcaccttctccggctccttctgcatcggccccgtctgcgtcggctcctgcggcccaggctccggcagctcaggcgcctgctgccccggccgcatcgacgccggtacccgcggcgccggcctcgggcagtggcatccgtatcgtcgccaccgccgacagctggctgcagatccgtgcgcccggtggtggcaccgtgttcagccgcatcctgcgggccggcgagacctacgaccttccgcccgaggcggtgggcgccagcatgatcaccggcaatgccggcggcatcgagatccaggttgatggccgcacactgccaccgcttggcgcggccggtgtcgtgaagcgcaacatcgtcctcgaccggcaggcgctgcaggcctcggcgggctgagcggccggggggggctctatccccggccccgccgccctggcccggctccatgaggcttgccggacatggctgcggctgataagtccttcaacgtccggcatccgcggccgatctgccgtccgcgggccatgatcagcgacggaagccatcatgaccgtcagagcctatcgccatatcgagcggcgccagagccgcaagatccgggtcggtccggtcgaggtcggtggcgacgcaccgatttcggtgcagaccatgaccaacacccagaccccggatgtggacggcacgctcgatcagatccgtcgcgcggcagaggccggtgccgatatcgtgcgggtgtcctgccccgacgaagactcgaccgcggcgctgaagcagatcgtggccggaagcccggtgccgatcgttgccgacatccatttccactatcgccgcgccatcgaggcggccgaggcgggggcggcatgcctgcgcatcaaccccggcaatatcggctcggccacccgcgtgcgcgaggtggtgaaggcggcgaaggatcacggctgttcgatccgcatcggcgtcaatgccggcagcctggagcgggaactgctggagcactatggcgagccctgccccgaggcgatggtcgaaagtgcgctcaaccacatccgcatccttgaagaaaacgacttcttcgaaaccaagatcagcgtgaaggcctccgacgtcttcctggcggtcgcggcctatcagggcctggcggaggcctgcgactacccgctgcatctgggcatcaccgaggcgggtggtcttcgctccggtacggtcaaatcctcgatcggcctcggcatgctgctctggtcgggcatcggcgacaccatccgggtctcgctctcggccgatccggtcgaagaggtgaaggtcggctacgacatcctgaagagcctggggctgcgccggcgcggggtgaccatcgtgtcctgcccctcctgcgcccggcagcgcttccaggtgatcgacacggtcgcaaagctggaagaccggctgggccacatcaccgtgccgatctcgctgtcggtgatcggctgtgtggtcaacggtccgggcgaggcgcgggaaaccgagatcggcgtcaccggcggcggcggccatcatctggtctatatcaacggcgcgcccgaccacaaggtcggcgacgaccggctgatcgaccatatcgtcgaactggtcgaggcccgcgccgaggcgatcgccgccggtgacaccgccatgaccacgctgaagcggaaggtcgcggccgagggctgaccccggcgaccctgcacctttccttcccggacatcccagaacctgcctgacggagacccccagccttggccaagctgcagccggtgcgcggcacccacgacatcctgcccgacgagatgccgcgctatcgcaatgtcttcgatgcggtggcccatgtcggcgccacctatggctatggcgagatcgcgactccgatcttcgaattcaccgaggtgttcaagcgcaccctgggcgacacgtcggacgtggtgacgaaggagatgtacaccttcgccgatcgcggcggggaggggttgacgctccgccccgagggcacggccggtgtcgcccgggcggtcatttcgggcgggctgctgcagcaggtgccgctcaaatatttctaccgcggcccgatgttccgctacgagcgcccgcagaaaggccgcatgcggcagttccaccagatcggtgtcgagctgctgggcgtgcccgaacccagcggcgatatcgaagtcatcgccctcggcgccgatattctcgaccggctgggcgtgctgggcgacaccatgctcgagatcaacacgatcggcgacatggagagccgcaacgcctatcgcacggcgctggtcgcctatctggaaggccatatcgaccgcctctccgatgacagtcgcgagcggctgcaccgcaatccgctgcgggtgctggacagcaaggatgcggacgaccgcgaggtggtggcgaacgcgccgcgcttcgatgactacctgacgccccatgccgccgatttcttcgcggcagtcctggccgggctcgaccggctgggcatcccctatcgccgcaatgtctatctggtgcgcgggctcgactattactgccacaccaccttcgaattcgtgaccgaccggctgggcgcccagggcaccgtgctcgccggcggccgctatgacgggctgatcggccagatgggtggcgccgagaccccgggcgtcggctgggcggccggcgtcgaacggctgtcgctgctggccgagccgccggcggccaccatccgtccggtggcgcttgtgccgctgggcccggctgccgaggccgaggcgatggttctggcgcaccggctgcgcaaggccggtgtcgtggtcgatctcggctacggcggtaacctcaagaagcgcatgaagcgcgccgaccgtgtgggggccgcccaggcggtgatcttcggtgatgacgagcttgcccgcggtgccgcccagctgaagagcctggatgatggcgcccagaccgaggtggcgctcgccgatctcgtcgaccgcctggccgcgcggggctgaccctcaggtcatgtcgcttcaggccaagctcgatcaggtcctgcgccgccatgaagagctggcggcacggctcgccgacccggcgattgccgggtcgggcgattatgtgcgcctgtcccgtgaattcgccgggctggacgaactggcacaggccgtgcgccggcagcgggaggtggcgcgtgaactggccgaagcgcgtgtgatggccggtgatccggccgccgatgccgagatgcgggcgctggccgaagaagagtgccggagcctcgaggccgagtgccaggcgctggaccgctccgttcgggtgatgctgctgccgcgcgacgaggccgatgaccgcagcgccatccttgaaatccgtgccggcaccggtggcgaagaggcggcgctgttcgcagccgatctcttccgcatgtatcagcgttacgcccaggaggccggctggcgggtctcgctgctgcaggcgacggagagcgacctcggcggcttccgcgaagtcgtggccgagatcgaaggggcgggcgtctatggccggctgaaattcgagagcggcgtccatcgggtgcagcgtgtgcccgagaccgaggcccagggccgcatccacacctcggcggcgacggtcgccatcctgcccgaggcggaagaggtcgacattgccatcgatccggcggacctgaagatcgacgtcttccgggcgagcggtgccggcggccagcatgtgaacaccaccgacagcgcggttcgcatcacccatctgccgaccggcattgtggtggtgcagcaggacgagcgctcgcagcacaagaaccgggccaaggcgctcaagatcctgcgcgcgcggctgttcgagcaggcccgcgatgcggcggccgaggcgcgcgcggcagagcggcgcggcctggtcgggtccggggaccggtccgagcggatccggacctacaacttcccccagaaccgggtcacggatcaccgcatcggcctcaccctctataagctcgacaaggtggtggcgggcgaggcgttgggcgagctgatcgaggcgctggtgaccgaggatcaggccgcccggctggcggctttggacgagaccggcgcatgagtccggccgggggcggtgacgcagatgccctgcgtcggatgctgacggcccggctggccgacgtcgccggcgcggatgccgggctggaagcgcggatgatcgtggagcgggtgacggggctggatgcggccggcctgctgacccgcggcgaccagccggtttcgcctgatgcgcgtgccgcggcggaggctatgcttgcccggcggcttgcgcgtgagccgctgtctcagatcttcggcacccgcggcttctggaccatcgatctggatgtcaccgccgacgtcctgaccccccggcccgacaccgagaccctgatcgaggccgtattggatttcgtcgacaccgatggccgcggccgcggccatccctggcggatcctggatctgggcaccggttcgggctgtctgcccgcggccctgctcaccgaactgcccgaagcgcgggcggttgcggtcgatcgttccgaggctgccgcgcgggtggcccggggcaatctggcgcgaattgcgcccgaccgcgcggccgtggccgtcggcgactgggcgacggcgctttcggccgcacccggccacgtattcgacttgatcgtgtcgaacccgccttatatacctaccaatgaaatccgggccctggatccggaggttgcgcggcacgagccacatcttgcccttgatggcggtgatgatggtctcgaggcatatcgggtgctggcacccgtgattgcacgcctgctgcaccccgaagggttcgcatgtgtggaagtcggacgaggacaggcgcgggatgtggagcgcctcttcggcgacctgggattgacgacatccgtaaggaatgatctgggccgtatcggacgctgcgtgaccgcgcggcatgccgcagcggtggcgccctgagcgctgcgagcctgcgcccgacccgcggacggtcctgatcctggcgtgatggccctgcggagagggcacgcaagcatttgccacctggcacatcgacggccggttcggccgtaacaccgaacagataggacggcttggactgacatgaggaacggcccgaattccaagcggacgcgcatgggacggcagcagggcggtggcggcggtggtggtcgcccccggccgcagcagccggtcaaccgcaaccggatctttgagagcaacggccctgccggcaagatcaagggcaacttgtcccaggtcatcgatcgctatctggctgcggcccgtgatgcgtcgagttcgggcgaccgggtgctggccgaaagctgcctgcagcatgccgagcactatctgcgcctgatgaacggcacccaggacgagaaccgcaccgaccggagccccgttcaggaccggttctcgcgcccggggaccgaaacggactccgacgaggacgagaccgagagcggcgacgccgagggtgaagacgaggccgccgagccggcggagcgcccgaaccggggcgaccgctatgagcgcggcgatcgtagcgaccgtttcgagcgtggcagccgtttcgatcgcggggaccgtgatcggggagaccgcgccgagcgtggcgatcggcccgaacgcggtgatcggcctgaacgtggcgatcgctccgagcgcggcgaccggcccgagcgtggcgaccggcccgaccggggtgatcgcgatgacgaacgcggtggtcgccgtcgtcgcggccgtcgcggcaatcggggcgagggccgcgatgagcgtgacaccgagcgcggtggcgagagcgatctgttcggtggcgagcagccgcgtgaacggcgcccggccggcgatctgaccccggcgccgcagccggttgccgagcagccggccccggtggccgaaaagcctgcaccggttgaaaagcctgcgcctgctgttgcggcaccggttgccccggcgcccgccgctccggcccctgcacctgccgctccggcgcctgccacgccggtgcccgttgcttcggcacccgtcgcttcggcaccggcggccgaacagccggccgagccggcacctgccccgcgtcgccggaccgccaaggccgccgagactgcggcagccgaggccggagaggccgaggcgcccaagccgcgccgcacccgccggaccaaggccgagatggccgcggccgcggaagcggctgccgccgaaggggctgcaccggccgaaaagccggtccgcaagcgtgcgaccaccacccgcacccgccgcaaggcgagcgaggatgagggcgaggccggctgacgagcccggccggctgccattgctgcctgaacgaacgccgccgtcgggatgaccgacggcggcgttcgtgtatccgggggcaggtctccgtcctgcgtggctcagcgaatgatgatcggatcgccggcgcggatcgtgccggggcgggtcacgacggtgaagacgccgaattccttgtggccctgggtcgaggagagggccggcaggacctccagatcccggatggcggtgcccgggcggacatgggtggcggcacagcgaatgaccggtgccaccgcctcgacggcgacctcgccgatttcgatggtgcggccgatcaggtcgcgctcgatccagggctcgccgaaatcggcaaccaggttgttgcggaaccgcagcggatccagcgcctccggcgcaagccccatggcgtgagccagcgcccggccgctcgccagattggtgatcgagagcatctggcgttccttgtcggtgaacgaacccgtcccggccttgaccagcatcggcgccttggccgggggcaggtccagatgacgcgcgaccagctggccggcgcggaccgcgaaatccggatcgtcgccctggccggcgatggcctcgccgtcgggcagggtcagcaccagccggtcggtttccgtgtcgtagcggcaggcgatcgcggccatgcgcggttcggtcaccatcacatgaaaggcggccttcgggcgccattcgggctggagcggattgggctgggtgccgatcttcgcaaaggcgaagcggcggtcggcgggcaggccggcaccagtttccagccgggcttccgaaagccggtccacggacaggctcttcacggggaagcggttgatgtcgatcaaggcgccgtcggccatccctcggtctcctggaagggcaggtcagatccgcatcatagcgatgcatgaagatggtgcgaggcgatcttgcacgactgttgccggttcaccacatgggatgtgggccggggacaaccggtccgcccggcggccggccgcagcagcggaggatcgccggggcaggtcggtcggcgccgtcgccacgaaagccagggacgcgcgccattccatcggacgatcgtcgagggacgccacggcatgaatatcgagagctataccgatcgggcaaagggtttcctccaggcggcccagcagctggcgcagggccgggggcatcagcagttcacgcccgaacatcttctgaaggtcctggtcgatgacgagcagggcgtggggctgggtctggtgcaggccgcgggcggtgaccccgcgaagctgcgcgaggcggccgagcgcgcgctcacccgcctgcccaaggtcgaaggcagcggtgccggccagctttatctggcgccggataccggccgcgtgttcaccgaggccgaggccctggccaagcggctggaagacgagtatgtcgcggccgagacccttctgctcgcgctcgccctggtcgaccggaccgaggcgcagaaggcgctggcatcggccggcgtcaagccgcaggcgctggaggccgcgatccgcgacatgcgcaagggccgcaaggtcgacagcgcgcaggcggagcagggctatgacgcgctcaagaaatatgcccgcgacctcacccaggcggcgcgggacggcaagctcgacccggtgatcggccgcgacgaagagatccgccgcaccatccaggtgctcagccgccgcaccaagaacaatccggtgctgatcggcgagcccggcgtcggcaagaccgccatcgtcgaggggctggcgctgcgcatcatcaatggcgacgtgcccgagagcctgcgcagcaagaaggtgctggcgcttgatctgggggcgctggtcgccggtgccaaatatcggggtgagttcgaagagcggctgcgcgccgtgctgcaggagatcgatgcggcggcgggcgaagtggtgctgttcatcgacgagctgcacacccttgtgggggcgggtgcagccgaaggctcgatggatgcctccaaccttctgaagccgaagctggcccggggcgagctacgctgcatcggtgccaccacgctcgacgagtatcgcaaacatatcgagaaggatgccgcactcgcccggcgcttccagccggtgatggtcgaagaaccgacggtggccgagaccatctcgatcctgcgtggcctgaaggagcgctacgagcttcatcacggcgtgcggatcaccgatgccgcggtggtggcggcggcgacgctgtcgaaccgctacatcaccgaccgtttcctgcccgacaaggcgatcgacctggtcgacgaggcggcgagccggctgcgcatcgagatcgagagcaagcccgaggcgatcgacgagctcgaccgccggctgatccagctcaagatcgagcgtgaggcgctgaagcgcgaaagcgatcaggcgtcgaaggaccggctggtcaagctggaaggtgagattgccggtctggagaagcagaccgccgacatgactgcgtcctggaaggccgagaagggccgcctggaaggtgtgcagaagctgaaggaggagttggaccagctgcggctggagcttgccaacgcccagcggcgcggtgacctggccaaggccggtgagctggcctatggccggatccccgaactggagcggaagctgaaggcagccgaggagcaggtgaagagccggctgctcgacgaggcggtgaccgacggccatatcgcggcgatcgtctcgcgttggaccggcgtgccggtggacaagatgctggaaggcgagcgggccaagctgctgcgcatggagcaggtgctgggcgagcgcgtcatcggccaggcagaggcggtcgcggcggtctccgaagcggtccggcgtgcccgtgccgggctgcaggatcctcgccggccgatcggctccttcctgttccttggcccgaccggcgtcggcaagaccgagctgtcgaaggcgttggcgcagttcctgttcgacgacgacgcggcgctgctgcgcatcgacatgtcggagttcatggagaagcacgccgtctcgcggctgatcggcgcccctccgggctatgtcggctatgacgaaggtggtgtgctgaccgaggcggtgcgtcggcgtccctatcaggtgatcctgttcgacgaggtggaaaaggcccatccggacgtattcaacgttctgctgcaggttctggacgacggtcggctgaccgatggtcagggacggacggtcgacttcaccaacacggtcatcatcctgaccagcaatctgggcgccgaggttctggcgggccaggagccgggtgcgccggccgaagacgtccgggcgcaggtgatggcggtggtccgtgcggccttccgtccggaattcctcaaccggctggatgagattatcctgttccaccggctcggccgcgagcatatgggcgggatcgtcgacatccagatcaccgatctggtcaagcggctggccgaacggcagatcggcttcgatctcagccctgccgcccgcgactggctggctgatgccggctatgacccggtctatggtgcccggccgctgaagcggaccatccagcgcgaggtgcagaacccgcttgcgcgcatggtgctggaaggccggctgcccgagggttcgacggttcgggcggatgtccgggacggcgcgctggtcttcgagaccagcacgcctgaagcggcggcggcctgatcggcatcccgggaccagacgtaaagaaacccccgcccgagcgatcgggcgggggtttttcgttgcggtccgggcgggcgcttccggctggtctgcgccggctggtcgcgaaatcactcggtggagcggcccggcgtcgccgtggtggtgctggccagggtggccgaggcgccgcgcaggctcgccacctgcttctcgacctgggcgaccgtctggcggaacttcttcaattcggcagcggcgagggtgcggccaaccggcagcttgatgctcttcgggttgacctgcgtgttgttcaccagcacttcgtaatgcagatgcggcccggtggagcggccggtggtgccgaccgcgccgatcacctgaccctgcttcaccttctggcccgcccggacgttgatccggctcatatgggcataggcggtggagtaggtgccgttgtggcggatgcggacatatttgccatagctgctgaaccagtcggccttctcgaccacgccgtcaccggcggccatgatcggggtgccggtgggggcgccgaaatccacgcccttgtgcatcttggtgtagccgagcagcggatggcggcgggcgccgaagcccgaggtcagacgggcgccctcgatcggggtctgcagcagggccttgcgcacgctcttgccgttcggatcgaaccagtcgtcgtcgaaacggtagagggtcagtgaccgaccgccgaccaccagggtcgccgccagcacgtcgccattgcggatcgcgcggccctgttcgtcgaccatgcgctcatagagcacctcgaagcgatcacccggctgaatgtcccgctggaagtcgacgtcgtaggagaagggcttgatcagctccgacaccatagagaccggcaggtctgccgcggcggctgcttcgtacaggctggagcggatctcgccggaggcgagcgcgagctgacggttcagctccttgcgcacctcgacggcggtgaaactggtctgcaggccgctgcgttcgatgcggatctgacgctcggcgtcgatcgccatctggaagctggtcaccgggccgctgccgccacccgcccgctggcgcgggaaggtcagggtgacttcctggccgaccttcaggctgcgcgggttgaacaccttgcgcatcgaatcgaccagggcataggcgtcttcctgggcgacgccgttgcggaccagaaggtcgatgatcgtgtcgccacgctcgacggtcgccgtgcggatgatggggcccatctcggcggcattggtcgagggcgtcagggtgcgcagttcaaggcgttcgtcgagcaggcggcgggtcagggtatcaggcgctgcaaccggggcctggttgcggagcgtcatgtcgaagggatcgaagctgttcaccagcgggtcggcgaaggcgacatattcggcggctgtggaagttccgggtgtggtgagaagcgtcacccccatgattgccgcgacggccgcagccatcgccctgccccacaggttttgtcgcacaccaagcccgtcggtggtgaaccgcatgaagtcgcccctttgagtttgaacccgctcttgtcgcgtgctcccgacctgccggtaccgcctgtccgacattccggtcgagatgcgtcgcccgatcactttggacttgcctctttctggccgatcttcgtgatcctgtgcccgctttcagacggcatccgcatcacccacgtcccgcggtcctgcatccgttcactgaccttacagatcatccatcaaacgatgacatatcttgtatgcggtcagtcaactgacgtcaggccgagtctccggaaggagaaccgggcgtgaagcgattcgatcggatgcctgccgacttgtcgaaacgacccggaggtcggttccaagctgttgccgataccggcgccagcggggaaagcgaacaaaaggctcacgactttgttttcgattttttgccactgtgcccaagcgcagccggggtgtcaacgggatgttgggcgtgatcgacgaggcaggacgtcgcagccgcgatgcagggcaagataggaaaaaagccatgtatcgttaaccacttggatacctcacttcatgtggtgctgcatgctgcgatgcggtgcggaatatgaaggggttacgcgcgcgggcgccctcgcgctcgtgcacgagcatggactggaccgttggggctccgcggaaccgtgtttcgacgggtgccgtatccggtggtctggtctccggatggtcacgcgcctgatcgggccccgcggagcggaagaccgcccgatgtgtcgtgggcggccccggaaaaatgccggtgccggaaaaaaaaacgcaggggctttgccgaggggccgggaaaccggcctggagagcgatggatgatccctcatgatttcaaggggatgcccgacaggctcaggggcgtcgcgaaaacgtcatcgaagtgtgttgacagggggggcggatccccatataaaccgccccacaccgacgggcaccgcggaggacgcggcgccgggcggggctgaaaagccagagaatacagcctcttaaacgaggcgggcccttaagaggggcaggcacctgagggtgccgcgaggcgggaacgcttcgtcaggatctttgacattgtgaaacggatcggaagggatgcgagggcggcggtcgtcgatcttaggactttaagaacgactgaccgatgagcgccttggcatctcgatatgaccttgtgcctagagagatgccgggacgattttcggttgaagccttgttgtgtgagcgatcacgcagcgaaggttcaacttgagagtttgatcctggctcagaacgaacgctggcggcatgcctaacacatgcaagtcgaacggggtcgggacttcggttccggcttacgtggcgcacgggtgagtaacacgtgggaatctgcccatctatggggaataactgcgggaaactgcagctaataccgcatacgcccttcgggggaaaggcttcggccgtagatggatgagcccgcgtccgattagctagttggtggggtaacggcctaccaaggcgacgatcggtagctggtctgagaggatgatcagccacactgggactgagacacggcccagactcctacgggaggcagcagtggggaatattggacaatgggcgaaagcctgatccagcaatgccgcgtgagtgatgaaggtcttcggattgtaaagctctttcgacggggaagataatgacggtacccgtagaagaagccccggctaacttcgtgccagcagccgcggtaatacgaagggggctagcgttgttcggatttactgggcgtaaagcgtgcgtaggcggcttatcaagtcagaagtgaaagcccggggctcaactccggaactgcttttgagactggtaggctggagttcgggagagggtagtggaattcccagtgtagaggtgaaattcgtagatattgggaagaacaccggtggcgaaggcggctgcctggcccgaaactgacgctgaggcacgaaagcgtggggagcaaacaggattagataccctggtagtccacgccgtaaacgatgagtgctggacgttgggatacttagtatcgcagtgtcgtagctaacgcgttaagcactccgcctggggagtacggccgcaaggttaaaactcaaaggaattgacgggggcccgcacaagcggtggagcatgtggtttaattcgaagcaacgcgcagaaccttaccagcccttgacatggacgtcgcgaccctggagacggggttttcggttcggccggacgtcacacaggtgctgcatggctgtcgtcagctcgtgtcgtgagatgttgggttaagtcccgcaacgagcgcaaccctcatccttagttgccatcagttcggctgggcactctagggaaactgccggtgataagccggaggaaggtggggatgacgtcaagtcctcatggcccttatgggctgggctacacacgtgctacaatggcgactacagtgggcagcgacatcgcgaggtgaagctaatctcaaaaagtcgtctcagttcggattgtactctgcaactcgagtgcatgaagtcggaatcgctagtaatcgcggaacagcatgccgcggtgaatacgttcccgggccttgtacacaccgcccgtcacaccatgggagttggttttacccgaagccggtgagctgacccgcaagggaggcagccgtccacggtaaggtcagcgactggggtgaagtcgtaacaaggtagccgtaggggaacctgtggctggatcacctcctttctaaggaagacgcccgccgtccccgcatcccttccgcatcgaacgcagtcaagcgggcctgtagctcaggtggttagagcacacgcctgataagcgtgaggtcggtggttcgagtccacccgggcccaccatctgccttgcttgtcctggaggcacctgtccttgagacgggcccttgacgttggttcgatgcaggaagcgagaaggtttcggccctgttcttcggaacgggatgccgggatcgggtttccgatccgtgaaccgggatccttttggatcaccggcgatgttctttgacagtgtgaagagatgagatcgtctgatgtatgcgagctgagtggccgcgcgtcggaacctcgaaggatgaccgcgccggtttgcaggagtgcaaacggatcgcgggtccggttctggacgtggcggcggatctctcgagcaagagaagggcatctggtggatgccttggcgtcaggaggcgatgaaggacgtgacacgctgcgataagccgtggggagctgcgagtaagctttgatccatggatttccgaatggggcaacccaccgcttcggcggtatcttctggtgaatacatagccaggagaggcgaacccggtgaactgaaacatctaagtagccggaggaaaggacatcaacggagactccgtaagtagtggcgagcgaaagcggatcaggccagtggtcctttgtgcgacgatcagaacggcatggaaaggccggccagagcgggtgatagccccgtatggagagttgcgcactggatccttgagtagagcgggacacgtgaaatcctgttcgaagatggggggaccaccctccaagcctaagtactccctgacgaccgatagtgaaccagtaccgtgagggaaaggtgaaaagcaccccgacgaggggagtgaaacagttcctgaaaccggatgcctacaagcagtcggagggcgcaagcctgacggcgtaccttttgcataatgggtcagcgagttactttatccagcaagcttaagccgataggtgtaggcgcagcgaaagcgagtctgaacagggcgtttgagttggatgaagtagacccgaaaccgggtgatctagccatgggcaggttgaaggtgcggtaacacgcactggaggaccgaacccacgtctgttgaaaaagacggggatgacctgtggctaggggtgaaaggccaatcaaactcggatatagctggttctccgcgaaaactatttaggtagtgcgtcacgtgattacccctgggggtagagcactggatgggctagggggcctcaccggcttaccaaacctaaccaaactccgaataccagggagtacagcgtggcagacagactgcgggtgctaaggtccgtagtcgagagggaaacagcccagaccaccagctaaggtccccaagttgcggctaagtgggaaaggatgtaggacggccatgacaaccaggaggttggcttagaagcagccatcctttaaagaaagcgtaacagctcactggtctagataagctgtcccgcgccgaagatgtaacggggctaaagccgtacaccgaagctgtggatgcaccgtatggtgcgtggtagcggagcgttccgtaggcctgtgaagggtgacccgtgagggcgcctggaggtatcggaagtgagaatgctgacatgagtagcgacaaacagagtgagaaactctgtcgccgaaagcccaagggttcctgcgcaaggctaatccgcgcagggtgagtcggcccctaagacgagggcgaaagccgtagtcgatgggaagcaggttaatattcctgcacctgtgggaagtgacggatgatgtaagttgtcggggcttattggattgttcccggcagcgaagttgttccaggaaataactcccacgtacagaccgtacccgaaaccgacacaggtgggctggtagagtataccaaggcgcttgagagaacgatactgaaggaactcggcaaattacccccgtaacttcgggagaagggggccccgttcctgggcaaccaggggcggggggcacagaccagggggtggcgactgtttactaaaaacacagggctctgcgaagccgcaaggcgacgtatagggtctgacgcctgcccggtgccggaaggttaagaggaggggttcacgctctgaatcgaagccccggtaaacggcggccgtaactataacggtcctaaggtagcgaaattccttgtcgggtaagttccgacccgcacgaatggcgtaacgacttccccactgtctccagtatcgactcagcgaaattgaattctccgtgaagatgcggagttcccgcggtcagacggaaagaccccgtgcacctttactacagctttgcagtggcactagggactgaatgtgtaggataggtgggagcctatgaagccgcggcgccagccgaggtggaggcaaccttgaaataccacccttttggttcttggtgtctaaccgcgctccgtgatccggagccgggaccctgcatggcgggtagtttgactggggcggtcgcctcccaaagagtaacggaggcgcgcgatggtgggctcaaaccggtcggaaatcggttgtcgagtgcaatggcataagcccgcctgactgcgagactgacaagtcgagcagagacgaaagtcggccatagtgatccggtggtcccgagtggaagggccatcgctcaacggataaaaggtacgccggggataacaggctgataacccccaagagtccatatcgacggggttgtttggcacctcgatgtcggctcatcacatcctggggctggagcaggtcccaagggttcggctgttcgccgattaaagtggtacgtgagctgggtttagaacgtcgtgagacagttcggtccctatctgccgtgggtgtaggagacttgagaggatctgtcctcagtacgagaggaccgggatggacggacctctggtgcaccagttgtgacgccagtcgcatcgctgggtagctatgtccggaagggataaccgctgaaagcatctaagcgggaaacctccctcaaaaccaggtctcccttgagagccgtggaagaccaccacgtcgataggccgggtgtgtaagcgcagcaatgcgctgagctgaccggtactaatcgctcgatcggctcgaaagatccccgccgcgcccagaaccgggcccgcggcccacgaagcttgcacacacatcatcaaatcagacgatctcgcgctcagagcttccggaagcacaacttccggactgtccctccgtgcggtttcatgacctggtggctatggcggacgtgaaccacccgatcccatcccgaactcggccgtgaaaccgtcctgcgccgatggtacttcgtcttaagacgcgggagagtaggtcgctgccaggtcttgtaaccgcatggatggacagacaacgctcaccacaacaaagcgcgatctcatctcaatccacactgccaaccgcctacgccctgacgcggggtggagcagcccggtagctcgtcaggctcataacctgaaggtcgcaggttcaaatcctgcccccgcaaccaagtttcaagcaaacgccgccccggcctctcgccgcgggcggcgttgctgcgtttaggcgtgcgcttccgcatgcggttctggcgaacggtcaggcggctcattcatcgccaagaatgtcatctttcctacattaagagtcgttatccttacattcgacgccggcctcggcctcccctccggcgccgaatgtgaggaaaacgagatgaaccgctccgaccttcgtgcaaggccgccgcgccggcgcttgcagatgctgcttctgtccaccgtggcgatcctgccgcttctgcatacgccggtccatgcgggcgacggcgagctgcgcattctgtcgctgaacacctggggtgaccgcttcaagccgaacccggcggcggcgatgtcggaattcctggtcaacggcaattacgacatcctgaccttccaggagctgcgcggcggcacgacctacctcgcgaccattccgccgctgctggagagcgaagggctcggcacctacaccaccggccagatcggggatgtcggcctcgcctcccggctcgccggcgatcatggcgcctatgagaacggcgtgcggatctcgtatcagacggtcgaggcgcagaaccggacgcccgagaccatcgtcggcacggtgcatctgaactattacgacgagccgacctatcgtatcgacgaggccaaggcgctgaacgactgggcccgggcccagggcaagccgatcatcatcaccggcgacttcaatgccggcgacctgtcggagcgtggcctgcatcgtgccgaacagcagtcctatctctttgcccgcacgatcattgacggcggcagttcggagctctggcgacagttggcccagcagtacacgcccgagggccgcgaggccgatttcgaggcctatgttgccgccatgcaggcggtggacggcaatggcagcgcccattaccgcaatgtcatccagggctatttcgacacccatcgcgacgaattccccgggatcgacagcatttccagcatgagctggcggcaatgggaacagatcgtcgccaaggacatggccgagaagggcctgaccttcgaggacgagacctatccggtcgccggcaacacgccgcagaccatgaacatcctgaagaagcagtacatcctgctgcagaaggaaagcgagcgcgagacctacgcgccccatgacctggcggacggcagcaccacctggccgtcggcgggtgaggatcataccaacacctggaccagctgggaccgggtgacgatcgaccatttcatggcctcgcgccccttcggcaagtggcaggttctggccgatgccgccgatgacgcctataccggcgttctcgacgacaccggctatgccaatgacggcaccacgccgctctccgaccacgagcccgtggcccatgtggtcaaatgggtcggcccggcgctcgaaacctatacgaccggcgccggcaccgcagacgaggccgaggcgacccggctggtctggggtggcgctgcggcggtcttcgaggagaagggcaaggtcttctacctcacccgcaacaacatgcggaccgatctctatctgggccagatctcggacgagaacggcatgccggttctggcgggcctgaccgagactgagaagaagaccctgctcgactgcgccagcgacgatccgcgcttccaggccgcgatccaggaatattgcatcgacgaccattccttcatcggcgagaccctggtgaccgatggcggcacggtgatcgtggacgaggacgcggcactcggcaacgccacggcgcagctccggctcgacaatggcgggctgcggatcgccggcacggagatggcgacgctggcgcgcaatgtttcggtcgaggccggcggcggcttcatcgaggtggcggatgccgatgcggcggtcaccgcctcgggcgtgttcagcggcacgggcgcttttgccaagaccggcgccggcacgctgacgctgacggctgagaacagcttcaccggcacgaccacggttgcggccgggcggctgaatgtcgacggctcgctggcgggctcgacgctcaccaccgttcagaatggcgccgtgctgggcggtactggtaccgtcggcaatctggcccttgcctcgggtggccgtctggcgccgggccggtcgatcggcacgctgaaggtcgcaggcgacctgaccatggccgagggctcggtttacgaggtcgaggtggatgccgacggcaaggcggatcgggtcgatgtcaccggcagcgcctcccttgcggggtcggtgctggcgatggcggcgggcggcaattatgcgccgctgaccgactacaccatcctgaccgcggaagagggtgtgaccggcagcttcggcaccgtgaccagttctctggccttcctcgacccgacgctccgctatggggcgaaggacgtcacgctccgcctggagcgcaacgacacctcgttcaggagcgtggccggcacggccaatcagcgcgccacggccgccgcggtcgaaagcctcgccatgggcaatgccgtctatgatgcggtggtgctgaccgacaccgggacggcgagtgccgccttcgacagcctgtcgggcgagctgcatgcctcggcggccggtgcgctgatgcagggtgcgatggcggtcggcgacgtggtcgccgcccagggcgcgctcagcgccggcagtgccggcatcgaggccccggcttcggcggccttcggcgccgggcggatgtggctgcaggcctatggtgcctggggctcgaatgatggcgacgacgtcacctcgatcgaccgcaacacctcgggcacgctgttcggcctggatgccgcggtcggcgaaaactggcggatcggtgccttcgccggcttcggtcaggcttcggtcaagcaggacggcacggggagcaagctcgatgccgacagctatcatgtcggtctttatgccgcgacccgcatgggcggcttcggcgcgcatctgggtgcggcctacagcctgaacgacgccgagaccacccgccatgtcgcctatgccggcaccactgaaaccctgaccgcggattacgacgtcaatgccgcccaggtcttcggcgaggtgaactatcgcttcgacaccagccatggcgctttcgagcctttcgccggcgtggcccatatcagcctgtcgggcgacgacttcaccgagaccggcggtgctgcggccctcgcgggcgatggcgtcgacatgcgcaccaccttcacgaccctcggcctgcgcaccgtgcaggaattcggcctgggtgagaccccggcggccttccgggcggaactgggctggcgtcatgccttcggcgatgtcgaccccgatgcggatctgcgcttcgccgtcggcggctcgggctttggcgtgaccggtgccgcgattgcggagaacaccgccgtcctgcgcaccggtctcgaggtcgggctcaccgacgacaccgccctgtcggtcggctatggcggccagttcggcggcgacgtcaccgaccactcggtcaccgcgaagctgcgcattcagttctgatcgcagtcaccgtcgtcagaacggacggggagggggacaccccctccccgtccgcgtatatagtgaggtcttatcgacgcgagacctcatccggtttcgggggacgaatggacgacacggacaagaagagccgacggcaggcgcaactcgtcgcgcatcttcagcaacatcgcttcatctcgctcgacgagatttcgacccgcttcggggtgaccacccagacggcccgccgcgatctcatcgatctggaagaggcggggctggtccgccggctccacggcggcggcacgcttgcggcgccgcccatagacccgccgacctatcgtcagcgccgggtcgagaatgccgacggcaaggcccggatcggtgcgcgggtggcagagctggtcggggacggatcagcggtcttcctcgacaccggcaccacctgcgaagcggtggcgcaggcgctgaccgggcggcagaacctgcgggtcgtgacctacagcctgcgcagcgcagccctgttgagcgaggtggaaagcgccaccgtcgcggttccgggcgggttcgtccgccatgtcgatgccggcgtcttcagccacgagaccgtcgatttcatcggcgccttccgcttcgacaccgcggtgatctcggtcagcggcatcgacgagcacggcatcatgggcgatgacgatcatggcgaggtgcaggcggtgcgcgcggccatgcagcaggcgaagcgcaccattctggcggtcgacggcagcaagttcttccgccgtggtctggtctcgctggcggtgatcaccgaggtcgacctggtggtgaccgataccccgccgccgcccgcgatcacggccctgctcgccgtggccggggtgggggtggaactggcgggcggctgaccgcggcttatggcggacctcaggcctcgacgcgcagatagccggtcagcccggtcttctgatgttcgatgacgtggcagtggaaggcccagtcgccgggattgtcggcgaccagggccacgtccatggtctcgccggattgcagcagggcggtgtcggtgagcagcggcaggatctcgcgcttgtccgaccgcaacagccggaaggtcagcccgtgaagatggatcggatggtcgttgggcgattcgttccgcagccgcagcacatagggcttcccctgtttcagaaccgcgagcggcgccatcgggtcgggggtatcgccttcccaggcgatgcggttgatcgaccagaaagtgtagcccagcgtgccgcagatgctggcgaccggcggcttgccgccgggcgaccagccgaagacgaattccaggatctccgcccgggccagatcgggctccgcaaccgggttcgccaccagcggcttcagctccatcaagctgcgccgggcgctcttgccggccggccggaagcgggcgatgggctggggcccctggggcaggcgcagggccagggtgacgatctcgtccgcgctgtcgggcatgcgtagcgcaatatcggcgcgctggccgggggccagcagcacgccccggggcggcagcggccgggccagggggttggaatcgagtgcgatcacctgcgcctcgccgccggtcacctcgtagaggccgacccgggtgacgtcggtgaccgccagcctgaggcggatcagcccgcccgccggcagatcgtagaccggctccacctgccagttcacggtcgacaccgtgcccagcgtgccgccacgggcggcggcacgggcgcggaagaattcgatgaactggccgtcctgacccaggcggaaatcacggatgttgagcggcagatcccggtcgaagccgggatcttcgtcctcttccaccaccagcagcccggtcaggccgcggcccatctgttccagcgtgttgcaatggggatggtaccagaaggtgccggcatccggcggcgtcagggtgtagcggaagctctgccccggatcgatcggggcctgggtcagatagggcacgccgtccatggcgttgtcgatccgcaggccatgccagtggaccacggtcgtctcggccaggttgttgaccacatcgacggtgaacggccggccgcggcgcatgcgcagcaccggcggcgggccgtcggtggcgaagctcatcatgtcgcgggtgaccgtgcccggcacgatcggatggtcgagcccgctcaccggcagggtcaggtcggcggcagccatgccccggcgggtgatcaggctggtgccggcggcgatggcgaggccggcggcgctgccgagcaggagttcgcggcgggtcacggccattgtcgactgccctttgtcatggaactaccgggccgatcctggcaggacctgcgcgagtttcaagccgccagccccgcgcaaatcgccgcagctgccgggtcgggctttgttgcgactgattctcaataaatgctagggtcgcggcaagtgattcctgtcctgccccgtcgacgggggctggaggtgtgcgcatgtcggtctcctcgttcagcatcgcggttgcggatggtgtcttccgcgctgatccgtcggccttgccgacagagacggtgctgcccggtctgaagctgggtcttgtcatgagcggtcgtttcggcctgacggtcgacggcggcagggatctcgacatcgccgggccggccatctgcctgctggtggccgagcgggccttcgagacccgccacggcatgacggcgcaggatggtgtgcgctacgtgaccatcgccctcgatcccacctctcgcgatgatctgctcggcagcgatgctgaacggctgggcgccggatccggcgcacccggcattcaccaggcccgggccgggcggacggcctgcgctttggccctgcagatcgcgacctgcccgttctcgggcggtgtcggccgggcctggcgagcggccaaagggctggaactggtcgcgacggttgcagccggcttccttgagaccgatggccggggtgcgcgcctgaccagccgcgatctggaacggttgcgagaggcatatcacatcctgaagaccgcgccggccgatgcgccgacgctgccggtgctggcaaggcgggtggggatgaatgtgcgcaagctgaccgacggcttccgtcgccagttcggcaccagcatcgccgatttcgtcgccgaggaacggttacatctggcttatcgcctgatatcgaccggcgagatgggggtcgccgaggcggcctatcgggtcggctacagccccaatcatctgtccaccgccttccgccgccgtttcggcatctcgcccgggcggctgcgctgatccggtcccgccgcccgtccgcggagatctgactcctgccatcgtaggcctccggcatttcggagaccggccacagatgcgattcattcgcaacatgacgcgcgccgtccgtctccgttcctgccgatatcagaggcctctctcatgccgctctcccgttccggctccgcccggctgtcgcccacgctcctgattgctgccgggctgctttcccaggcctcgccggtttttgccgccgatgcagaggatgccgagaccctgcccgcccttcaggtgcaggagacgcgccccgcgtcgtggaggccggccggcggtgtggtcgcccagaccgcgaccatcggcacaaagaccgatgccccgctgtccgagacgccgcaatcggtgtcggtggtgacccgcgaacagatggagatgcagcaggcccagagcctgggggaggcactgcgctacacgccgggcatcgtcaccggcctcgccaatgccgacaatcgatacgaccagctcaccatccgcggcttcaatgccaccacgctcggcctctatcgcgacgggctccggcagatgtcgaaccagatgaccacccggatcgagcccttcggcctggagcggatcgaggtgctgcgcggcccggcctcggtgctctatggtcaggcggcaccgggcgggctggtcaatgcgatcaccaagcgcccgaccgccgatccgctgcacatggtggaaatctcgggcgggagccacgatcggctgcaggcggccgtggatctgagcgggcggctggtggatgacggccgcgccctgttccggctgacggcccttgcccgcgacgccgatgcccagatcgaccataaccgcgacgaccggatctatgtcgccccggcgctgaccctgtcgcttggcgaggataccagcctcactttgctcgccagccgtcagcaggacgaggcgggaactccgggcccgctgcccgcctcgggcacggtgctgcccaacatgcacgggcggatcccgatgacccgctattccggtgatccgtcgctcaacgaattcgaccgtacccagaccgctttcggttgggctttcgagcatcgtttcgacgaccgctggcagctgcgtcagaacacccgctatgaccggctcgatttcgatcaggccaatgtctacgcctacaccccgcttgcgaccgacggcaccatggtcaaccggggcgcctatcgcttcggtgtcgatgcggatctcttcaacaccgacacccagctccaggcggactggcaggcggggccggcgtccgtcacctcgctctttggcctcgattaccgctacaacgccgaggatttctaccagttcatgggtgcggcaacgccgatcgacctctatgacccggtctatggtcaggcgatcgccaacccgtcgctgaaggtcacggacaacaccacccggatcgaccagatcggcgtctatacccaccagcagatccgcctgccccaggggctggtgctgagcctgggtggcaggcaggactgggcccgcagccgggtcaccaaccatatggacgatgacgcccgcaccagccagtcagatgatgccttcacctggcgggcgggggcggcctgggccttcgaggcgggcctgaccccttatgtctcctggtcgacctcgttctcgccggtctcgggcacggatgtcgatggccgggcgttccggccgtcggaggcggagcagctggaagtcggggccaaattccagcccgacggtttcgacagctttttcaccctggcctggttcgatctgacccagaccaatgtcgtcacggcgagcgccaccaacccggctgcccgttaccagatcggcgagattcgcagccgtggtatcgaagtgcaggcggtggccgagctgggcaggggggtcagcctgatcggcgcctacacctggcaggatcccgaagtgacccgcagcctgggcgccgatctgcataagaagcccaccggcatccccgatcatatggcgtcgctctggggcgactatacggttcagtccgggccgctggccgggctggggctgggggccggtgtccgctatgtgggcgaaagcgccggcgatgcccgcaacagcttcaccgtgcccgatgtcacgctcgtcgatcttggggtgcgctatcaggcgggcgactggcgggtggcggtgaatgccagcaatctcttcgaccgctattacgtcgccggctgctcgtccgaggccaattgcagcctgggctatgagcgcacggtcgtggccagcctgcgctacagctggtgacgccatgaccctcggaaccggtcgtcccttcgccttcctgatgatcgccgtcctctacatgacccagggcattccgctgggcctggcgatggaggcgctgccgggcttgctgcgccagcagggagcggcccttgacaggctcgccttcctgccgctggtcgggctgccctgggtgctgaaattcctctgggcgccgctggtcgacgaccggtggtcgccgcgcctcggccgtcggcggagctgggtgctgccgatgcagtcgctggtgctggcaaccctgctggccgtggtggcgacgggggtgtccgagaccgtctcgggctggctggtggcgggttttgcgcttgcctcgcttgccagcgccacccaggacaccgccaccgacgggcttgcggccgaacacttccagggccgcgatctggcccgagccaacggcattcaggtgggcgggaccatgatcggcttcttcttcggcggctccggcacgctggtgatggccggcatgatcggcctgaccggggcgcttctggtggtggccggggtggttgcggccgggctggtgctggccctgttctggcgggagggggtacccccgcagcctggggctgcgccgtacatgcgggccagtctcagggggttcgcggcgcggcccggcgcgctgcccctgctggcggtggcgctgctttccgccgtcaccgccagcgccggctttggtctgtggaagctgttcctgatcgatgccggctggacgatcgcggcggtcggccggctcggcatcgcggccggtgccgtcaccattctgctcggctgtggtggcggggcctggatggtggcgcgcctcggcgcctggcgggcgctgttcgtcgggcttggggcatcggggctggcggcactgatctgggcagcgcaggcggcgggtcttctgcccctcacgcccggaccgtcgcttctgtcgctgccttttctcgccgcctcgctcggtgccttcggggccggggcggcctcggtcgcggccatggccctggccatgcgcttcgccgccgccgccggccaggccggtaccgacatgacctcggtgcaaagcacccgggatctgggtgagatcggcacctcgtcggcgatcaccgcctttgccgccgccgctggctatggtgctgccttcctggcggtggccgttgcggccggtctcacgatcgcggccgtgctgcatgcccggcggtcggcggcgctgcgcctggccgaggccgggctcagggaggcgccgtgatgccccgccctgtccggccatcctggaggaagatctggctgcagctgcatctctggctggggctgaccatcggggcggtggcggccctgctgggggtgaccggtgccgcccttgtggtgaaggagccgtggctccgcctggaactgggggcgatggcaagaccggtcgatcctgccgcggcgcccctgccgcccgatcttcaggtacaggcggcccaggcgatcgcaaccgggccgcgtcgcctgctgtctgtcacggcccccggcagcgggccgatgccggtcgccaccgtgcttgccctgttgaccgaaccggccggcgaaggtggtccgcgctttcttgtcgcgaccttcgatcccgcgcgcggcgacctgctcggcatccgcccgttcggggatctcgccttcgcgcaggtgctggatctgcatcgggcgttggctggcggcccgaccggcgccgggctggtggcggtggtcggggtggtgctctgcctgtcgcttgcgacgggggcctgtctctggtggccacggcgaccggaaggcgggcggcggccgggtgcctggcgccgccggctgctgccgtcgctcgctgggccctggcatcggcagatcagggtgctgcacgtgaccgcaggcatctggctgctgctgccgctggcggtggtggcggtgaccggcacgctgcttgcgcgccccgatctgattggcgccgcgcggcgtggtctgccgctcgccgctgcggccccaccagcgccggacgatgcctgcgtagccgtgccggatgctgccaccgcggtgcgcctggggctcgccgcatcgcaaagcggtaccttcctgggtgtgatggcggccgggtcgggctggatggtcacgacgaccaccggcatgctcatggtcgacccgggtatgctcgatccgggctgtggcaccgtgacggcgatgccccgcggtccggatctgcacggggtcatgaacgcgctgcacggccggctgatgctgggatggcccgggcaggtggtggcctttctggccgggctcgccctgcccgtgttctatgtcacaggtctcgtcatctggctgcgccgccgacggtgaggcggtcgaccaggcggtccactgccgcctccgccgcgacgatcgaagttgcaaggcggtcgtcgccgaattcgtcgccctcgatcgccaccacatccaccgcgcccatgccgatatagcgcaacggggcggcgagaccgggcaccaccagctcgttatgggcctgaatgccgcccggctcatatcccaggtcgccgcgcgccgtcaggaccaccgcccgcttgcccgccggcagcatcggccaatagggcgtgtcgccgcgggcgcggtcgaagccgaaggtgacaccgacccgcacgatattgtcgatccaggccttcagcgctgacggcaggccgaaattgtacatcggcgccccgaagaccacgatgtcggcggcaaggagttccgccgtcagccggtcgctttcggcaagccgggcccgcatggcgtcgtcgcgcgcctcaggccgggtgaaggcagccctgacccagtcggcatcgacgggggccggtggcgcgaggccgacatcgcggcaggtgatttcatcgccggggcgatgctgccgccaccggtctgcgaaacgcgcggtcagccggcgggtgtgagagccatgagggtctgtgcccgagcggccggggcgggcgctggcatcgatttgcagcagccggatcatgatgcatctccttcatctgtggagtgtgaatgacatgaggattgccctgaatttcagcggctgacaaaatcgtatccctcagccgataatgaagatggattcatccatgcccccttcccgcaggctgccaccactccaggcgctcaagaccttcgaggcggcggcccgccatcagagcttccggctggccgcggccgagcttggtgtcacccccaccgccgtcagccatcagatccgcctgctggaagagacgctgggcctgcccctgttcgaacggcgggtacggcaggtggtcaccacccccgccggcgaccggctgtttcccgtactgcgcgacggcttcgacgccatggcggcggcggtggcggcgcttcgccccccggcgccgcggcgggcggtgacactgaccgcactcggcctgttcactgcgaagcggctgatcccggcactcggccggttccgggcgcggttccccgatcacgagcttcgcctgcacgcctcggatgatgtggtcgagcttggcaccggcattgccgatctggcggtgcgctacggccgggggccgttcccggggctcgtggccgaaaccctgatcaccgatcgcttcggcgtggtggcaagcccgcggctgggcctgcggtcgcccgaggatctggagaaggtgccgctgctcagggtcgactggcggcggcaggaacgcgtacccgactggcgggcctgggccggcgccgccggccggctggaacctgcaggcacggcggtgctcaccttcaccgacgatgcccatgccatccaggcggcgatcgccggccatggggcgctgatcgccagcctgaccctggtcgccgacgaccttgccgccggcctgttgacggcgcccttcggcccggaattgccgggggacggctatcacctgctgatcccggaagcggaacggtcggcaccggatgtgatcgcggtgcgcgactggctgcgggagatcgccgccgggagcgccgcatgaccgcatcatggccgaagctcactcttggccagctgcggttgctgctggcggcggtggagaccggcagcgtcggtgccgcggcccggcggctgggactgacccagtcgggcgcgtcgcaggcgcttgcggcactcgaaaaggggctcggcgtcgagctgctggtccgaacccgtggcggggtgactgcaaccgccatcgcagaggccctgctggccgatgctgccgatgcggttgccgccgtcgaccgcatcgcggctcgggcccgggcagcctcgggacgccctgagcgtcccttgcgcatcgccgcaatcccgagcattgccgagcgggcactgcccggctggtgccggcggttgcgacagcttgcccctaccctggtcaccggcgccttcgaaggtggccatggcgaggtgggagattgggttgcccgcggtctcgccgacatcgccgtcacctcggtggtgcccgaggggctgccttcggtcgcactccggcccgaggcgctgctggtggtggggcgccgagacgatccggatctgtggccggcatcgctgcctgttgccctcctggcccgccggccgctcgtgctggcggggggctgcgagccggtggtggaaccgctgcttggcggcggcgccgtgccgcggaccggcgatatcaccacggccggcctcgcgaccgcgctggaaatggtacgccagggacaggggttgaccctgttcgcggagacgtccttcccccgcggtgacatggacgggctgaccatccgacccttggatcctccggtcacccgcacgctgcatctggtgtttcgcgccgagaccgcggaggggggcgtcgtcgacctgctgctcagggtgctggaagacgagggatggcgggctgcaggtcataagccggactgatggccgctcatgcgtgcattccatgacgtcggcgcggcggctgggtgggatgatgcggtatcgaagaaaggcccgctcccatgcccctgcgtgacaccaccatgaccgggtccatccgtcggaccccggcctccgccgcgccgtccggttctgccgtcatcatcggcctcgcctgggggctgttgggggtgctggtgtggtccggttccttcatcctgacccgtttcggggtccgcacgagcctgggccccttcgacatcatcgcgctccgtttcatggtggccggcctgttgctggcgccggtgatcctgcgccgcgggctggcctggcggcggctcgggccgctcgggctcggactgctcgtcttgggcgggggcgcgccttatgccctgctttcggccgccgggctgcaatatgcgccggcggggcaggctgcggcgctgatcccggggctgatgaccgccgccgtggccctgatcggcatcagggcgctgggggaaccgctgacccggccgcgtatggccggcgtcgcggcggttctggcgggcagtatcaccatcgctgcggtttccgcggggccgggccagaccccgggtcatgcgatcttcctgtgtgcagccctggtctggacgggttatgtgatggtgctgcggcgttccgccattgatggtctgcacgccacggcgattgccgccgtggtctcggccgtctgctacctgccggtctacgctttgttcctgccctcggcgttcggcaccgcgccggtcgccgacatggcaatccaggcgatctatcagggggtgggggcgaccgttttcgggctttacgccttcaaccaggcggtccggcgtctgggggcggccggaggtgccgcgctgagtgcgttgatcccggtggtcaccatggcgcttgcggcccctctgctgggggaggtgccgggtccgatcgatctggtggcggcgcttctgatcaccgcgggcgtgctgctgctgaccgtcctgcgcgggtgccgccggctgggttgacctgcggcttgcggcttccttgaccgtcctgcgggggcgcccgatactctggccgggctactctcgccgggcattttctcccctccctgcggagagggggcgccctcgtgctgccagaaggaaggttctgccccgatgtgcgccgacgtcaccaccgcccctgtcccggcgcttgcgcccgaaccgcatgtccggtcgcgctatgccgcagacaatctggggcgcatgcgccggcggccgccgctggagggtgatctcagggtcgatctctgtgtcatcggcggcggactggcggggctgtcgacggcgatcgaggcggcggagcgcgggctcagcgtggcggtcgtggaggcgcggcgaatcggctggggggcctcagggcgcaatggcggccagctgctgaacggcttcgcggccggcaccgaccggctgatcgccaaggtgggggaagacaaggcccgcaccatgtggcggatgagcgtcgaggcgctggacctggtccgcgatcgcatctctcgtcatgaaatcgactgtgattttgccgagggtgttctgatggccgcgctgaagccccgccatatgcgggggctggaagcggagctggcccgcgagcgcgcctggggctatgaccggtcggagctgatccccgccgcccgtatcggcgagcatgtcggcagcccgcgctatatcggcggcatgctggaccgcggcgccggccatctcgatccgctggcctatgcgctcggtctggcgcgcgtggccgaagaggcgggggtccggatcttcgaggagacatcggccaccgcccttcaccggggcgcgccgccccgggtggagacgccgcatggcagcatcaccgccgatgcggtggtcgccgccgccaatcacgagaacgggcggctgatccccgaggtgcgctggaaggtgatgccggtcggcacctatgtactggcgaccgaaccgctggatccggcattggccgagcggctgctgcccggccgggtggcggtgtccgactgcaagttcgcgctcaactatttccgcctggccggcgaccgccggatgctgttcggcggccgggtcagctattcgactctggagccgctgaacctggacaccgcgatgcgccggaccatgatcggcatcttccccgatctggccgatgtgccgaccgccgaggtctggggcgggttcgtcgacatcacccatgaccgcacgccgcatttcgccgcggtgacgcccgagatcctggtgctgcaggggttttcaggccacggcctggccgccacggcgctggccgggcgtctggcggccgaggccgtgaccggtgatcgcagccgtttcgatctgttccacggcctgcgccacatcgattttcccggcggttgggcgcgcacccccctgctggtcgcgaccatggcatggttccggctccgcgacatgctgtaggccgcggcgccggaacccgtgacccgggatttgggacccgggattcggggcacttcactctgcggcaagcacggcgggccgcgttgcccgttcgcgccgggccaggacgatctggaccgtcatcaccagggccagcgccgccacggccgcaaccgtggacaggggctcgggcaggatcagcccgaaggccgcggctgccagcagcaaccgccagcccggatggagccggcggatcagccagccctgatcggccgccgccagcgccgtcaccgccaccaggcaggcgagggtggaagagaggatggtgagcggcgcctggtccacgatcagcacccccggatggtagaccatcaggaaggggatgatgaaaccggtcgcccccagccggaccgccgccatggcctgccgcatgggatgaacgcgcgagatcgaggcggccgagaaggccgacagcgccacgggcggtgtgatcgccgacatgatgccgaaatagaagatgaacagatgcgccgtgatcaccgacagcccgagctgggtgagggctggcaccacggtgaaggcgagcagcagataggcgggtgtcgtgggcaggccggtgccgagcaccagagaggcggccatggtggccagaagcgccatgaacaggtcgtcgccgccgaccgccagaaccagcttgctgaaggcgaggccgatgccggtcatgttgaccacggccaggatgatgccgacggcggcgcacatggcgagcaggcccagcccgtcgcgggccgcttcgatcaggacgcgcatgacgacccgcggccccatgcgcatcggcgcatgccagatgccgccgaggaagatcaccgcgataccggcaagacaggcataggcgggtgaatagcccgaggcgagcagggcgacgatgctgcctgccgatgcggcgaccgtcaggccctggatcacatccccccggtcgaccgggggcagttcggcggcggcacgggcatcggccgcttccatgccgccggcccgggccgcgaacaggaccctgagcgagatgctggcatagaacagcaggcagggcaggatcgaggcgatcacgatagtgacgtaggggatgccggtgatgtcggccatcaggaaggccacgatgcccatgacaggcggggtgatctggccgatggtcgaggcgcaggcttcgaccgcgccggcaaaggcggggcgatagccggcccggatcatgaagggaatggtgaacgagcccgtggcgagcacgtttgccgggcccgagccggacagggacccgaagcccatgctggcgacgacggcggcctgggcgggcccgccgggaacgcgccgggtggcgcgaccggcaagacggatgatcgagtcgccggcaccgctggcccgcaggacggcaccgtaaagcacgaagacatagatcatcgacgccatcaggccgagcgacgagcccaggatgccgccctggccgaacatctcttcaagtgccacttccagccggacgctggaatggtgcagcacgcccggcagccaggggcccgcccagacgaagcccatgaagccgaccaccagcagggccatgcccatgccgcaggcccggcgggtgatttccagcgtcacgatcagcgtggcgcagaacaccatcacgtcttcaggcagcggaaagcccatgcggtacgagaacatctcgaaccagtcgatgaacacatagaccatcgccgccagaatcgcggtcagaaaagcgagggtcagggcgcgatcggccaggcgaccggcccggccgctgcgccaggtggcgggcagtgtgggggtggaaaacaggatggccgcggcgccgagcagcagcaccgcaccgcgctgcacgggcagtggcagctcccccaacgcgatcgtcgccaggatgaagatcatgagggcgaggccgcaggcatcggcaaggccgcgggtggtccgcgtccagccgtcggaacgggccgccggcctgaggccggggccgtcggtaatgacgctcatcggatgtgtcctcgattctggtcgggaagacgcaacgacccgtgccggcccgccatgcgcctggtcaggccgccggccggtcggtcgagcttcttcgggatgcgtctgtggcgggcggcgggggcgcccgggaaatcagggcttcatgacgccggcttcgacatagaagcgcttggcgccgggatgaatgatgccgctggcgctccgcacggcctcgtcgagcgacatgatcgagagttcgcgcgaggcatgccgcacctcgtcgatgttctcccacagcgtcttgaccagccggtaggcgacatcgtcaggcatgtcgcgatggacgatgatctgcatgcgcgtcgtccagctcaccaccggcgcctcgggcttcagatggccgtcataggccgccgagatacgctccggggcaagcgtgaccagatcgtaataatccgcggccggaaaggtcttgcgccagctgtccatggcgaccggatccaggcccacataggcgaggtcgctctgcagcgccgccgaggcgacggccccctgcggcaggccgccccagagatagaccgcatcgatcatgccgttgcgcagctcgtccatggcggtcgagtattcaaggtattgcgccttaacctgacccttggccggatccagcccatgggcggccagaagggcgagattaaccgtgcccgagaagccgcccggcgtgccgaccgcaatggacttgtcccgaagatcggccagggtgcggatgcctgatccggcgcgcgtcagataatgtgcgacaccgctttccagcgtcagcagtacgcggacgtcgtcatagtatttcccgtcctcggccctgcccttgaacatgaacagcccgtcacgggcatagagcagatgcggtgaggcgatgatgccgatatcccaatctttgtcgacgacgccgcgcagcagcttcggcgtgccgccatgggccaccacttccatggtgatgcccgaccgggtcttgtcgagcagggtggaccaggtgacccccaacgcgtattcatccgacgtattgctgatggtcgcgaatttgacctcgaccgggtctgcggctgcggccggcccgatcggtgacaggccggctgccacccagacgcaaaaggccatcgttccggcagccgctttcagggcggctgccagtccgccgcgccatgcgcggcccgtgctcgtcgtcatctgcccctgttctcccctcttcgctccatcccacggagcgcgtcgatgcggatgcgggtccggctcgccttggcgtttctcgtatcggtatatgatacttcttataaatcgccttatacgttgtttttatatctttaattgaatccgttgcgcatatccatcccgaattacgcgaatccgggtggcgcaatgcggctgtctgccccgcggcacggcaccgtcgcatgccgtgaacaccgtgacgattcgggggccagtggtgcagtgattgacgcagggatgcgggctaaatacggtctccacagtcccggtcgtgccggttcaggcacggttccattcgtgtcgagcgagacgatgatgctgcgccttaccgccttcgcccgcctgctccggattgttccggctcttctggtctgcctgcttcttctgacgacgatcgccgtcgccccgctgcaggcccagaccctgcccggactgccctccacaggttccggctccgccgataccgccaccagcgacggtcaggcggaggtcgatgcgctgatcaagctgctcgagaacccggagggccgggagaagctgatcgagcgcctgaaggcggcggaaaccccggcggagcccgccgagggcgaggaacttgcagccgaactggtgatgcctttccttgacggtccggcgacggtgatcgccaaccgcctggatgcgctggggcgtgatctgcagaaggcggcggtcgcgctgtcgcatacgcccgacgagctggagcgtatcggccgcggccttgccaacgacaggaagcgggagcagtggattgagctgatcggccgtctggcggcggtggttgctgcgggctttctgctggaatggattgtaaaagcgctgctgtcgcgcccccgtcgccggctcgggaccaacccgccggcctcgcgctggcgccgggctgcacgcggtatctgcctgctgctgatcgatcttctgggtattgccggctttgcgggcggtgccgccgcggccaccgccctggtgcgcccgacgggcgacgctgcgatgatcgcgatcgccgtcgtgcaggccaatatcgccgtgcgcgcgatactggcggccgggcgcatggcgcttcgtccgcaggtgcgccggcttcggccgctgcccttctctgacgaaaccgccgcctatctctacatctggctgaagcgctttgcgcgcatcaccgtctatggctggttcctgtacgacgtcgcccggacgctcggggtctcgccgccggtgctgctggtcgcgtccaaggtcttcggcctgttcgtggccagcctggcggcggtggtggtgctgcagaaccgccgcgaggtcgccgatgtgatcgccggccgccggccgctccagttcggtgccgacgacgtgccgggcaccgaggcggcgatggccgatcccggcgacgggtcggcaccgctcggggtgacgccggcagaggcggatgtccggaccgccgacgacgacgttccgcccgatcttgccgccgccgccgccgaccgggcgcgcgaggtgacgcgtgcgggcatggcgaccctgcgcgcgcgtctcgccgatgtctggcatgtgctggcgctggcctatgtcgccattgcggccgggatctggctgctgggggtcgatggcggtttcaccttcctggcgcaggcgaccggcgccaccgtcctgatcctgctgctggaccgggtggcggtgatggcggcggaacggatgctggagcggctgttctcggtctcggacgagttcatcctgcgccatcccggcatcgaaacccgggtgaaccgctatctgtccatcacccgtaccgccatcgtcggcttcatccatgtctttgcggtgctggcgctgctcgaagtctgggggctgggcggtctggcctggctcgcctccgacgccggcgcccgggtggtgggggcgctggtcaagatcgtggtcttcgtggtcggtgccgcggtgatctgggaaatggtcgatggggccatttcgcggcgcctgcaatccgatggcgatcgcgcgcccaccacgcgcgccaagaccctgctgccgatgctgcgcaacgtggtcatgatcatcctgaccctggtggtggtgctgaccgtcttctcggaaatcggcatcgacatcgcgccgctgctggccggtgccggcgtcgtcggcctcgccatcggtttcggtgcccagacgctggtcaaggacttcatcaccggcgccttcatcctgttcgaagacacgatctcggttggcgacgtggtcaccgtcgccggccagaccggggcggtggaacgcatgaccgtgcgcaccatccgcctgcgcgacgtggagggtgtggtgcggaccgtgccgttcagcgccgtcgacatcgtccagaacctgaccaaggacttctcctacgccctgctggatatcagcgtcgcctatcgcgagaatgtgggcgaggtggccgagatgatgcgcgaggtcgggctggccatggggcacgatccggagttccgggatctgatccttcagccgatcgagattttcggcctcgaccgcttcggtgccagcgacgtggtcgtccgcggccggatcatgacgaagcccggccagcaatgggggatcaagcgcgccttctttgcccgcatcaagcaggtcttcgacgagcgcggcatcgagatccccttcccgcacaccacgctctatttcggcgtgggcaaggatggcaaggcgccggctgcgccggtgcaggtgctcaaggccgaaggctcctggcgctcgggtgcgacgggacatgcggcccccaagctgccggcggtggcaccagcggcagaggatcccgaggaccggcgcgacgttcgtgcggtacccggcgacgaagacagccgtcgcccgccgcggatcgacgaggagtcgggcgaagcgggtggcgactcccagccctcacgttgaggcctgggccggcgtgtacgacaggcgttcccgccccgctcttgcccctccggcccatggcgcttatcctccggcggccccatccggctcgtgaacggcctgaggcgggggcggcggcgcgtgccgtcgggtccggtggaagcgaggtgacgacatgggcgaaccgcgacagatgggggcggtcaactggcggggcttcgcgaccctctacttgcgcgaggtgcgccgcttcgtgaaggtggcgggccagaccctgaccgcaccggtggtgacgggtctgctgttcctcgcgatcttctcgctcgccctcggccgggcagtcgagacggtgggcgacgtgccctatctggaattcctggcgcccggcctgatcatgatgcaggtggtccagaacgccttcgcgaactcgtcttcgtcgctgatgatttcgaaggtacagggcaatatcgtcgacgtgctgatggcgccgctttcagccgtcgagatgacgctgggctatgcgctgggggcggtgacccgcggtgtgaccgtgggcatcgtcctcatcgcggcgatgagccccttcgtgcatttcgaattcgcccatccgggcttcgtgatctatcacctggtcgccgcctcggcgatgatggcgctgatcggtattctggtgggcgtctgggccgacaagttcgaccagatggcggcgatcaccaacttcgtgatcaccccgctttccttcctgtcgggcaccttctattcggtcgcgcgcctgcccgaaggctggagctttgcggcgcatctcaacccgtttttctatatgatcgacgggttccgctatggcatcaccggccatgccgatggctctgtgctggcgggcatggccgtgctggccggcgtcgacctggtgcttggcatcgcctgctggcgggcactggcccgcggctggaagctcaaggcctgatccggcggatcgtccgcgacggtcgtggccggcaggcctgccggatgcggccgtcttcggcgttgcgtcggcctcgttccgttccgtctctccaaccgtaatcggttccgcgatgtcctcatccactctggcgctcgtcgtgcggcatcccaagctgaaggccctctatggcctctggctgcggctgtgcgccggcggcagctttcccgccctcgacggcatgtcgccggccgacctcaggccctggctcgacaacatggccatcctgggtctggacgaaaccggtggttacgtctatcgctattacagccctgcttatgcatccgccttcggcggcgacctgaccggctgcaccctggcccggatcgcggccgatcgggcagccgtgcttgccgccgaatacgacgcggtgcgtgccgaccggctgccggtctcgcgggtgtacacggcgatgttcgacggcgagcagcagacctgggaacgtctggtgctgcccttcttcgatctcgacggcgaggtgagcaagctcctcgtcgccgcctacagggtggacgcatgaccgcacggcgcccctatacgctgcccgatctggacccgcgccgcgagcccgagcaggacaacgccatgccaccgcgtgccgaggaattcggcctgtggtgcgcgatgaccgaccgccccttccgtctgatcaagctggcgctggacgatagcggccaaccggaatgggcgatcgaagcccatcccggcaccgagcaggcggccgtcatctatgccaccggcaccgtcgacgaggcgcaggcgctggcggttgcctatggcttcctggcgggggtggaatggtcggaagcggcccttgccccggcgctggagcccgaggatggcgaagactggcccgacgaggcggaagccctcgccctggctttgtccgtgcccctggttctgccgccgccgctgatggaaggcgagttgctgacggccgaggtgatcccgggcgaagagccggtgttcgacttccaggcgctggccgccgccaatgaagccgatgccgaggcagaggtcgtcgatatggccgggcccgtcaccgaagagtccgtcaccgaagagtctgaggcggcacccgtcacagacgacgccggcgaggatgattccgacgcggatgcggtggggcctgccgacgccacagcggacgaagatgcggcgggggatgtctccgaagcgccggtccacgccgatccgcagctcgacgacgcctttgccgacgaggatgcagaggcggatcccctcgacgacatcctcgatgaggatctcgacgacgcggacgccgatgatgccgtcgaggccgaggctgtcgacgagaacgaggcggatgacgtagcggccgccgatgaaggggccggcgaggacgaggcagctgaggacggtgcaggcgacgacgagccggcgagctgggacgacacggaacaggatgccggctatgtcctgcccgccctcgctctgctggcgacatcggaagccgaggacgaccccgcgctcgacgagggtgtgctggccgacaagacccgcaagcttgaaaccgtgctcaggaacttccgggtgcggggcgagatcatggaggtccggcgcgggccgctggtgaccctgttcgagctggagccggtgcccggcaccaaatcctcgaccgtgatcaatctcgccgacgacatcgcccggtcgatgagcgccatcaccgcgcgtatcgccgtggtgcccggacgcagcgtgatcggtatcgaactgcccaacgagtcgcgtgcgaccgtctatctccgcgaaatcctggcctcgcccgcctatacccaggcgcatcaccgcctgccgctggcgctgggcaagaatatcggcggcgagccggtggtggtcgatctgacccgcatgccgcatctgctgatcgccggcaccaccggctcgggcaagtcggtcggcatcaatgccatgatcctgtcgctgctctaccggttgccgccggaacagtgccggctgatcatggtcgaccccaagatgctggaactgtcggtctatgacgagatcccgcatctgctgaccccggtcgtcaccgaccccaacaaggcggtcgccgcgctgaaatgggtcgtgcgcgagatggagagccgctaccgctccatgtcgcttttgggcgtgcgcaacatcgaaggctataacggccgggtggccgagcttgccgagcgcggcgagcaggtgacccgccgggtgcaggtcggctacgacaaggcgaagcaggagccgatcttcgaggagcagatcgtcgaccttgaacacctgccctatatcgtggtggtcgtcgacgagatggccgacctgatgctggtggcgggcaaggagatcgagaccctgatccagcggctggcccaaatggcccgcgccgccggcatccatctgatcatggccacccagcggccctcggtggacgtgatcaccggcaccatcaaggccaatttcccgacccggatttccttccaggtcaccagccgcatcgacagccgcaccatcctgggcgaagcgggggccgagcagcttctgggccagggcgacatgctgttcatggcggccggcgggcgcatcacccgcgtccacgggcccttcgtgagcgatcgcgaggtcgaggaggtggtcgagcatctgcgcggccagggccggcccgactatgtctacagcgtcaccgaagaggatgacggcgatggtccggtcgagggtctgccgtcggatgacgtcacccctgagggggaggatgacggcgacatcttcgcccaggcggtttcgctgatcctgcgcgaagacaaggtctcggtcagcttcatccagcgccatctgcagatcggctacaatcgtgccgcccggctggtggagcggatggagtccgaaggcatgatcagcccgcccgaccatgtcggccggcgccagatcctggtcaatgcccgcaactacttcgccgagcgtcgccagcagagctgagattcagggctttgcggggtagccccccggttccgggcttgaacgaccgatggaccgtcctaatctctcccctgacgggagagggcaggacggtccttgacgtttcaggcatatccgacgtgtcaggcacggtgtctcagccggaaaggtgcgcatcatgaccatcgccaggatcctggcggcagggatcgcggtgacggcagcggcgacgatcgcggcggtcgcagtgctaccggcctctgcgctgccgcgcagcaccggcggcgaggcatcgaaacatgcgacggcggaggcgaccggtatgacggcctatgatttttccctgccggccatcgatggcggcaccatcgacatggcggcctggcgcggccagccgctgctgatcgtcaacaccgcctcgctctgcggcttcacccggcagtatgaggggctggtgaagctctggcaggactatcgcgaccgtggcctggtggtggtcggtgtcccctcgggtgatttcggcggccaggaatacgacgaggccggtcgcaccaaagaattctgcaccgtcacctatggcgtcgatttcccgctggctgaaaagcagacggtgcgcggcagcgaggcgcatccgctgtttcgctggctgaccgcctcgctcggcgaggacgcggcgccgcgctggaatttccacaaatacctgatcgatgcccaggggcgggcggtgaagagctggccctcgcgggtggagccgaccgatcgtgagatcgtctcggcgatcgaagccgtcctgcctcagcggcaggccagactgaactgacccccgttcgggaggccgggtccccttcaggcgtccctgggcatcgtgccgcccgaaagtcgccgcgccgcaatccgcgcgaagcgcagggtcagcgccttgcggcgggcaggggcgagcggcgggcgtggtttcgcctcgcgcaggatcgccgcctcgaaggcgtcggccaggatcagcccctcgtcttcgggcaggatctgctgcggaaaatccggggcgacggcgaacaggaaacggtcggcccagtcggcatattccggccatttccggtcggtgcgaaaatccgcggcgccgctcttgatctcgatcagcgtgaactgccctctggcgtcgagcgccatcagatcggcccgccgacctgaggcgagcggaaattcggcgagcacggccatatccatcgcctcttccagcatccgcctggttccggcggccaccatggccgcgatgcccgcgaccgaattgccggcagcggggggcttcgcctcgtcgtccatcacaatctgtaggcctctgcaagtctgacggcggtttcgatcgcgagcgcatggcggcgtgccagggcctcgacatcctcgtcatagccgccacccagcaccgtggccaccggaatgccacgggcgagacaccggtcgagcacgagatgttctcgggcggccaggccgcgatcggtcagcgccagccggcccaaccggtcgtcccgatgcggatcgacccccgccagatagatgaccagatccggccggggcgcgtccagaagcccgggcagggcgtcttccagctgatcgagataggccgcgtcgccggtgccgtccggcagctcgatatcgatggtgctgcgggccttgcggaccgggaagttgcgggccccgtgcatggagaaggtcaccgcccagggctgatcctccagaatgcgggcggtgccgtcgccctgatgaacatccaggtcgatgatcaccacccgcccggcccgacccgtggcatgcgcgtgacaggcggccacggcgacgtcgttgaacacgcagaacccggcaccgaagcccgcatgggcatgatgactgccgccggcggtgttgctggcgatgccgcggtccagggctgcctcgaccgctgccaccgtgccgcccaccgaggccgtcgcccgcatcaccaccggcggggtgacgggcacgccgatgcggcggatcgccgtcggatccagccggcaggccagtacgtcggcgacgtaatcgggcgtatgggcccgctccagcagggcagcatccgcaggctcgggcacgacatggcgaaacctgtcggcgaacggcccgcggtccagatgcgccttcagggccgcgaacttgccgatcgggaaacgatgccgtggcgggaagggcacagtgtagcaggaatgatgcaccaagctcagactcattcgacgcaacccttgacctgaccccgtgtcgcgaaacattaaggatgctgtgacaatatgtggcgtcaatccggtccgcccatcatggatcgtaaaacggccgcaggagttgagcgacggaaggcacgcccgaggccgcccgtcgcgaagcccgatcggccggaacggcgccggttgcctgtttttcccggccggtttcgggagtattctcgaagccgcgccttcgtgcgaagcctgccgccattcccctcgccgggcggcgtggagaaggtgcaggctcgcgaagcacagcgggggttgcatgatctccgaatggcagcgtgagctgcggtgcccgaccgtctgaaatccggccggataccggaaatcacgcgccagaagccctgatgcaggccgtgttctatggtgggcatcaagggtgacgaaaaagccacgacgatgactcgggcatcatctgccgtattcgataggatgcccggcaaccaccccaacggcttcaccaaggagggtaatccataatgaacgcgctgaaccgcattgccgtggtcggcctcgttgccggcagcatctctgcctgcggtctgatcgaccccgacagcatcgcgcagacccccgccccggccgatccgttcctggcggcgctgtcggacgagtatctggcgctggcccgcgccgagcgcgccgagttcgactgggtcgacggcgacgtcttcgcgcagaagggcgagtgggcccgcgagggcaccatggtgccgccggagcagctctccgactggtacctgccggccgcctcggttccggccctgtcctcggcccgtcagcgtctgatgactcagctgaacggcggcgccacctcggccaagccggttgcggccgccaaggcccaggccggcttcgactgctgggtccaggagcaggaagagaaccatcagcccgaggacatcgcggcctgccgcaagatgttcgaggatgcgatggccgagctcgaggccaaggccgccccggcgccgcagccggtcgccgtcgtgaagccggtcgagttccagatcttcttcccgtgggacagcgcccagctgcacggccaggcctatgacatcatccgtgatgccgcccaggcctataaggagcgcaagtcggtcgcgctgcgtctcgacgcgcacaccgaccgttcgggcccgatcccgtacaacgaccgcctgtcgacccgccgcgccgagtcggtgaccgccgagctggtgaagctgggcgtgccgcgcaacgcgatcaccgccgtcgcccatggcgagcgtgacgtgccggtgccgaccgccgacggcgtgcgcgagcagcgcaaccgcgtcgtgatcatccgtctggcgcagtgatcccggcggatcctgaccgacgccggcccgggtgaccgggccggagatcgcgaagacgacagaaagggtggatccgctccggcgggtccacccttttttcgtcgggtgacgtaggcctgcgggtttcacggtgcgggtgcagccattcgggccgtgacatgttctgtcaccggacaaccgggccgggatgaggcatggtgggctcggaacatctgacagaccgtatcctggtccccggggagagaggcgcggatgatgaagaagatcctgattgcagctggggcgctggtggtcgtgctggccggcgccgcgatcgcggcccccttcctgatcccgactgaggcgatcgtgcagcgggtcaccgccgaggtggaggcccgcaccgggcgcaagctggtgatcgagggagatgtcgggctgaacgttctgcccgatcttgcggtccgggtggacggcgcccgcttcgccaatgccccctggtcggatgccggcgacatggcgcgtatcggccagttgcaggttgaactcgccctctggccgctgctgtcgggcgatgttcaggtgcggcgtttcgtgctggacgagccggtgatccggctggagcgtaacgccgatggcgcggccaactggcagatccatgcgggcggacagacgagcacgggcaccctgacgccggcggcacccgcggccggcgggtcggccccggctgcgccggctgcaacgccgtcttccggtggcgggctctcgggtctcagtctcggcgaggtgaagatcaccaacggcacggtcatctataccgatgccatgagcggcaccgacgagcggctcgacgatgtgaacctgacccttgccgcccccgatctcgagagcagcctgacgcttgcgggcgatgccagctggcgggatcagccggtgacgatctcggccgaagcggggcagacccgggcggtgcttgaaggcggcaaaacccccgtcagcctggatctcggcctgggtgagggcaagatccatctcgccggcgatgccaatcttggtgcctcgccgggcttcaacgggacggccgggctgtcgctgccggatctccggtcgatcattgctgccgcggcccccgggccggccctgccggatggcgtcgccacccggttgaacctcgacggccggatcgacgccacggcgacgcgggtcgcattcaccgacatgaaactgggcgtcgacgatatcgaggccacgggctccctctcggccgatatcgcagggccgcgcccgaagatcaccgccggcctgaccaccggcgatctggtgcttgatcgctatatcgcaggcggatcggagcccggtgccgggaacggcgcggccgggacggacaaggccgcgggcggctggagcgacgatccgatcgatctctccgccctggggctgctcgatgccgatgtcacgctgaatgcgacctcggtcagcctcggcgatacgaagctgggggcgaccgaactccgcctggccatcgatgaccggcgggcgcggatcgaggtgccgaagaccacgctttatggcggcagcggttcggcgacgatcggccttgatggccgggcggcgcctgcgtcgatgagcgtcaaggcgaccttcagcggtctcgacatgctgccgctgctgaaggcggcagccgatttcgaccgtctggaaggcaagggccggctggaggccgatctgacggcgcgcggcaacagccagcgtgccctgatcgggtcgctcggcggcaaggggctgttcgaattcaccgacggcgcgatccgcggcatcaacatcgcggcgctgatccgtgatccgaccggcgccctgcgcggtgatacggctgatgcgcgcaagaccgatttcgcccgccttgccggaacctacaccctcgacaagggcatcctgaccaatcgcgacgccgaaatgcaggcgccgctgctgcgggtcggcgggcaggggacggtcgatctgccggcgcggcgggtcgattatcgcatcgagcccaaggccgtggccaatctggaaggccagggcggacagaccgggctctccggcgtgatggtgccggttctggttcagggcccctgggacaacctgtcgttccggcccgatctggaagggacggtcaagcgcacgctcgaagatcccgacgccacgcgcaaggcgctcgacgacgtccgctcgggcaatttcggcgatgcgctgaaggggcttctggggcgctgagatcgtcccgggcgcgggccgtaaggatcgcgcaagccgtgggtaagtggggtgaaagcccgcatgggtaggctgatgacgtggcgcgggacggtgccgtccgtgccgccacatcggatcagcttccccactgccctctggagcctctccccatgtcgtttgcccgtctgtttgccgccgtcgcggcccccgccgccgttctgaccgtcctggccgcgccggccctggccagcacgacctgcaccagcgcccccaaggataagtggatgtccgaagaccagatgaaggcgaagatcgccgaaatgggctacaaggatatccgcaccttcaagaccaccaagggcaattgctacgagatctacggccacgacaaggaaggccggaaggccgaggtctatttcgacccgaccgacggccatatcgtgaagcaggagatcgattgagccatggctgcggggatcgaggcggccgcgcggccgggcgggcccggggtccgggtctgggatccggtcgtgcgtgccttccactggattacggtcgtgggctgcgtgctcgatctgggtctgcttgaagaaggcgaaggtccgcatcgtctggtcggctatgtgctggcggcggtgctggccatacggatcctctgggggttcgtgggcacgcgtcatgcgcgcttcgccgacttcatccccgcgccgcgccggttgaccggctattttcgcgaccttctggctggccgagcccgagactatgtcgggcacaatccggcgggtgcggtcatgatgctggcgctgatggccctgctggtcgtggtcacggtgacgggcatcatgacgaccaccgataccttctggggcgtcgagtgggtggaagggctgcatgaggccgcggccgaggcgatcatcccgctcgccctggtccatgcggcggttgcgatcctggagagcctgttcggccgggtcaatctggtcgcagccatggtcaccggccgcaagcgctggcgacgctgagccgctccgcccggctgcccctatctgctgtcgccgcaccgccgcgcctcgcgcggcggtgcggttttttcggcagggggcgtctggaaaggcgggatcgcatgcactgccgtcagcggcactttgcggccggtggcgacggcgctaggctgtcggcccacccttgccggtggcagatcgcccgtgcccggagccgcccttcatgaccgaagtcgacatcgcccctgatattggcgtcagcctccagctcgtggttgcgaccgcagcgatcctcggcaatatcgcactgcatacaattgcgaccgttgcagtgatcgccgggctccggcgcttcgagccgacgatgtcgaaacttctgggcgatgcctttattgcggttccgatgatggttgcggccgccaccctcggcatgctggtcgcccataccatcgagatctggggttgggcggtgatgctgctctggctgggcgagttctcgaacctcgaatccgcactctatttctcggtggtgaccttcagcacgcttggctatggcgatatcgtgctcgaccaccagtggcggctgctgggggcgatggcctcggtcaacggtatcatcctgttcggctggaccaccgccgtggtggtggcggtgctgaccagcgcgatcgagcgccatgacgagcgccggtcggcgcgcaaggcgcgagagggccagcccgaggggcatcatgcctggcagccctggcatccgcatgccccgtggcggccgcatattcaggaggtgcgccaccgcgccgaccatatctcagatcataacgccggcgcgggcgactgatcgggaccccgcgctcagggtaccggcggcgggttgcgggcggccatggtccgctgctgatgccaatagggatagggtgggctgacggcgctggcggcgtcgaggcgggcgatctggtcggtgtcgagcatgatctcaccggccgtcagattggccgccagctgttccggcgtgcgggcgccgatcaccagcccggaaattcccggccggcccagcagccaggcgagggcgaggcggggaatgctgtgccccgtctcggctgccagggcctcgagcacatcggtgatcgcatagagccgttcgtccggtacctgccagctggcatcggtcgcggcccggctgtcggccggtgccgggcggttgcggccgacacggcccgagagccgggccccgccgagggggctccagaccagggtgccgaccttctggtcgagcccgagcggcatcagctcccattcggcatcccgggcgacgagggaatagtagacctggtgcgccaccggccgtggcagacccaggcggtcggccgccgccagcatcttcatcaggtgccagccggaatagttcgagaccccggcatagcggatcttgccgtcgcggatcagcgtgtccagcgcatgcagcatctcgtcgaccggtgtcaccgcatcgaaagcgtgaagctggtagaggtcgatccggtcagtgccgagccgcttcaggctcgcctcgcaggaggcgatgatccggctgcgcgaggtgccgagatcattggggccgggccccagcgccatgccggtcttggtcgcgatcagcagctggtcgcgcctgccgcggatcgcctgccccaggatttcttccgaccggccgagcgagtagctgtcggcggtgtcgaacatggtgcagccggcatccagcgccagatcgaccagccgggtggcctccgccacccccgtctccccccatttgcggaagaaatcggtgccgccgccgaaggtggcggtgcccaggatcagcgccgggaccttcagccccgaaccgccgagcgtgcggtattccatggatcgtcctccccggttgcggtctgccgcgcaaggcggcagacccgcagcagagcggaagcggacggtcgggtcacccccaaatcggccggggggcagcctgagcggaattcaacctggtgggcgatcagccctggcgcagccgcgccaccagcccctcggccccggccgtgacctgggcccaggtgaggtcgaagcctgcatcggcgccgtaatagggatcggccaccgcctgccccagccggccggggacatgatccagcatcagcgacagctctgccgtggccccggcgggggccagtcggcgcagcgcctccagattctcgtgatccatggcgaccagatgggtgaagcgggtgaagtcggatcccttcacctgacgggcacgatagccgctgatatcgatgccgtgacgggcggccacggcccgggcccgtccgtcgggcatctcgcccgcatgccagccgccgatgccggctgagtcgatcaccacctccagctccgccgccgcggccgcccggcgcatcgcggcttcggcaaggggggagcggcagatattccccaggcagacaaacagaatggcgggcggcgtggtggccatgatcggattccggtgacggtggctggcatgaggctttctctgccgcattgcggcgaaaggagcaagtctccgccttgtgatgccgcgcccgcagccttaccaatagatggaggcggtggcggatggcacgaccccgcggaagagcagggagcagggtgtgagcgacgacgacggcatgacgcgcggtcccgccagggcggccaacggcaacgggtccgatgcagctctgaaggacgatatccgcttcctcggccggatcctgggcgacatcgtccgcctcaacgagggggcggaggtcttcgatctggtggagcggatccgccagacatcgatccgcttccatcgcgacgaggatcgtgccgcgcatgacgaactcgatgcgctgctcggcggcatggacacggtgcaggggctgaagatcgtccgtgccttcagctatttctcccatctcgccaacatcgccgaggatcaggaccggttgcgccagtcgcgcgccggcatgcccgacggcgacggtccggcggccggaacgctcgactatgcgatggcgcgcgcggcgaccgacgggctcgatcccgaccggctcgcggcctttttcgacaccgcgcgggtggggccggtgctgaccgcccatccgaccgaggtgcgccgcaagagcacgctgacgcgcgaggcggaaatcgcccgcctgctcgaccgtcgcgaccgcgagcggccgcagggcgaagaggcggcggcgatcgaggaagaggtcacccgcgcggtgctcaccctctggcagactgccatgctgcgccgcacccgcctgaccgtgatcgacgaagtggtcaacgggctcagctattacgacgagaccttcctgaccgaggtgccggccgttcacgcccgggtggaagacatgctcgcccgccgcgccggcagcaccgccgaggcgcgggcgggtgtcgcctcgttcctgaagatgggcagctggatcggcggcgaccgcgacggcaacccgttcgtgaccgccgacgtgttgcgcacgaccatgcggctgcacacccgccaggcgatgaaattctatcttgccgaattgcacgaacttggggccgaactctcgctgtcggcgacgctggtgccggtgagcgacgatctggcggcactggctgcggcctcgccggtgacgcccgagcatcagcgccaggaaccctatcgcctggcggtggccggcattcatgcccggatggcggcgacggctgaggcgctcgacgcggccgatgcggtgacccgcccggtgcccgcggcgccgcgctatgccgatccggccggacttgcccgggatctcgacgtcgttcatgagagcctggtggccaatggctcggttctgctcgcccgcggccggctgcggcgtctgaggcgggcggtcgactgtttcggcttccatctggcggtgctcgatctgcgccagaattcggcggtgcatgagcgcacggtggccgaactgctggaggtggccgctcccggcaccgactatctgtcgctggacgaagaggcacgcatcgcggttctggagcgcgagcttgcgaccacccggccgctggtgtcgcccttcgcaaaatattgcgaagagaccacggccgaattcgcaatcttcgcagaggcggcggcgacccatcgtcgcctcgggccccaggcgatcgagaacgtgatcatctcgaagaccgacggggcctcggacctgctggaactggcgctgctgctgaaggaggtcgggctggtgcggcccgacggaaccgccgcggtgaatatcgtaccgctgttcgaaaccatcgccgacctcagggccgcgccccagatcatgcggcgggtctttgcctgcccggcctatcgccgtctcgtcgcctcgcgcggcgagatgcaggaggtcatgctgggatattccgacagcaacaaggatggcggcttcgtcacctcgcgctgggaactctacaaggcggagacggagctggtcgcctgcttccgcgaggccggggtggcgctgcgcctgttccacgggcgcggcggctcggtcggccggggcggcggatcggcctatgacgcgatcctggcccagccggccggcgctgtgggcggccggatccgggtcaccgaacagggcgagatcatctccagcaaatacgccaatccgggcctcggccggcgcaacctcgaaaccttcgtcgccgccacgctggaagcgagccttctgccgcagccggcctgcgccgacctcgaggccgacatggcggcgatggaagagctgtccgacaccgcctttaccgcctatcgggccctcgtctacgaaacgcccggctttgaagactatttctgggcctcgaccgtcatcaccgagatcgcctcgctcaatatcggcagtcgtccggcctcgcgcagccgcacgcggcggatcgaggatctgcgggcgatcccctgggtgttctcgtggtcgcagtgtcgggcgatgctgcccggctggtacgggttcggggcggcggtgaccgcctggcgtgaccgtcatggcgaggcagggctcgaccggttgcggcgcatgtatcgcgactggcccttcttcaccacgctgctgtcgaacatggagatggtgctggccaagaccagtatggcgatcgcatcccgctatgccgaactggtgcccgacgaggcgctgcgcgaagcggtgttcggccggatccgtgccgaatggcagtcgtccgaggcggcacttctggcgatcaccggccagacgatggtgctggagcggacgccgcagctggcgcggtcgatccgcgaccgcttcccctatctggatccgctgaaccatgttcaggtcgaaatgctgcgccagcaccggtcggaggcgggcagcgaccgccatctctccggcatccatctcaccatcaacgggatctcggccgggctgcgcaacagtggctgaccccgcagatccggggaggcatgtctccggtgcatgacatcgacaccgcgctgctgcgcagtttcgtttctctggcggaaacgcgcagtttttcccgcaccgccgaacgggtcggacggtcgcagtcggccgtcagcacccagatccgcaagctggaggatctggtcggttgcaccctgttcgaccgggacaagcgcaatgtccgcctgacccgcgagggcgaggtgctgctgggctatgcccgccagatgatccggctgtcggatacgatgctcgaccggttccgcacgcccgagatcgcgggcgaggtccgcttcggctcgcccgaagacttcgccacgcgctatctgcccgagatcctggcggccttcgcggccgcccatccccgcatccggctggatgtgaactgcgatctgaccctgcatctgatcgacggcctgaaggccgggcgctacgacctgatcgtcatcaagcaggatccggacgatctgcatgccgacagcatccggctctggcgggaacatctggtctgggtcggggggccggagatgagccccgagaccccctttgccgaggtggccgaggcggcatccgccgacccgttgccgctggtattgtcgccgccgccctgcgtctaccgggcgcgtgcgacccgcgcgctggccgaaatcggcctgccctggacggtggcctattccagcccgagttttgcaggcgcggttgcggcggtgaaggccgggctgggcttcaccgtgctgccccggaccatggtgcctgaagggctggtcgggttcgatgcccgccgtggctggccggcgctcagcgatgccgagatctgcctgctgtcggtgccgcggccggatcccgccaccgatgcccttgccggtttcatccgcgatcgggtccagacttatcgataaaagtgataagattgattagataaatccgtttcacggatttttctgcatatgcgaaaagcggccacgtccccacgcaacggaggtgtccgcagatgaccggttttcagacagcgatccgcagcgctcagcccctgccgcaggcttccggccgtcgcccggggcttcgccatctgaccggcgcggccgcgctggcggcagcggctgcgcttgtggcgctgccggtcggcgacggcattaccctcggcccgctcaccatcgacagggcggcgctcttcctggccacggccgtgctgggcctgtccgccctggtacagggcttcgcctggcgctacatggacggtgatcgcgaccgtcgcggcttcgatctccggctcggcatcctgacgcttgccgctctggccctggccgcctcggaccatatgctcgccttcctggtcgcctggtcggtcgtggcactggtgctgccgcgggcaatcggccatgtccggggctgggcggccgccgatgccgccgcctcccttgcgcgccgcagcctgatcggcggcacggtgcttctggggggcggcctgcttctgctctggctggccaccggtgcagaccgcttctcggcgcttgcggcggggctgccggcggcggatccgatgatggtcacccttgcggctctcggattcgtggccgtggtcgtggtgcagtgcgccctgccgcccgcccatggctggctgatggcctcgatgaccgcgcccacccccgtctccgccttcatgcatgcgggcctggtcaatgccggcggcatcctgatgctgcggaccctgccggtctttgaagcggtgccggcggcaaccgtcgcggccttcgccatgggcagcctcgcgatgttgatcgggactgccgcgtcccgggcacaggcgggtgtgaagcgggggctggctgcctctaccagcgcgcagatgggctatatgacggtccaggccgcactgggcttccccggcgccgctcttgcccatctggttctgcacgggctctacaaggcgagcctcttcctgggggcgggctcggcgctggccggtgcccatgcaccccgggcgtcggtgccggtgacggcgtcccgcctgatgttcgcctggcctgcggccatcgccgcaggcgccggcttcgccctggtgaccggcaagctcgacgccacgcttgggggccgggtcgataccggcgccatcctggtggcgatcgcgggcctggccgggctgcagcttgcaaccggtgtgctgcgcaccggcgcccggaccatggtggtgctgctggcgctgccggtggcggccctgatcgccggcggtctctacggcgccgtcattctgatcgtcgatgccctgacgggcgtcgcggcggcaccgcagccgctcgccctgtatcaccttctgctgccggtggcgctgctcatgggctggggcggaatcgccctcggcctcgatcgccgggccgccgctgcctggaccttcttcgccacggcggcacggcccgccgctgccaccacctcctccgtcacgaagggtgcttcccatgcctgagaccgcacggctcctggccgagatcgaagccgctgccgcctgcatcgctccctggcggcccctccacaccatgattgccatcaacccccttcaggggcttgaggatctgcccttcgaggcggcgaccgccgaggcggcccggctgttcggcggccggccctggcccgatgccgggatggtggccccggccctggcggatggccgcatctccaccaccatgctgacggttgcggcattgcgccacggccggcccgagctggccgatcccgaccggttgatcaaggccctgcggcacgaggtcgtgcccggccggcaggcggccatcggcgccgccgcagacctcgaccggctgaccggcttctggcttgctgccttcctcgaccaggggcaggcgacatgggcgatgccggatcgggagctgggcttctaccgggcctggcggcggctggcgcgccatgatcgggcgatccccgaccggcgccggatcgaccggctgccggacgatccggcggtgctggttcaccagcggctgggcgggctggacgcagccacccgggaagacatcatccgggcccatctggtcgccctgccgggctgggttgcgcatctgcgctggcgggtggccgaaggggggcatcatccctggaacgccgtcgcccctgcctctctgctcgactatgtggccgtgcggctggcgctcgcggatctgctgggggtgaccctgccgccggtcgcggcaccggccgggcccgcggacaggcggctgcgcgcaccggccggtctggtggcgctggaagcctgggaggaaagccatcgccagcggctgctgacgatgctgacctccaccccgcccgccgcggatgctggcggttcggcgcagcccctcggtcagatcgttctctgcatcgacgtgcgctcggaagtgctgcggcggcatctggaggcgacgggcccctgggcgacgctcggcttcgccggcttcttcggcgtcccggtcgcggtgcggcccttcggcgaggatgacccccatgcctcctgcccggtgctgctccggccccgtcatctggtcgacgaacacccgctgcccgaggcggcggatctggcggtgcggcaccttgccggccggcggcggctgggcgggctgaagtccctggtcaaggagctgaaggcgggcgttgccggcagcttcggctatatcgaggcgacgggccttgtccatggtgcggccatgatgctgcgcacgctgaccccccggctggcggagcggctgtcgaccggcttcggccgggccgtcatgcccgaggtgccggtggcgccgggcctggatctgcatcacgatcatgatcacgaccatgatcatcaccaccaccatggcgacgcggaggatctgatcctggggctgtcgcccgccgagcaggccttcttcgccgagggggcactgcgggtgatgggcctgaccaagggcttcgccgagctggtggtcttctgcggtcatggcggtcatacggtcaacaacgtcttcgcctcgggcctcgattgcggtgcctgcggcggcaatcggggcgggcccaacgcccggatcctggcggcgctgctgaatgcgccggcggtgcgggcggcgctggcggagcggggcatcgtgatccccgagatcacccgcttcctgtcggcagagcacgacaccaccaccgatcgggtcgcgctcgatcccgatccggtggcggcgtcccggcagagcttccggcggctccaggccgatctggaccgggcgcggcgggcggcggctgccgagcgggtgtcgcacctgaccggtgccgatgcggtcgatccggtccgggcggtggaaaagcgggctgccgactggtccgaagtgcggcccgaatgggcgctggccggcaatgccgccttcatcgtcggcgatcgggcgctcacccgccatctcgaccttggcgggcggaccttcctgcattcttatgactggcaggcggatgccgacggccggctcctggaagtgatcctgaccgcaccgatggtggtcgcggagtggatcaacacccagtatctgttctcgacgctcgacaacgacacctggggggcagggtcgaagaccatccacgatccggtggcgggtctcggcgtgctgaagggcaatggtcccgatctcgccgtcggtctgccgctccagtcggtgatggtggcggacggccagatccggcacgagccgcttcggttgatggccgtggtccaggcgccgcgtacccgggtggaggcggccatcgaacgccatgccgtgctctccaccctgttcgacaatggctgggtcgcgctcgcggtgctcgatcccgaaaccggatgcagctggcggcgcgaccgcagcggcacctggattgaggcgctgcccgaacaggcgcccgaggtgatgtccgagaccggtgcccttgcctccgcaaccccgattccggcctgaaccgatttctgatccggccccgatccgatcccgaggagacgtacccatgaccgacgcagccgcttccgatcagatcctgttccacccgctcaagaagatcgagatcatcgtcatcggtgagaccgagccctttgtccggcgcctgctcgacgactcgggcgtctccggctacaccctcatccgcgacgtcgccggcaaggggcatcaccgcttccaggaggggcggctgctgttcaacgaccaggccagcctggtgatgctgctcgccgtggcgcctgagaatgccatccgtcggatcgccgccggcctggcgccgctcttccgcaaacagtcgggggtgatgttcatctcggatgtgcaggtggtgcgcctggagcacttcacccggcccgaggccggatgattctcgcgaccagcggcgatgaggccggtcgacagccaaagcatggacgtgcacgtggcccccgggccacgtgcacgtgtgcgttcgtcgtgggccgatctgtcggtatcggtcgcggcagggtcagttggcgacggcgcgcagccgtgccccggttgagccgcgcaggatcggccggcccgagagcaccatcttgcgggcggggccccccggacgctgcagccggtcgaagagcagcgacatcgccgtggtgccgatttcgtgcaccggctgttcgatgacggtcaggccggggccgaccaggccggtccaggtctcgttgtcgaaaccggcaaccgccagatcgtggggcatgctgagccccagccggcggacggcacgggcgacgcccaggagaagctggccgttgctggcgatcagcgcatcggggcgatcggccgactgcatccagtccagcagctccgcctcgcccgcatccgcggtgggcggaacgaaacgggcgggggcgggcagaccgcgggtggcgagggccgcggcgaaaccggcatggcgttcgatgccggtggtgctggtgttgccgaacaggccgccgatgcggcgatagccctgttccatcagatgcgagaccagggtgtgggcggcggcggcattgtcgagcaccacggcatcgtgcaggcccggggggccgacgcgatcgatcagcaccgccgggaagtcgagcgcggtctgcgacagggcctcggccgaggtgcgggtgggtgcgaagatcagcccggtcacccgttcctcctgcatgaggcgcagatacatcgcctctttctcagggttctcgtcggtgttgcacaggatgacccgcatgccggcctcgtaggcggcatcttccaccgcccggctgaccgcggtgaagaaggggttgcggatgtcggacacgatcagtccgatcgtccggctgtgctgcgatcgcagccgtcgggccgacagattggggcgatagccggtggcgcggatcgccgcatcgaccttgtcgcgcagctgtgcgctgaccgggccgccggtcaatgcccgggagacggttgcgaccgagaccccggcttcgcgggcgacatccttaattctggccttgagcgtggacatagcctgaaatcgttttcagttccgtagatcggattttcgcccatcggctggcggaatgcaagcatttgctgcggtgcagcatatgtgtgaaagggtgctgtcttgacagtgtttgtgtaatcgatttcaattcaccccgaggtgccgttcggcacgaaaattccgcacgccccaagccggccccgcgggccgcccgggggcgtgcctgtcgacacgcccggtggccccgacaacaggggcggacccagacggccgggcaggggaggaagaccagacgatgacgccagcccccgagctcttcgcgccgccggccgacggcgccgccgccatccgccgcgatctcatccggctgggggccgtccctgccgacaaggcgacagccatccgcgaggcggcgcagatgctggtggccgccggcgtctgcgcaccggcctatgtcgacagcatgttgaagcgcgaggcggtggcgaacaccttcctcggcgccggcgtggccatcccccatggcatggtcgacgaccgcgcgctggtccatggcaatgcggtggcggtgctgcaggtgccggcgggcgtgacctggaatgacggccagaccgcccgcctggtggtggcgatcgccgccagatccgatgcccatatcgcgatcctccgtcgcctgacccggctgctgaacgacgaggcgcggctggccgaactcacccgcaccagccgtgccgaagacatcatccgggcgctgtcgggcgaagatctgcccgcggctgcggcgggagaggcgaccgatttcgccgaaggcttcgactgggcggtcgactacccgaccggccttcatgcccgtcccgcctctgtctgggccgatacggcccggcggttccaggcccggatccgtatccgccatggcggcgaggcggcggacgccaaaaacatgatcccgctgctccagcttggtctgaagcagggcgacagcgtccgggtttctgccgaaggggccgatgccgcccgggcgctgcagcagatgaaggcggtgatggatcgcctggggcaggaggagcgggcggcagccggccgagcggccgagcgggccgccgcgccggtcgccggctggaccccgcccgccgatgccgggctggtgccggtggccggcctgcctgctgcgcccggcatcgccatcggccgggtccatgtgctggcgtccgggccgatcacggtcccggatcggccggtttcgctgatcgagggcggcgatgccctccacggtgcattgcagctgacccgcgagcagctcaaggttctggccgacgatacctcccgccggctgggggctgcggaagcgaagatcttcgaggcccaggctgagctgctgaacgatgccgatctggtgacccttgcctgccagctgatggtcgaaggccatggcgtcgcctggtcgtggcacgaggcggtggagcggctggccgggcggctggcggcctccgacaatccggtcctcgccgcccgggccgcggatctgcgcgatgtcggccggcgggtgctgctgcggatcgagccgggcctcgcccagggcggcatcggtgacctgcccgaggggcctgtgatcctgctggccaccgatctgtcgccctccgacacggccgggctggatacggggaaagtgatcggcctcgccaccgcccagggcggccccacctctcataccgcgattctggcgcgcacgctggggctgccggcgatggtggccggaggcggtgcgctgctcgacattacccccggcacccaggtgatcctggatggtcaggccgggcggctctatgtcgagccgtcggatgcggcgctcgcctccgcccgcgcctgggccgacgagcaggcggccctgcgggcgcgggcggcggaggaacggggtctgccggcccggaccaccgacggccataccgtcgagatcggggccaatgtcaaccggcccgatcaggtgccgctggcactcgatcagggggccgagggcgtcggcctgatgcggacggaattcctgttcctggaacgcgaccgcacgccggatgaggacgagcagtacgccttctaccgcgacatggcggcggcgctcgacggccggccgctgatcgtgcgggcgctcgatatcggcggcgacaagcaggtggcgcatctgcatctgccgcatgaggagaacccgttcctcggcgtgcgcggcgcccggctgctgctgcgccggcccgatctgctggaaccccagctgcgtgcgctctatcgcgccgcccgcgagggcgcgaagctttcgatcatgttcccgatgatcacctcgctgggcgaggtgctggagctgcgccggatcgccgacagcatccgcgccgatctcgatgcgccgcaagtgccgctcggcatcatggtcgaggtgccgtcgaccgccgtgcaggcggatgtcttcgccccccatgtcgacttcttctcgatcggcaccaacgatctcacccagtacggcctggcgatcgaccgtcagcatccggacctggccgccgaggcggacagcctgcatccggccgtgctgcgcctgatccggatgacggtcgaaggcgccgcccgtgccggccgctgggtcggtgtgtgcggcggcatcgccggcgatccgttcggcgcggcgctgctggccggtcttggtgtgcgcgagctgtcgatgacgccgcgcgatattccggcggtgaaggcccggctgcgcggcctggaccacggggcgctgaaggcgctggccgaagaggcccttgccgccggcaccgcggccgatgtccgggcgctggaggcgaggctcggggcatgacggccgcgatcatcaccgtcaccctcaacccggcgatcgaccagacgatcgtgatcgaccatctggtgccgggagaggttcatcgggcgaagcgggtggaacgcagccccggcggcaagggcgtcaatgtcgcaagctgcctggccgattgggggcttcgggtcaccgcgaccggcattctggggcgcgacaatgccgctgccttcgacgagatcttcgccgccggccgcatcgccgaccgctttctcagggtgcccggagaaacccgggtcaatgtgaaactggccgatctggccgcagccgacaccaccgatatcaacctgcccggcctggcagtcggggccgccgatctcggccggttgcgcaccgtgctcgacgaggtggctggggccggatcggtggtggtgctggccggcagcctgccttctggggtggcggtcgggatctatcccgatctctgccgcaggctccgcgcccgcggcgcccgggtggtgctggatacgagcggtgcgccgctcgccaccgccctgggtgccgacgaggatgcgctgcccgactgcgtgaaacccaaccgggacgagcttgccgcctgggccggccggcggctcgaaaccagggccgatctgctggcggcggcgcagggactggtggcgcggggcatagcgttggtggtggtctcgatgggggcagagggggccctgtttgtgaccgccacccgcgcgatccatgccggcctgccgcccgagcgcgtgctgagcacggtgggggcgggcgatgccatggttgccggtatcgtcgctgcccatgcggaggggggggatctggagcggatcgcccgcgccggcaccgctttcgccgcgaccaagcttggccttgtggggccgcatctgccggcgcggggcgtggtcgaggcggccatggcccgcgtgcatctggccgaggccgatatcgccgaccgtcttcaggtccggaactgatccgctgccgcatcatccggcagaagggggaaacatgtcgaaactggtggctgtgatcacggccgaagaggccgggaccgaacggctcggcacacgggcggtgctggcggccgaagcgctgcgcaagcatgcccatgacggcggtcatgcgatcgcgatcgaattccacgacggcgagaccgcccgcgatgtgctgaccgccgccgccatcgccgatgccgatgcggtgctggccatcggcggcagcggcggtgatccgcgcttcgccggtaaggccgtgacgactgcaggcgtcgacgatgtgctgcgcgacccggcggcggtgctcacccgtgccctggcggggcaggcggcacccgccccggcggcggccactgctgcgccacaggccggcggccggcggatcgtcgccatcacctcctgcccgaccggtattgcccacaccttcatggctgcggagggcatcctccaggcggcgaaggcgctggggcacgaggcgcgggtggagacgcaaggctcggttggcgcgcgcgacggcctgacggccgaagaaatccgtgcggcggatctggtgatcatcgcggctgacacgcaggtcgacctgtcgcgtttcgacggcaagcgggtctatctctccggcaccaagcctgcgatcaatgacggtcaggggttgatcaaccgcgccttcgccgaggcgaagcttcagggcaagggcgctgcggccccggatgatgcggcgccggctgcggcgaaggcggccgccggacagggatccggccgcacgggtccctatcgtcatctgatgaccggcgtctccttcatgctgcccttcgtcaccacgggcggcctgctgatcgcgatcgccttcgcgctgggcggcatctatgcctatgaggacgccaatcagggtacgctcgcctatgccctgttccagatcggcgccaagggcgccttcgccctgatggtgccggcgctcgccggctatatcgcctattcggtcgccgaccggccgggcatcgccccgggcatgatcggcggcatgatcgccacccagatcggcgctggcttcctgggcggcatcgtggccggcttcatcgccggctacggcaccgcctggctcaatcgcaacatccgcctgcacaagaatctggaggggctgaagccggtcctgatcctgccgatcctgggctcgctgctcaccgggctgctgatgctgtttgtggtgggtgagccggtggcccagctcctggcgacgctcagcgactggctgcgcaacatgcagggcggcagcgccatcctgctcggcctgatcatcgggctgatgatggccttcgacatgggcgggccggtcaacaaggccgcctatgccttttccaccggcctgatcgcctccgagatctacgggccgatggcggcggccatggcggccggcatgaccccgccgctcggcattgcgctcgcgaccaaactcttccccggccggttcacgggtgacgagcgcgaggcgggcaatgccgcggcggtgctcggcctcgccttcatcagtgagggggccatccccttcgccgcgcgcgatccgttccgggtgatcccgtcgctgatggtcggctcgggccttgccggcgccatctcgatggcggtgggcgcccagctcaaagtgccccatggcggcatcttcgtgctgccgatccccaatgccgtggtctcgctcggcggctatctggtcgcgctgatcgcgggcacggtggtgaccgcgatcatgctgcgcatcctgaaaaagccgctggccaaacccgcggcaccggccgcggtttaagccggtctgcctttgggctcgcgggcgggatggcgatcatcccgcccgcttttttgcagcgggctgccgctcctgccaggcgccgagcagatcctccgcatcggcgaccagccccagatgcatggcgacgatcttcagcgatgcggcttccaggtccccggtcgtgcccgccaccagatcgcgcagcaccgtgacccgatagcccatattggagccgtcgaaggcggtgttgagcacgcagcaatcggccaggcagccgttcaggatcagcgcctcgacgcccatattgcgcagcaggaagtcgagatcggtggggtagaaggccgaaagccgcttcttgcccgaaaccaccagatcgcgatcgtcgacctcggtcacgaactcagtccagtgcgagccttcgatcgcatggccgtcggaattggggatcgggccgacatgaagcgggaacacccgccgccaggccgagggaatgccggcgatgtcgtcgacgccgcccttgcgcagcgtgctgcggacatggatcaccggcacgccggccgcgcgcgccgcggcgtgaaaccggttcacgcccccgacgatcgcccgcgccctgggggcggggcaggggcagtcgggatcatcctccagatggccccgatgcagatcgatcgacaccaccgccgtgcggccagggttcagatagtcgtcgaacccggcgcccagcggctgccgggcaccatcgatatagacatgcatcacgcgcagattctcctggtcggcgcgacgatccggatcgtcgcgccagcatgcgcaggggtgccgacgatggtagatggggtggggcgggacgatccagcccccagctgcaccgtcgtacctgagaatgcgcagtgcacgccaaagactgcgcagtgttgggatatatggggtcacatattttgcgaatgaaaatgaattgcaacataagccgatgcgatggcattcaagggccaggatgacgccccgtttgcggggcaggtcatgcaattgatcgggatctgaccatgcgccgcctcctcctcgcctccaccgcgctttcactcatcgccccgtctctgtccttcgctgcggaagacggtgccaccatgctggggccgctgatggtcgaatccgaaagcggtgagacgctgcagcaggacggctatgtcgcgatccaggggcagcaggcgaccaaggtcgatgcgccgatcgcccggattccacaggcggtctcgaccgttacccaggcgcagatggaggatcagaagccgcggacgctgaacgaggcgatcagctattccgccggcgtcgataccggcaccttcggtttcgacacgcgctatgacgccttcaagctgcgcggcttccccgcccattataccggcatgttccgggacgggctgcggcagtataacggcccctcggcctggttccgcaacgatccctatacggtcgagggcatcgccatcctcaaggggccggcctcgtcgctctatggcgtcagcggcccgggcgggctggtcaatctggtcaccaagcgcccgaaggatcagcccttccacgagatcgaactgctgggcggtacagatgaccggcgccaggcggccttcgacctgtcgggccccgtcgatgacgaggggcgggtgctctaccgcctgaccgggcttgcccgcgcaagcgacaccacgctcgacggctatcccgacgacaagaccctgattgcgccggccgcgaccatccgcttcgacgaggacacgcagctcacccttctgggggaatacgcggatgcgacggtgggcgggaccgcggtcttctacaatcccagctacggggtcgcctctcaccgctatgccggcgatcccgactacaatgatttcgaccagatccagtggcgggccggctatgagttcagccatcgggtcgacgacgtgctgaccctggagcagaagctgcgctacaccgacgtctcctccgacctcgaatatcgcagctatcaggtgggcgggctcgcctttccctattggggacattaccgcgaggccatggatgcggtgaccgtcgacaccctggccaagatggtgttcgacaccggccgcgtgacccatgaactggtcaccgggttcgactatacccgggcgagctatgacgcctggtctgccggcagtaccgtttcgtctgccgccgcggccgcggcgcggctcggctatggcggcggtcaggaaaccgaccagtacggcctttatctgcacgaccagatggtgttcggcggctggaccgttttcgccagcggccgatatgaccgggtcgataccagggtcgtggcagccgaccgcagcagctcggaccaggacgaccaggccttctcgggccggctgggggtgtcctatgccttcgagaacggccttaccccctatgccaatgtctcgagctcgttctcgcccaatatcggcctggtctatgacgacccctataccggcaccggccgggcggcggagccgacccgggcgctgcagaaggaaatcggcgtcaaataccagatccccggcaccaacagcctgctctcggcggcgctgttcgatatcgaccaggaggacggggtggtcttcgacgccaccaccggcgtgaacaggcagcgtcagctcgacatgaattctcgcggcatcgagcttgaagccgtggtctcgctggacgacggctggagcctggtcgccgcctatacccatcagcgggtgaagatcgagaagggcatcgtcggcgctgaaggcaaggagctgtcggcaacccccaacgatatcgcctcgctctgggtgcattacgacattgcaggcggggctctggacgggctgggcctgggggcgggcctgcgctatttcggcaagagctggggcgacgacgtcaacagcttcaagaacgacgaccgcgccttcctggatgccgccatctcctacaatctcgccagcctgggccagccgggggcagagatccagctcaacgcccgcaatcttttcgactccgacgaccagagctgcagtgccggttattgctatcgcgacgagggccgcgtcgtcaccacctcgctgcgctatcgcttctgatggcgcgccgcggcctctggtcgctgatcggctcgatcggcggactctatgtcgcgcagagcgtcatcggcggcgtcacctggaccgggttgccggcgatcctgagagcagaggggctgccgctcgatcatgtcgggctgctctcgctgctggttctgccctgggcgctgaaggtgctgtggtccccggcggcagagcgctggcgcctgcccgcccgaggcggtgaccggtccgcgctgatggtcgctgccggtggcggcttttcggtggcggggctggcattggtcggggcgatcgggccggcccccgtgctgccggttctggctgtgctgctggcggtcgccttcgcgaccgccaccgtcgatatcgcctgcgacggctatgcggtcgaaagcctgcgcgaggccgaactcggctggggcaatgccgcccaggtcggcggcgcctatgtgggcgcggctctggggggcgggctgctgctggtgatcgtcgaccgggccggctggcaggcggggatctggaccatggcggccctggtggccctgctcggcctgcccttccttgcccatgcccgccgtcgggcgggacacaggccatccggcaccggccatataccctcgcttcgcgccacgctccggcggccggaggtgcggcgcgggctggcgctgaccgccttgttcgtcatcgcccagaagacggcgatgggcatggtcggccccttcctgatcgaccagggcatcggcctcgacgaggtgggcgtgctcaacgggctgggcagtttgaccctgggcttcaccggcgcactggccggcggcgcgctggtccgctggctgggtatcggtcgggtgatgatcctgacggttctcctccaggctctggtgctggcggggttcgccgtccaggcggccaccggccttctgccgcgcgaggcggcgatggggctggcgctggccggtgcctccttcgtgatgccgatcggcttcgtggccctctatgcccagttcatgcgctggtccgatccccgtcaggcgggggtcgatttcaccctgttccagtgcatggacgcgtcggtcagcatgctcgccggcctgacggcgggggtggtggcgcagcatctgggctatggcgtcttctttgcgctggcggcggccctggcgctcggtgccctgccgctcatccggcggctcgggcgtgcgcccctgcggtccgggcctgtgggatccggggcagaatgacctccgccgcctcggcgatcgcctcccaggcgcggtcgatgtcttccgccgtgctgcaatagggcggcatcagatagatcacattgccgagcggccggatcagcaggtcgcgatcgcggaagaaggcgcgcagccttggcccgacctccgagaggtagccggcttccgccacgtcgaggtcgagggctgcgatggtgcccgtccggcggacattgcggaagcgcgggttctggcggaagcgggtgacccaggcctcctgccggcgggcgagggcagcgatgcgggccaccaccggttcctcctgccagatccggagattggcgagggctgccgcacaggcgatcgggttggcggtgtaggaactggagtggaagaaggtccgggcgcggtcggtggacagatgcgcctcgaagacgggccccgtgcacagcgtcgccgccagcggcagggtgccgccggtgatgcccttggacacacacatgatgtccggggtgatgccggcctggtcgcaggcgaagagcgtgccggtccgtccccagccggtcatcacctcgtcggcgatcatcagcgtgccgtggcgttcggtgatccggcggaactcggccaacagatgcggcggatacattttcatgccgcctgcccccagaaccagcggctcgatcagcagcgccgccgcccggccggtccggcagaagccctccagcgcatccagcgtcgcctgttcccggccgggttcggggaaggggatggtgtcgacatcgaacagcagcggcgaataagcggcattgaacacgccgcgggcccctgccgacatggtgccgatggtatcgccgtgatagccgtggtccatgaccacgatccgcgatcgcggcgcgccgcggttgtggaaccagcccagtgccatcttcagcgccacttcgaccgatgtcgatccgctgtcggaatagaagacatgggcaaggccgggcggggcgaggtcgatcagcccacgggccagatcctcggccggctggtgggtgaattcggcgaagatcacctggtcgagccgaagggtggcgtcgcggatcgcggccatgatcgccggcggacgatggccatgggtgatcacccaccaggacgagatcgcatcgaagatcgaccggccctcggcgtcgatcagccgggcgccctcggtgcgggcgatagcgcgggtgacgggttcggtcaggtgctggcggaacggatgccagacaggagaggtggtggcaggcgcggtgggggcaggcgcgctcattctctgatcctttcaatccgggcgagatcgatcccgcggcggatggctgccgccagtgtgtctgcgtcgagcggatcaagctggggcaggcggcccagatgcgggacccgtccgcgggtcgtgatgatggcttcgctgtcgggctgcgcctcgccgatgaagacgaccccggcgaccggcacggcccgggctttcaaggcttcgagcgagagcaggctgtgattgatggtgccgaggctcgtgcgggcacagagcaccaccggccattgccagcgggcgaagaggtcggcgaacacgacctgccgggtcagcggcaccagcacgccgcccgccccttcgatcaccagcggaccggccgccggcggcgggtcgatggcggccgggtcgatggccacgccgtcgacatcggccgccagatgcggcgaggccggggtggtcagccgccaggtttcgggcagaacccgctcgggcggcagctggccgagccgggccgccacctcggaatcggtctcgccgtccagccccgactggaccggtttccaatagccggcgccgagggcggcggcgaggccggctgcgaccacggtcttgccgatgccggtgtcggtgccggtcacgaccagatgtcgggtcatggcgtggcctcctctgccaccgcgacggcaagggtggcgaacagcgcctcgatcagggcgtcatcgatgttgagggtgatcgagatccgcagccgggcggtgcccgggggcacggtcggcgggcggatggcgcggatgtcgaagccggcggtctgcatccgtcgggcgacgcggaccgtgcgggcatcatcgcccaggatcaccggcaggatctgggtggtgccggcgctgaagccgtgccgggcggcggcggcatgggcggtggcgatcaggccatgcaggcgactgcggcgttccggctcgccggccaggatccggagggccgcccgcaccgcggccgcctgaagcggagagggcgcggttgcatagatgaacggcttcgcccggttgatcagatagtcgcagaggacggcatcggcgccgaccagggcaccggccgcccccaacgccttgccgcaggtgtgcagcacgatcacctcgggccggccctccagcccggcggcgagaccgcgcccgtccgggccgtggacgccggtcgcatgggcctcgtcgatgaacaggaaaccgtcatgggcgcgggcgatcgctgccagatcggcgagtggtgcggtatcgccatccatcgaatagaggctttcggccacgatccagggatggccggtgccgccggcccggcgccagctgcggatggcgtcgtccaccgccccggcatcgttatgcgggacggcgacggatgcggcccggcccagccgcaggccgctatgggcgctggcatggatcagcctgtcatgcaccaccaggtcgccatcctgcggcagggtggcgagcaccgcctgattggcggcatagccggcaccgaagaacagcatccggtcggcgccgaaaaaccgcgcggcctcggcttcgagcgcctcatgctcggcatgattgccgcgcagcaggcgcgagccgccggcgccgaccggcacgccccgggccagggcctcggcgaccgcggctgccatccgttccgaggcggcaaggccaagatagtcgttggaggtgaagtcgagccccccgcggggcatcagcgtccggcggcggctgccctctgtcagctgcgccagccggtcggcatggcgggcgaggatcatcccgccgtctccgcggtcatgcccagccggcgcagcagggcggcatcgcggtcttcgcccggattggcggcggtgagcagggtatcgcccacgaagatcgaattggccccggccaggaagcacagcgcctgaagctcgtcgctcatcatgctgcgtcccgccgtcagccggacatgggatcgcggcatcagaatccgggtgagcgcgatgctgcgcacgaaatcgaacgggtcgaccggatcggcatcggcgagctcggttcccggcatgcggatcagcatgttgatcggcacgctttccggcggctcgggcaggttggcgagcgtcacgatcatgtcgatgcggtcggccgcgctttcccccaggcccagaatccccccggcgcagaccctgatgccggcggcacgcacccgcgccagggtgtccagccggtcggcatagctgcgggtggtcacgatttcgggatagaagcgctcggaggtgtcgagattatggttgtagtagtcgagcccggcggcggcgagggtgtcggcctgatcgtcggagagcatgccgagcgtcatgcaggtctccagccccagcgccttcaccgcctgtaccatcgcgaccagggtgtccatgtcgcgatccttggggctccgccaggcggcccccatgcaatagcgggtggcgccgccatcgcgggccttgcgcgcttcgcggaccacctgctctacggccatcaaccgcccggccttgaggcccgtggcattgcgagacgactggctgcaatagccgcaatcttcggggcagcccccggtcttgatgttgagcagccggctgagttgcagccggttcggatcgaaatgcgcccgatgcaccgattgggcccggaacatcagatctgcaaaacccatgtcgtggatctcgcttgcggcctcgtgcgtccagcgggccggactcagggcgggcgttgtgggggcagggatgacttcggcgggcatggcatcctccttgatccggcccaaagactggtatggacgcctaaaaggccaaatcatagataatctattattgatgcgtctctggaattactatatcaaccggatcagcggaggcatccgttattatcatagataatctatgagggggggtcatggctgagaccaccgcagaacgcattgcccgggtgctgggagacaggatcgtgtccggcgagctggcgcccggcacgccggtgcggcaggaccggatcgccgaggaattcgaggcgagccatgtgccggcgcgcgaggcctttcagatgctgaaggcccaggggctgctggtgtcggagcccaggcgcggcatgcgggtcgcgccgctggatgcggctgcggtgcaggaaatgaccgagatccgggcctcgctggaggtgctggcgctgaaatatgccgtgtcgaagctgaatgccgcagcgctggagcggatcgagcgggcgctgatcgcgggcgacgaggcccggaccatggcggaatgggagcgcgccaaccgcgcctttcaccgcgaactggccgccccctgccggatgccgcggctgatcgcgatgatcgaagatctgcaactggccaatgcgcggatcatcctgtcggccaatcgcagcgccggctggcggccggggtccaatctcgcccaccggcagatcttcgaggcgctgaaggcgcgcgacggcgcccgcgccgtcaccctgctcgatcagcatatccgggtgctggaacgggcggccgcaccggtggcgaaggcggcaccggcaggatgacggaaccatcggcgcgggcaccggttcgccggagaggtcaccgccgggtgacaaccggatggaggttccgcccatgtcccgcccgctccgccatcacccctatgacgcaccttcgggcggctgggggtcgatgcagtcgcttgtccgccatgccagccgtcagcaggtctggggcagtgcgctcggggaactgccgcgccagaacaagcccgacggcttcatgtgcgtcagctgcgcctgggccaagccggccgagccccatgcggcggaattctgcgagaacggcgccaaggcgaccttctgggagctgacctcgaaacgggcgacggccgatttctttgcccggcacaccacggaagagttgcgggggtgggaagatttcgacctggagaacgaggggcggctgacctgcccgatgcggcacgaccccgaaaccgaccgctatctgccggtgtcgtgggacgaggccttcgcggcgatcggccgccggctgaagaccttcgatcccgaccgggtggtgttctatgcctcggggcgggcctcgctcgaagcctcgtacatgtaccagcttttcgcgcggatctatggcaccaacaacctgcccgacagttccaacatgtgccacgagacgacctcgaaggcgctgccgaagagcatcggcgtgccggtcggcacggtggagctggatgatttcgagcacaccgactgcatcctggccttcgggcagaatgtcggatccaacgcgccgcggatgctgcaccccctgcagcgcgcggcggagcgcggggtctcgatgctggtcttcaacccgatgcgcgagcggggctggctgaccttcgtcgatccgcagaaccctgcgcagatgctgtcggggcggcccacgcggctcgcctcgcgctattatcagccgcggcccgcgggcgacatcgccgtcatgacgggcatggccaagacgctgctggcgctggatgatgcggcgcaggcggcgggtgagccgcgcgtgctcgaccaggctttcatcgacgagcattgccacgggttcgaggatttcgaacggatggtccgcaagaccggctgggacgagatcgagcgcaatgccggcctgacccgcgaggcgatcgaggatgccggccgcatctatgcccgggccgaacgcgcgattgcgatctacggcatggggctgacccagcacaggcttggatccgacagtgtcggcatgctggtcaatctgctgctgatgcgggggcatatcggccgtatcggcacggggatcctgccggtgcgcggccattccaacgtgcaggggcagcgcaccgtcggcatcgccgacgatccggccctggtgccgatcgaccggctgggcgagatgtacggctttgcgccgccccgaaaaaagggcttcaccacggtggaggcctgcgaagccatgcttgaggacggcgtcgacgccttcatcggccttggcggcaacttcctgcgcgcggtgcccgatcatgcgcggatggaacccgcctggggccggctgaagctggcggtgcatgtggcgaccaggctgaaccgcagccatctggtgacggcggaagaaacctatcttctgccctgtctgggccgtctggaagaggatgtgcaggccggcggtccgcaggtggtgacgatggaggattcgaccgcccatatccatgcctcgcgcgggcgggcgcggccggcaagccccgatctgctgtcggaaatccggatcgtcgccgaactggccaaggcgacgctttccggagccgcacgggtgccctgggacgactgggtggcggattacggccgcatccgcgatgccatcgcccgaaccttccccgaagacttccacgacatgaatgcgcgcatgttcacccccggcggctttgcccggccgctggcggcacgcgaccggcgctggaacaccgacaccggcaaggccaatttccggacgccggccgcgctcaatgccagcttcgacccggatgacgacgacacggtcttccggctgatcacgctccgctccaacgaccagttcaacaccacgatctatggctatcgcgaccgctttcgcggcatcgacggttcgcggatggtggtgatgatgaacccggacgacatcgcgcggatggggctggtttcaggggctcgcgtggcattgaccaccgttgcggaagacggcattccgcgccgcaaggccgggctcactctgctggcctatgacgtgcccaaaggctgtctcgccgcctattacccggaatgcaacgtgctggtgccgctctctcatcacgagcgcgacagcctgacaccggcggccaaatcggtgccggtcaggatcgccgccgaggtgggcgatgcgcgtgtccgaggcggccgtcctcagatcgaggccatgtagccgccatcgacatagagcagggtgccggtgacataggcggcggctggcgaggcgaggaagacggcggcgccgatcaggtcgtcgacctctccgaagcggccggccgggatgctggcctgcatgcgccgggcccaggcctcgtcctcgaagaagacttcggtcatgtcggtgcggaaatatccggggccgatgccgttgacccggatgccccggccggcccattcggtggcaagcgtgcgggtgaggcccagaaggccgctcttggaggcgccataggcggcagctgtcggcacgccgacctcggaggtgagcgaacagagattgatgatcgcgccgccgccggtgtcgctcatgatccgggcggccgcctgggcgcagaagaaggcgcccttgagattggtgtcctggatcctgtcccacaggtcctcgtcgacatcgagcgaggggcagacctgctccatgccggcattgttgaccaggatgtcgagcccgccgagcttttcggcggcctgcgccaccccggcacggatctgttcgaccgaagagacgtcgaagggtacggcgaccgcacggccgccggcgccgatgatgcgggcgatgaccccttcgagtgccgcctcgtcgcggccggagacagccactgccgccccggctgaggcgaggcccgtggccagcgcccggccgatgccgcggctggcgccggtgaccagtgccttgcggccggccagggagaagcgggagaggactgcggctgtcgtatcggacatgggagacaatcccgagcgctggaggacagggtggcgttcgggtgatgatcggacgcgggcgatgcggtatcaatccttccatcgcgtgccggccgcaatcaccggcatcgcccatgaccccgaggcctgcccgatgactgcgaccgccgccaccacgtcctctaccgcccaggctcccaccgcgctcgctcgtgatctggcccgcgccggccgcatcgccgaagccgaggcggtgatcgcaggcctggtggccgaggtcgcggatttcacgccagcgcatgtgaccatcaaccgcgacggctacagcctgaattcggtcaacggcttcatcgaggccgccgatggccgatccttcttcttcaagtttcaccaggaggaggacgaggccgaaaccgtgggcgaatactaccgtgccgagctgctcgccggggccggatttccggtcgaccggccggtggtcgcctcgggggcagtcggccggcagatcctgatctatgcccggcgtgatcagccgcggctggccgatctggcacgcgcggtggaggcggaggcgggcggcatcggtgggccggcaccggttgcggccgctcggctgattgccgcccaggccgatgccgaccggctggtcgctgaccgctatctggcgacgcttcacgacatcacggcagacgaggccgccgccgagccgctgcaccggctgttccatgaccggctgatcgatcatggtgcgccggagcggccgggcggtcggatggtgcggttctatgagggacaggtcttccatctgggcggccgggccgaggcgccggacctcaccctgtcctggcatcagctcaaggatctgcgctggacggtgggcggcatcacctatgaccggggcctgggcgcgctgttcgacgaggcccgtgcgcggctgctgccggcgcgcttcgccggggccggcgtcgtggcccatggcgatgcgcacaacgccaatgtctggttcgaagcgggggcgggggatgtggccgatcggctggtcttcttcgatccggccttcgccggtgcccatgtgccggccctgctggccgaggtgaaggcgaccttccacaacattttcgcccatcccttctggctctatgatgcggcggtggccgaggggctctacaccgtgcgggcgcggctcgatgccgacgggcgggggatcaccatcgatcacgatcatgatccgggccccctgcgccgggcctttctggcggccaaaggggatctgctctggcggccgctgctgcaggccctggcggcatgcgggcagcttgatgcagactggcgacgggtggtgaagctggcgctgttctgctgcccgaccctggtgatgaacctgcgtgccggcccggatggcggccatcacggccccgccgcctcggcgctggggcttgcgatcgcggtcgccatgggggccgagcctgcaggcggcgccaccgatccgctctccaccatgctggacgccgtcactccctgacggaaaccgcccgtgccgcatgctgcggcaggccgggcgggcgatcttgacagttttccgacgatccggtggactggccgccgaacccttccctggagcagaacatcgatgtccgcagatgcagcggcgacgcccgagatggtgcgcgtcgaccgggtcagccggagcttcaacggcaccaaggcggtggacgaggtgtccttcacgctggcgcgtgggcgtttcctcaccatcctcggccccagcggctcgggcaagaccacgctgctgcgcatgatcgcgggcttccttgcccccaccggcggcgagatcgtgctgggcggacggccggtctcggccgagccgccgcatcgccgctcgatcggcatggtgttccagaaactggcgctgttcccgcatatgaccgcggccgagaacgtcgcctatccgctgcgcatgcgccgcttcgatgcccgcaccattccggatcgggttgaacgctatctggagctggtccggctgggcggctatggcggccggcggatccacgagctgtcgggcgggcagcagcagcgcgtggcgatcgcccgtgccctggtcttcgaacccgatctgctgctgctcgacgagccgctggcggcgctggacaagaagctgcgcgaagagatgcagctggaattccgccgcatccagcgcgaactgggcgtcaccaccatcaacgtcacccatgatcagcgcgaggcgctggtgatgtcggacgaaattctggtgatggatggcggccggacccagcagctggcggcaccggtggaaacctatcgccgcccggccaatcccttcgtcgccggcttcatcggtgtcaccaatctgctggagggccgtgcgcttaccgcaggcggccagatggtggccttcggcaatctggaatgtcaggcaacgccgatggcggggggtgagatcgcggccggcgcgccggtgacggtctcgatccgcgctgagcagctgcgcattgcgggcgatgccgatgcgctggataccgacggcaccggcggcgggctggaggtgatcgtgcgggcgaccatcaccgaggcgatcttcgagggtgaacggtcggtctatgccgcgcaggtgccggcactgggcaatgcggtgctccgggtgttcgatcatgacccggcggcgcatcgcgcctgggcacccggccagtcggtgcatctgggctggacggcgcgcgacctgctggtctatccggcgtgagcgatgaccccggcctacgacgacccccggcctacgacttcacgatcagggacggccgccgcatgcggcctgcaagaacagggaacagggcgatgaccaagcatgacgacgcgatgcgcggcgccagccgccgtcaggtgctgaagggcggcgtgatggccgcggccggggcggcgctgaccggaaccccggcgctggttctgggccgccgggcctttgccgccgagccggccaagccggccgagatcatcgtccgcgcctggggcggtgtctgggtcgaggcgctggacaagggcgtgtcgcagagcttcaccgaggcgaccggcatccgtgtgcgccacgacctgaccgaggacaacgagatccagcccaagatctgggctgcggtggcgcagaagcgggtgccgccgatccatgtcaactgggacacctcgaccaacgccaccaagtcggcgctgcgcggcgtgaccgaggatctttcggatctgtccaacctgccgcagttgctgccggtggcgaagccggtcggcctggagggctggccgatcgtcaacacctattcctatgtctacgtgctggcctatcggaccgaagccttccccgacggcgcgccgaagagctggacggtgatgctcgacccgaagttcaagggccgggtcgcgctctacaatgacggcatcggcttccatccggcggcgcaggtcgcgggcggtggcaaggtgtctgacattccggccaatatggagccggcctgggcgttcatccgcaagctgaaggcgcagcagccgctgctgggcgaggatccggacttcaccaactggttccagcagggcgagatcgacgtcgcctgcacgatcatctccaatgcccgcgaagcgaagcagaacggcatcaaggtcaattggaccgtgccggaagagggtgccaaggtcgataccgatgcgctctgggtgcccaagggcctgcccgaaagcgagctgtactgggccaaacagtatgtgaaccatgccatttccaagggcgcgcagcagacctggaccgagaagctgggtcttcccggcgtccagcccggcctgacgccgccggccgatctggcgggcgacccggcctatccgaccacgcctgaagacttcgcccggctgatcagcgtgccgaccccggtgctggtcgagcacgagcgcgaatggttccagaccttcaaggaaatcatgcagggctgacgccctgcggaatattaggggtcattcagggctgacgccctgggggcggcaccggcgcaatccggtgccgcccgatccgtgacacatcttccgaggatgccggtcgccgccatgctccgcccgtcgaaacgcgcctatccgctgtcctggcggctgctcgatgcggccgaggctgccgtggggctgatccgcccgaaacggcctgaactggtcgcgccggccctgttccttgcccccgccatcctgctggtggcggtgctggtctggggcctggtcgacatggcgtccgacagcctgcacatgctcgacacggcgaccttcctgccggcagaggcgatgagcctcggcaattacgcccagctgatcgaccggcccatctatgccaccgtcatctggcgcagcctgctggcgggcgtgatcgtgaccgcggcgactctgctgctcgccttcccctatgcctatgtgatggtgcgcacgccctcgccggtgatacggcgggtgctgctgatcagcctgttcctgcccttcttcatcggccaggtggtccgtgcctatggctggctgatcatcctgggcgccaagggcatcgtaaacagcgcgatcaccggcctcgggtttgagccgctgaagctgatctacacctacgagaccattctgttcgggctggtccagtacatgctgcctttcgccgtgctgctgatcgcgcccgcgatcaccgcgatcggcgaggaggtggagatggcggcgtcctcgcttggtgccaactggtggcggggcttcgcgaccgtggtgctacccatggcgcggccggggctgatcgcggccggggtggtggtcttcacgctgaccctcaccgatttcgccattcccaacatcctgggcggcggcaccaacgactttgcggccaacgccatctacgacgccttcttccggatttcggacagcgggctcggggcggcactcgccatcgtgctcaccttcctcggcagtaccatcgttggcatcatcctggcgatcgccggcgccggcacgctcggcatgggcgggcgcgcaccggtaaagggaggcggagcatgagcgccggcggcaccacgccccgctccaagcggctgctgctctggtcggtgatcggcttcgatctgctgatcctggccctgccgaccctgatcgtgctcggcgcctcgttcaccgccggcaatatcgtgaccttcccgcccgacggcctgtcgctgcaatggtacgagaaggtggtcggcgcctacgagctgcgtcaggctttctggcggtcgctctgggtggcggtggtctgcacgctgatcagcctgccggcgggcacgctggccgccatcgcgctcgcccgctggcggatcgccttcgggcggacgcttcaggtctatctgctgctgcccttcaccgtgccgctgatcgcctcgggcatcggcatgatgctgctcttcgggcggatcggcattctgggccagctctggccggtggggcttgcctgtgcggtgatcaacctgcccttcatgatctgggcagtgggcgcctcggtgaacgcactcgaccccgatcttgagaatgcggcggccaattgcggcgcgccgccggtgcagaccttcctgaccgtcaccctgcccgcggtgatgccgggggtgatcaccggtgcgctgctgatgttcgtgctcgccttcaacgagttcctggtcagcctgctgctggtcgatgcacgcatcgtgaccctgccggtgcagatctacaattcgatccgcagcgtgatcacgccggatctcgcggcggtgtcggtggtctatatcctggtcgccgccctcgccatccgggctctcgacaagctggtcgggctcgacctgttcctgcgctcgaaatgagcatctacctccctgaggagtcctgcgccatgccggccgtcaacctccacgacctttcgaccctcgacgccgccgcccgcgccgacctgctcaagcgcgccgaaagcgatctcggccccttcctcgacaaggtccggccgatcatcgaagcagtgcgcaccgagggagatgcggcgctggcccgtttcgcccgtgatttcgacagggcgcctgtcgatccggcccggatccgggtcgagcccgaggccttcgaccgggccttcgatcaggtcgagcccgaggtgatcgaggcgatccgctttgcggtcgacaacatccgccgcttccatcaggaccagaagcccgaggagatgtggctgcacgaggtgcgccccggtgcctttgccggtgaccgcttcctgccgatcccgtcggtcgcctgctatgtgccgcggggcaagggctcgtttccgagcgtggtgatgatgaccacggtgccggcggtggtggcgggcgtgcccgagatttcgatcatcacaccgcccggccccgatggcgaggtcgatgcggcgacgctggttgcggcacggctcgccggtgtcgagacggtctacaaatgcggtggcgctcagggtgtcgcggcggtagcctatggcaccgaaaccgtccgcaaggcggtgaagatcgtgggccccggcagcccctgggtggtggcggccaagcgcctgctgtcggatgtgatcgatcccggcatccccgccgggccgagcgaggcgatcatcttcgccgacgatacggcggatggacggctggcggcgctcgacctgctggtcgaggcggagcacggccccgacagctcggcctatctggtcaccaccagccgcaaggtcgccgaggatgcgatcgtggccctcgacggatactgggcgaagatgggcaagcagcgccgcggcttctcgaccaccgtgctcaccggtccgcgcggtggcgtggtgctggcgccggatctggaagcggcctatgccttcgtcaacgactatgcgccggaacatctggaagtgctgggcgacgagcccttcgcccatctgggacggctggtgaatgcgggcgagattctgctcggcaaccgtaccccggtgacgctcggcaatttcgtgctcgggcccaatgccgtgctgccgaccaatgccgccgcccgcaccttctcgccgctatcggtcttcgactacatgaagcggtcctcggtcggctatgtcaccgcccgggcctatccggagcttgcccgccatgccggcgtgctggcccgctacgagggcttcgaggcccatgccgccgcggtctccgaagtgcgcgacgcgctgctgaagcgctgatcgcggtccggcgtaagcgctgatcgcggtccgagcgaccggttcagccgggattgccacggcgcagcgcctgatcgcgaacttcgcgcggggtgcggccgtggcggcggcggacggcgtcggtgaaggcggcatggctggcgaaaccggcctcataggtgatccgggcgatggtcagatcgctcgtccccggatccatcagcatgtggaggccgacggcaatccgggtctcgcggatcagcgtctggaccgtatggccgctgccgcgcatcgcccgatgcagatagccggggctgatacccagccgttccgccacagcctggggcgtcagggcgggatcggtggcctcggcgcggatcagggcttcggcccgccggcgcagcgcggtcagccccggggtgggcggggcggcggcggggggtgctgcgaacatcagggcgatcaggtccagcagggcccgggcggcgtgttcggcgcgtcgctggtcgaccggtttcggggcttcaagcagggcgtcgatcatggcggtcaccgcgtgcagcagggcagggtctgcagcacgctgcccatcggtcacggcgggtgcgaccgcgaaaccgccgcccgaacaagtcaccgccggcgggatcttcacgcagacgctcgtcaggccctcgacgcatcgaaaaccgtaagggcgggacagatcggtgacgagcgcctcgcccgggcggatatagccggatctgtcgccctggcaatggatcatccgtcctgacaccggtatcgacacggaaaacccggccacctcgtcctgtcggatgtgtgcctcgctccggatcacggcgcagtcgtcgcaggtgaatctggtcagcgacaatggcccgatccgtctctcgacgatccgggcatggaagggctgacggtcgggaatgacgtcgaacgagcaatagatgtcggtgaccgcttcgcgccaccgctcaacacctggcagtgaccggcaatccaggtcgaggatccggacccccatgatgactttgcgctccacgacccgaacaagtgccaacggcatattggatgtcgtggagaaaagagcatgcaatggcaaacgccgtgatgatgcatattgcatcacacacgaacgatgtttcgcctttcaggtcacccggtcgaaagcttttgtacacgcgacggcaagacgccggtctgaccgacgccttatgctcgtcacatatcgaccagccgcctgaggcgattatggtcgatgtaccgatccgttccgggggcacatcgccttgtgctggcggcccttgtactgacggaacgggtcgggcgggtctgcgtgcggtcccgacagggcagtgtcggggccgcacgcggttcgtcgtggtggtcagccgacgggtggttcagaaccggtagccgacacccacgccgaacagccacgggtcgatgtcgacatcggccttgatcgagttgttgatcgtgacgtcggtgttcaggaacagcttcttcacgtcgatattggcgacccaatggtcgtcgatcgcgaagtcgacaccggcctgcagggcgaagccgaagccattgtcatagtcgatgtcgatgccggccggggtgtcctcgttgtagaacacggtgtagttcacgccggcgccgacatagggacggatcttgccgtccggaatgaagtggtactgcgcggtcagagtggggggcagcagccagacgctgccgagatccacaccgccgaccgaggtgcccttggcgcggacatcatgcttggtggtgcccaggatcagctcgaaggcgatgttctgggtggcgaaataggtgatgtccagctcggggatgaccgagttgtcgatcgatacgtcgccgccgatcgggctgatcgatgcgccctcgtcggggacgaccgccacgccgcggacgcgcagcatccaggggctcttgtcttcggcggcggcgggcgctgcaccggcaagagcaccggcaagggtgccggcggcgacgagggcggcgaggccggcggccttcagggcgcggggggctttgttgagcgtggtggtcattgatctggccttcgttggcagcggtcaccggccggactgcggcggccttgtcatgcacggcccgccctgcagccggtggtccggaactctccgatacgtcaccggtcgatggccctcataaagcacctgtgtcctttttcgggcgttgatctggatcaaccgccgcgaaggatgcgaccggatgtcgcgccacctggccgcatcaggttctggaaccatcgtttttgatcttgcgcaaggaagcagcggcgtggccggggcaggatcatggcaatcaaggtcacgcccggagaggtcaatgcccatggcaaccgtcgtcgaactccgccccgccgtgcagacgtcccccgccgcgccgcgcggtggcgaggcgatgcagacggccctgcgggccgcgcgtctgccgcgctataccagctatcccacggccctgcagttcgatgccgcggtcgggccggatcaggcggcggcctggatgcgggcggtgccggcggacgagccggtttccatctatgtccatgtgccgttctgcgacacgctgtgctggttctgcggctgccacacccgggtggtgaatgtgcgcggacccatcgaggcctatgtccgcagcctggtggccgagatcgagatggtggcggagatgctgggccggcggcacagggtcagccatctgcatttcggcgggggcagtcccaccatcctggagccgggtgacatcgacctgatcttccggaccctgacccgcgccttcgacatcggaaccgatgccgagatcgcactggagatcgatccgcgcgacctggatccggcccggctggatgcctgggcgacggctggcgtcaatcgggcgagcctgggcgtgcaggatctggatcccgaggttcagaaggcgatcaaccgcatccagccggccgaagcgaccgcgcaggcggtgcgggaactgcgcgcgcggggaattcatgcgatcaacatcgatctggtccacggcctgccccaccagactgtcgagggcgtgatcgccaccgtcgatcaggtgctgacactggcgcctgatcgggtggcgttgttcggctatgcccatgtgccgaccctgaagccgcatcagcggctggtgcccgaacatgccctgccgggggcggtcgagcggctggaacaggccgaggcggccgcgcggcgcctgatggctgccggctatgccggcatcgggctcgaccatttcgcacggccggaggattcgctggcggtggcccagcgtgaaggccgcctgcggcgcaatttccagggctataccaccgacacggcaaccgccattctgggcttcggcccctcggccatcggggacctgccgggcggctatgtccagaacaccaccgatgtccgggcctggcgtgaggcgattgccgccgggcggctgggtaccgtgcgcggtgttgccgttaccgccgacgatctgctgcgccgggcggtgatcgagcggctgatgtgcgatcacgcggtcgacgtggcggcggtggccgccgggcagggccgcgatccggcggagcttgccgatgccctcgaacgactggcgccgctggagatgcggggcgtggtggtgcgcgacggctggaagctgacggtgccggcgggcatgacgcccgacgtgcagcgtgtcgccacctgtttcgatgtctatcttaaccccgcggtgcgggcgatggtcgcggccgaataggggccagcccctctttcggccgcgccacgcggcatcacttcggggggaagagcggctcgagtgcctgcggcatgaaagcgtcggcccattcctgaacgaaatgtccgccatcttcgacctcgatcggcggcgggcagccgcggatgacctgatgcagggcggtcatggccggcttgcccagtaccggatcggccatgccgatcaccatcgacgaccggcccgaccagtccgatcgccaccagtcgcgggcggcacgcgacagcggcgcaccttcggcatccggatgatcggggaccagcgacgggaagacccgggcacccgcccgatagctgtcgtcgggatagggggcgtcataggctgcagcctcttccggcgtcagatgcgggcagccgcgctggaagagtttcgagatcgagaaatccgggctgttggcgacgaaatcgcgccaggcctcgaagcccttgcccagcggccggtcgccagtgccgagggcggtgttcatgaccagaagcccctggaagcgttccggcatctccggcggcagcgtcaggcccagcagcccgccccaatcctgcaccaccaggataatgttgtggagattgagccgcttgatcagctctaccagcatgccgcggtggaacaggaaaccgtaggcgcgatcgtcggtgagcttgtcggagcggccgaagccgatcagatcaggcgccaccacccggccgcgggcgaccagctgggggatcatgcggcgatagagatagctccagctcggctggccgtgcaggcagagaaaggtcggtgcatcggcaccggcatcagcgacggcggccggctcgtcaacatatgcgatgcggatgccttcatagccgggcagatcgtcgaggtaatgcggcacataggaccagccgggcaggtccaggaagcgcgcatcgggcgtgcgcaggatctgggtcatcgggcgttgtctccggaatggcttctcatgccgccgccgtatgcggcggcggcagggccggttgcaggacggggctcgtcccgcaatccagcatagggcatccggttccggagatcagccgaggagcgtcaccgcgtctgcgaccagccgggcggcgatcgcccacatcaccagcgcgatgatcccgtccagcacccgccaggcggccggccggcggaacaccggcaccagcagccgggcgccccagcccagggccgagaaccaggcgatcgaggcaatggcggcaccgcccacgaaccacagccgttccggcatcgggtggcgcccggaaatgctgcccagcaggacgaccgtgtccagatagacatgcgggttgagcagggtgaccgccgcgacggtcccgagtgtcgcaagaagcggggcaggggccgcttcggagggcaggaggcggcccggatgcagggcgcggcgggcggccatcaggccatagacgccaaggaagagcgcgcccgcgagcgacacgtatccaagcaagacctcgtgaccggcgatcagcgagccgaggccgagggcaccggcgccgatgagcagcgcgtcggtggcggcgcaaaaggcgacgatcggcaggacatgggcgcggatcaggccctggcggaggacgaaggcgttctgggcgccgatcgcaatgatcagcccggcaccgagggcaaagccttcgagtgcggtttcgatgggaagcgacatggaaaacgaaacccgtctgcgggaatggtcggggccgcctgtcgatgcacgacatcatcgcccgcgccggtctgtcgggcgggggcgggtggcgggaggtgctggcacggcaaccgggccgtgcggacctcagaccttccggcggctgattttctcgagatgggccgagacgagcagagccatggcggggcgggttccgatcgcgggatcaaggggtcgccactatgcccggccggacgcccggctgcaacgggggcgatcgcatgaccccatgccggagggatgtgcaggcggtgcagggcagcccccggagatcttccgttctgtttcgtttgaactttcacttcggtgcgaacatatttcgtttgacggggcggcgcgggtgatccgcagcttgcccagggcgacccgaccggttgcagaggggcttcgacgatgtccgggcatgtgtatgatctggcggtgatcggtggcggcgtgaatggctgcggcattgcccgcgatgccgccggccgcgggctggatgtggtggtggtggagaagggcgaccttgccggggccacctcgtccgccagcaccaagctgatccatggcgggctgcgctatctggaacatcgcgaattccggctggtgcgcgaggcgctgcaggaacgcgccgtgctgctggatgcgctgccccacatcgcctggccgctgcgcttcgtgctgccgcatcaccggggcctgcggccgcgctggatgatccggctgggcctgttcatctatgatcatctggccggcggcaatggcgggcggcggaagctgccgggcacccggcgcctggatctgtcgcgggatgcggccggcctgccgctgaaggatgactaccgcaccgctttcgaatattccgacgcctgggtcgatgatgcccggctggtggtgctgaacgcgctcgatgcgcaggaaaacggcgcccgcatcctgacccgcaccgagttcaccgccgccgatcgcggcgccgatctctggacgctgtcgctgcgcgatgtggagacgggggaggtttcgatcatccgcgcccgggcggtggtcaatgccgccggcccctgggtcgcggaaaccctggtggaccggctgaaggtgaagacgcccgagcgggtgcgtctggtgcggggcagccatatcgtggtgccccggctgttcgaccacgaccgcgcctatatcttccagaatgccgacaaccgcatcgtcttcgccattccctacgaggacgacttcaccctgatcggcaccaccgatgccgatcacaaaggtgacccgggccgggtcgcgatcacgcctgaagaggtcgactatctctgccgggcggtttcgggctatttccggcgcccggtcacgcccgagatggtggtctggacctattccggtgtccgcccgctctatgacgacggcgcgagcaaggcgcaggaagcgacccgcgactatgtgctgacggtggataccgcggcagcaccggtgatcagcgccttcggtggcaagatcaccaccttccgccgcctggctgaggcggcgctggcgaagctggagccgctgctgccggcacgcaccgacggccgggcgctgcgcggcccctggacggccgatgtgccgctgcccggcggccgcctgcccgccggcggggtcgaggcgctggtgcagagcctggcgctcagccatcccgtgctggacgaacggacccgccggcgtctggcccgcgcctatggcggctatgtccatcgcgtgatcggcgatgcggcggccgatccgtcggcgctgggcgaacatttcggcgctggtctgcatgcccgggaggtcgcctggctgatggatcatgaatgggcgcgcacggcagaggatgtcctctggcggcgcaccaagctgggtctcaggatcgatgccgcgggtgtccgccggctcgatgcctggatgcaggcccgcagctcggcgcgtctcgcggcgtgagcgtgcggctgcagcagaggggtgcccgggccaccggcaccaccggacttgccggggccccgtcccccggcccaaactgacgcctgaaacgaccggggcggcccaagccccggcgtgccgggcgtgcggggggagcattcgcatggccggcacagcttccgaggaggatcgccgtccccatgcccgccaaccgcaaagatgatgttgtccgcaaggacgatggtgcccgcgaaggcctgatcctggcgctcgaccagggaaccacctcgacccgcgccatgctgttcaaccacgacatgcaggtggtcgcgaccgaccagcaggaatttccccagcactttcccgcctccggccatgtcgaacatgatgccgaggatctgtggcggaccagcgtcgagaccatgcgcggcgcgctggcgaaggccggcgtggaggcggccgcgcttgccggcatcggcatcaccaaccagcgcgaaaccacggtggtctgggatcgcgagaccgggcgggccatccatccggccatcgtctggcaggaccggcgcacggcgcggatctgcggcgatctgaagcgcgacgggcatgaacagctggtccgcgaccgttcgggcctgctgctcgatccctatttctcggcgaccaaggcctcgtggatcctggacacggtgccgggtgccagggcggcggcggaggcgggcaaactcgccttcggcacggtcgatgccttcctgatctggcggatgaccggcggccgggtgcatgcgaccgatgcgaccaacgcctcgcgtaccatgctctacgacatccaccgcggcgcctggtgcccggatctctgcaaggtcttcggcgtgccgatgggtatgctgcccgaggtgcgcgacagcgccggtgatttcggcgaaaccctgcccgacctgctgggcgtgccggtgccgatccgcggtgtcgccggcgatcagcaggcggcgaccaccggccaagcctgtttcaggcccggcatggtcaaggcgacctatggcaccggctgcttcgccctgctggtgaccggcaatcagtcggtgcggtcgcgcaaccggctgctgaccacggtggcgctgcagctgaacggccggcgcagctatgccctggaaggctcgatctttgtggccggtgccgcggtgcagtggctgcgcgacgggctgggcctgatcgagaattccgcccagaccgaggtgctggcggcggaggccgatccggcgcagagcgtctatctggtgccggccttcaccggtctcggtgcgccgcattgggatgccgatgcccgcggcgccatgttcggcctgaccagggccaccggcccgcgcgagattgcgcgcgcggtgctggattcggtcgcctatcagacccgcgatctggtcgaggcgatgcgtggcgactgggagggggacgggttttccgaaaccgtgctgcgcgttgacggcggcatggtcgccagcgactggctgatgcagcgtctggccgacatgctggcgaccccggtcgaccggccgaaactacgcgagaccaccgccatgggggcggcctatctggccggtctcgcgaccggcgtctatcccgatccggaggtgtttgccgaggggtgggcgcttgaccggcgcttcgagccgggcatggccgaagccgaacgcgaacggctgtatggcggctggcaggatgctgtgcgccggacgctgacgcgcagctgatcggggcgatcacgagcatgtgtcaacccgcccggcggggtggcgcgaacgggggatccgccctattctgatgggggtgcggatccgcccgttcacgttgccttgtggggtgatgcctgacgatggtcaacgacgttctgaagctggtcctgagcggggccgaaagacgaccgtcgccggtgatgtcccggcgcctggacgccttgttccgcgccctgcagacgcccacggatgaccgtgatcccgaggacatccaggcgatgatctgggcgctgtggtgcgaacatcacgatccggatgcgacccgtgcgctgtcgcgggcgatcgatgccatggtcgccggccggctggtggtggcggaaggtgtgctggaccgcaccgtgctgcgctggcccgatttcgccgaggcctggaaccgccgcgccacgctctactacatgcaggaacgcgaccaggagagcctgggggacatccgcacggcgctggagctggaaccccgtcatttcggcgcgatctgcggcttcggccagatctgcatgcgccgcggggaccgcaccgcggcactggccgctttcgaaacggcgctgcggctcaacccctatctcgccaatgtccgccagatggtcgaggccctggccgaggatctgccgcgcacggtgaactgacgccgtgatcaattggtgaaaagacgcgcggcctgcacacgatcgaatgggcaacacttgaagatgatgcgcagatgggcgaggtttctcgtcgttccgcatcatgtagcccatcatccggaaggaccggtatgcgcatcggcagcctcgttgcgtccctgctcgcagctcttgcgcttgcggcctgttcctcctcgcgcgagagcctgccgtccaggacggcgaccgagcagcttctgctatcgtcggcggtcgacagggcggcgcaggaactgaccctggacctgccgcaggatgccccggtcttcctggataccaccaatttcgaagccatcgacggcaagtatgcgatcggggccgtgcgcgaacagctgctgcgccgcggcgcccggctgatgcccgaccgggcgcttgccgatgtcgtgatcgagatccgttcgggcgcgctgtcgatcgatgacgaaagctcgctgctcggcctgccggcgatcgacattcccgtgccgatgagcgatgtcagcacgcccgaactggccctggtgaagcgcgacgagcgccgcggcacggtcaagctcgccgccgtcgcctacgacgctcatgacggccgcttcgtcgacgcgaccggcccggtctacggttattcgcacatcaccgactggacggtgctggtgttctcgtggaccagcagcgacgtgctgccggacgagcagcatgtgccggcgatcaccgccagcctcagggatttcggcctggcgagcgcgccggaggattgagaccggccggcggcccttcggcacttttttatgccccgtttacgcggtcggaccaggatcgccatcgcgattttacggccgtccggccgacactccatcctgacgggagcgtcctcttgcggtcgctccgcacatcaaggatcggagccatgatggacattctgatgctggcgctgggatccgggctgttcggcctggcagctctcgcagctgtcgggatcgcacggctatgacccccctgcctgaaccggggctggtcgatctgatcgggttgattctgggcggcttggccgttgcggcgctggccgcatggctcaccgccgtgctgatccgccccgatcgctgatcccgcccctgagacggatcctgccatcccatgatatcgacggatttcgggcggatcgcgctttatctcgcgatcctggccctgattgcggtgccgctcggccgctggacggtcgccgccgcgtcttcctccggccgtttgggccgcgtctttgcgccggtcgaggccggcatcctcggcctctcgggcgtgcgtgccggccgcgaaagcagctggctcggctatgcgctggggctgatcaccttcaactatgccggctttctgctgctctatggggtgctgcgcctgcagggcgtgctgccctggaacccggccggcattccgccgctcgatccggcggtcgccttcaacatcgcgatcagcttcgtcaccaacaccaactggcaggcctattcgggggaggcgcagctgtcctccttctcgcaggccttcgggctgggggtgcagaacttcctgtcggccgccaccggcattgcggtgatggtggcgctggcccgcggctttgcccgcgccgagacgccgaccatcggctgcctgacgaccgacgtcacccgcatcacgctgcgcctgctgctgccgctggcggttgcggtgaccatccttctggtgctgcagggcgtgccgcaggtgatgaccggcacgctggcatccgtcggtctggacgggcatgcccaggccatcccgctcgggcccgtggcctcgcaggtggcgatcaagcagctcggcaccaatggcggcggcttctacggcgtcaattccgcccatccactggagaacccgaccgcctggtcgaacctgatcgaggtggtggcgatcctggccctgccggcggcgatgcccttcgccttcggccgccttgccggcgatccgcgccagggccgggcgttgttcctggccatgttgatcccctttgccgtctttgtcgggctgaccgtctgggcggagacgaccggcaacccgatccatcacgcgctgggcctcgccggtcccaatatggaaggcaaggaggtccgcttcggggccgccgacagcgccatctgggcggcggcgaccacggccgcgtccaacggctcggtcaatgccatgcatgacagcttcacgccgctcggcggcatggttgccatgatcggcatgatgctgggcgaggtgatcttcggtggtgtcggcagcgggctctacgggttgatcatcttcgccgtgatcgcggtcttcgccgccgggctgatggtcggccgcacgcccgaatacatggggaagaagatcgaggcgcgcgagatgacgctggcgatgctggcgctgatcggcctggcggtcgcgatgctggtcccggccgccctgtcggccgtgctgcccgcgggccgtgccgccgtgcaggatgccgggccgcatggcctgtccgagatcctctacgcctatgcctctgcggccggcaataacggctcggctttcgcgggcttcggcgcagcccagaccttccacgccatcgccgtcggcatcgcgatgatgatcggccgctatttgccggtggtggtggtgctggcgatcgccggcagcctggctgccaaaaagaagatcccggccactgccggcaccctgccgacccatggcccgctcttcatcggcctgctgatcggcacggttgcgatcatcggcggtcttacctatttcccggcgcttgcgctgggtcccgtcgcggagcatctgtccatgctcctcggccggacgttctgacggaacccgctcccatgcgtacatccgaggacatccgcctcgtcgacccggcgctgctgtcgcgcgccgcccgcgaggccttcaccaagctcgcgccccacgcccttgccggcaatccggtgatgctgaccaccgccgtggtcgcagccgtcgcgaccatcctggccgtgatcgatcttgcaagcggcggcccccatggtgcggtgctggcgcagatctgcctctggctttgggcgacggtgctgttcggcaattttgcggaagccctggccgagggccgcggccgggcccgcgccgacagcctgcgcgccacccagtccgagacgccggcaaagctgctgccggccatgccgcgcggcgatgtccggatccatgactggcgcgaggtctcgtcccgcgatctggggcccgatgacctggtctatgttgaggcgggcgacatcgtgcctgccgatggcgaggtcgtcgccggcatcgcctcggtcgacgaaagcgccatcaccggcgaaagcgcgccggtgatccgcgaaagcggcggcgaccgctcggcggtcaccggcggcacccgggtggtatcggatgcgatcgtggtccgcgtcacccagcggccgggcgaaagcttcctcgaccggatgatcggtctggtcgagggcgcgacgcggcgcaagacgccgaacgagatcgcgctgaccatcctgctggtctcgctgacgctgatcttcctgatcgtggtggccagcctcgaagccttcgccgccttctcgggcacgctgatcccggtcggcttcctgatcgcgctgctggtcaccctcatccccaccaccatcggcggcctgctctcggccatcggcatcgccggcatggaccggctgatccgcgccggcgtcgtggcccggtcgggccgtgcggtcgaggcggcgggcgatgtcgacgtgctcctgctggacaagaccggcaccatcaccttcggcaaccgcatggccgatgccttcctgcccctgcccggcgtgggggaggcgcggctggcagaggttgcggcgctcgccagccttggcgacgaaacgcccgagggccgctcgatcctcgatctggcgcgcaaggcccatggtttccgtgccgaggcggcggaggtcgcgcgcatggtgcccttcaccgcccagacccggatttccggcgccgacctcaacgatggccgccgcctgcgcaagggcgcgggcgatgcgatcctgaagcaggccaggggcagcgtcccgccccagctcggccatctggtcgatcaggtcgcgcgcagcggcggcacgccactggtggtggcggaagacgaccggccgctgggtgtcatccacctgaaggacgtgatcaagcccggcatccgcgagcgcttttcggaactgcggcggatgggcatccgcacggtgatgatcaccggcgacaacccgatcacggcggccgccatcgcggcggaagccggtgtcgatgacgtgctcgccgaggcgacccccgaacgcaagctggaactgatccgggctgaacaggccaagggccggatggtcgccatgtgcggcgacggctcaaatgatgcgccggcgctggcccaggccgatgtcggtgtggcgatgaacgagggcacgccggctgccaaggaggccgccaatctgatcgatctcgacagcgatcccaccaagctcatcgaagtcgtgatggtcggcaagcagctgctggtcagccgcggggccctcaccacattctcgatcgccaatgacgtggcgaagtatttcgcgatcgtgccggcgctgttcgcgagcgtctatccggcgctgggtgcgctcgacatcatgcagctttcaagccctgaaagcgcgatcctctcggcggtcatcttcaacgccctgatcatcgtggcgctggtgccgctggcgctcaaaggcgtggcggcacgggcaacctcggccgcggcgctgctgcgccggaacctgctgatctatggcctcggcggcctgatcgcacccttcatcggcatcaaggcgatcgacatggtcgtctcgggcctgggcctggtctgagcgagggagaccgtcttatgctgcaccccatgttgcgcaacatccgccgggcggtggtgccgctcgtgctgttctcgggcctgctcggcctcgcctatccgctggccatggccggccttgccggggcgatcgcgccccggcaggcggcgggcagcccggtcaccgatgcggccgggcgggtggtcggctcggcgctggtcggccaggatttcacctcccccggctatttccatggccgcccctctgccgtcgactacgacgcagtggcggccggcgcctccaatctcgggccgacctcggctgcgctggcggcagagatccgcgaccgcatcgccgcggtcagggccgagacgggggcgggcggcgcggttccgggcgatctcgtgacggcctcgggctcggggctcgacccggatctctcgcccgaagcggttcggctgcagatcccgcgggtcgcgaaggcccggcagatggcgcccgatgcgctggaggccctggtggccacccatgtcgagcggccggttgccgggctgatcggccagccccgggtcaatctgctgcggctcaacatggcactcgacgccatggctggccccggggcaggctgagccctaagccccgcgcgcggagagcccgatgaccagagacgccgacagacccgcccccgaggcgctgatcgaggatgcgaagcgcgagcgccgcggccggctcaagatcttcctgggcgccgcccccggcgtgggcaagacctatgcgatgctggaagaggcgcagcgccgccgtgctgaagggaccgatgtcgcggtggcggtggtcgagacccatggccgggccgagaccgaggcgctgctgcgcgggctggaggtgatcccgcgccggatcctgacccatcgcggccggagcttccccgagatggatctggatgcggtgctggcccgccgcccggccctggccctggtcgacgaattcgcccacaccaatatcccgggggcgcgccacgaaaagcgcttccaggatgtggccgagctgatcgatgccggcatcgacgtgctgaccacgctcaacgtccagcatctggaaagcctgaacgacatcgtccagcgcatcacccgcatccgggtgcgcgagaccctgcccgacgacgtgctggcgatggccgacgagatcgagctgatcgatctgccgcccgacgatctgatccggcgcctgcgcgagggtaaggtttatctgggcgaccaggcgcggcgggcggtgctgcatttcttcagccgcggcaatctgacggcgctgcgcgagctggcgctgcgcgcggccgccgagcgggtcgatgaagagatgatccgctatatgcgcgcccatgccgtgcccggcccctggccggcgcgggagcggctgatggtttgtatcggcacgggggcagaggccgaggcggtggtccgcgccggccgacgcatggccgaccgcgcgcggctgccctggatcgcggtccatgtcgagaccgggaccggcgccgcgtctgccggtgattacaccccccaggaccgcgccaatcgggcgctccggctggccgagcggctgggggcggaggtgaccgtgctgccgcggccggtgcatgcccggcggctggccgacgagctggtggcgctggcgcgggagcgcaatgtcagccggatcgtgatcggccgggcgccccgccggccctggtggcggcgcctgggggccggcggcgggctggccgaggcgctggtcagccgcgcgaccggcttcgaattgaccgtcatcgccgccgaggccgggacgaccgccgccgcagccgaacccggccgtctgcaggcggaggccccgggcccgcatttcgggccgcgggaactggcgctgatcggcgtgtcggtggccgccgccgccctggtctcgaccctggtcgagatgatcctgcctttgcccaatgtgtcgctggtcttcctgatcgcggtgctggtggtggcggtgcgcggcgggctctggccctcgatcgcggccagcgtgctcagcttcttcgcctacaatttcttcttcaccgtgccccaccacacctttcaggtgtcgcgaaccgaggacatcctgaccatcgtcttcttcctgatcgcggcggcgctgaccggcaatctcgccggccggctgcgggagcgggtgcaggcggagcggcaggcggcgcggcgggtcggcaatctgtatgatttcgcccgcaaggccgccggggcggccgatgtcgacgatgtcgcctgggcggtggtctctcatgtcgcgcgcacgctgcaatgcgatgcggtgctgctgctgccggaacccgatggcgggctcaggatcggcgccggctttcccccggaggaccggctgacccccgccaaccgggcggcggcggaatgggcctggcggcacgagcggccggcgggctggtcttccgacacgctgccggcctcggactggctgttcgtgccgatgaaggccgcgcgggggcccgtggggctggtcggcgtctcgttcggcgggcgcgacggccggccgaaacagctgggccccgaacagcgccggctgctggaggcggtggtcgatcaggcggcgcttgccgtcgaccgtaccctgctcgcggccgatatcgagcgggagcggctgaagggcgaggcggatgccctgcgggcggccctgctctcatccatcagccatgatctgcgcacgccgctggtctcgatcatcggcgccgcatcgagcctgaagagcctgggggaggcgctggatcccggcgcccgcggcgagttggccgacaccatccacgacgaggcgaggcggctggatgcctatgtccagaacctgctcgacatgacccggctcggccatggcgcgctggcgctgcgtcgcgactgggtggatctggcggaactggccgggcgggtgcgcggccggctggcccggcagctgggcgggcggcagctggacgtggtggtacccgaaggcttgccgctgcttcatgtcgatgcggtgttgatggaacaggtgctggtcaatctggtcgacaacgcggtcaagcatggcggaccggatggccggatcaccatcgccgccgcccttgccgatcgcggccgaagcatcgacatccgggtggaggatgacgggccgggcatccccgaagcggatcgggaggccgtgttcgacatgttccaccgggtgaaggcgggcgacagccagccggcgggcaccgggctcgggcttgcgatctgtcgcggcttcgtcgaggctcatggcggcacgatccgtgccgaggccggtgccggtggccagggcacccggatcgtgatccgcctgaccgtcgcggagccgccggccccgccgcccgaagatgccgagtgatgccccctcatcggagagacgatgcccgtcgacatgaacacggcccgcattctggtggtcgatgacgaaccccagatccgccgctttctcaagatcgcactcggtgccgccggcttcgaggtgatcgaggcggcgacgggggaggaggcggtccgggccgcggcgacccgggcgccggcgatgatcgtgctggatctgggcctgcctgatatcgacggcaccgaggtgatcggccggatccgcgactggtcgggcgtgccgatcctggttctgtcggtgcgggctgacgaggccggcaaggtggcggcgctggatcggggggcggatgattacgtcaccaagcccttcggcatcgcggaactcaccgcccgcatccgggcgacgctgcgggcgcgcggcaccacaccggcccagccggggcagatcccggccgcgcctgatgacgaggcgctgatccgcatcggcacccggatcaccattgatcagccccgccatgaagtgacgctcgacggtcagccggtgaagctcagccggcgggaatacgacctgctgcgcatcctggcccgcaatcgcggccggatgatgacccatgcccagctgctgcgcgaggtctgggggccggcgcacgaggccgacacccattatctgcggatctatgtcggccatctgcgccagaagctgggcgacgaccccgccgatccgaagctgatcgtcaacgagcccggcgtcggctaccggctcgacgggggctgacgggaagagactggtgacatcaaccccaccatcaaccccgcgggttgatggtgggcggaatcaggccagccccttggcgcgggtgatgtcttccagcgccgccagccagtgatggtaataggtggtgccgagatccggatcaccgcccagctgggcggtgacgatgcgggccgacagggtcgccgcccattcgttccagctgaacaggccggcctcgtgcagggacacgaccagggcgaaagcctgggcttcccagggttcacggaagaccggcccctcggcatccgccggctggcccagcagcaatggcggcatctgccgggacgcggacggcgtgcaggtgatgccgtgggcgccggcatccggcgtgccggtggccgcggggcgggcagcaccggccggcaccacggtgatggggcggggtgttgaggggggttgatgctccgtcgccatcatgccggctccagatagtcgtcccacagatcggcgtggacgcagtcgttgggatgggcggtttcgccccagagatcgcgggcggcgaagcgcacggcatagcagggctggggatcctcgccgcggcgggcggcggcggcatccggcagcacgaaatcgccgtgcaggcgctcgatcgtgcccacgcggccgcgcacatagcgcggcgccctggtatgagccagggtgttgatatcgcggacctttacccggtctccggctctgaagcgggcggggtggccgccgccctcccggcgggcgctggcaccacgcgccaggatggcggccgcctggggcgcatcgggggcgggtttcaggtcggcgggcagggccggggccgccggatcgggcacccccgtttcaaattcagcgacggtcgcgaggccatggcggaccatcaacttttcgagcccgcgcagccagatttcatagtagctgctggtcagatagaccggcggcggcaggctttcgcgggcatgacgggcctcgtcgatcgaccagcggcccaggaagccgatggccagcgtcaccgcgagcgcgcgcgcctcccagggggcatggaagaccggctcgttgacctcgatcccgatcgggccgaagcccatcatgccgcccagatcctgtgcgccgttcatgaccgcatctccggtgtctggtcggccagacgggtgacgccgatcatcgaatcgcgggtgacgatcgccgccagttgatcctcgtcccagtcttcggtgccggcagggcgctggggcaggaccagatagcgcagctccgcggtgctgtcccagacccgaacctcgacatcgtcgccgaccctgcagccgaattcggcgagcaccccgcgcgggtccagcacggcccgcgagcgatagggggcggatttgtaccagaccggcggcaggcccagcaccgtccagggatagcaggagcacagtgtgcacacgaccatgttgtgcacctggtcggtgttctccagcaccaccatgtcctcgccctggcggccggtgaagccgaactcggcgatggcggcggtggcatcgctcagcagccgggccttgtaggccgggtcggtccaggcgcgggcgaccacgcgggcgccgttgcgcggcccgaccttgctttcataggtgtcgacgatcaggtcgagcgccgccggatcgaccagccccttggccaccgccagcgcctcgatcgccttcacccgcgccgccatgggcgaaggcggggccgcatgcgcgtgcccctgcccgtcatgtccgtgatcatgatcgtgatcatgggcatggtcatgatgatcgcctgccatcctgtcctccctggggcgtcgtttccgtgcgcggttccgttcagtcgacggtaggccgctcgggtatgcggcgcaagtcggtgccgggcaatgtggaccggccgggcagcccgtcatcggccgtcatcgcctgttccagccaggcggcgacgcgctcgatctcggggcgatcggcggcgctctcgccgtggatcagccaataggcgtcggtccaggggacggcggtggcgaacagccgggccaggcggccggcggcgatgtcggtcgcgaccatgcggttcggcgccagcgccacgccatggccggcgatggcggcgccgatcagatggtcgtgatcgcccagaaccgggccgcgcggcggctcggcgcgggagatgccggcgctgcggaaccacagatcccaggcatcttcggggccgcgcagcagccggtagcgcagcagggcttcgggggccgccggccgccccgcccgggccagatagaccggggcggcgaccggcaccagcatgtcgccggccaaccggtcgacccgctcgctgccgcgcggccgggccccgatcctcaggatcaggtcgggcggcggggcatcgccatcgggggcgccttccaccatcagatgcggctcgatcccggggacggcggtctccagctcgtccatgcgcggcatcagccagcgggtggcgatcaccgccggggccgcgatgcggaccggctcggccggcaggccgtccagctccaccagcccgcgggcgagcaggtcgaacatctcgcgagaggtggcatagagccgccggccgtgttcggtcagcaccaccttgcggtggagccggcggaacagccgcatgcccagccggtcttccagatcgcggatccggtggctgatggcaccgtcggtgaggtgcagttcctcggcggcgcgggcaaaactctgatggcgggcggcagcctcgaaggcatgcagggcacccaggggcggaaggcgacgacgtgacatggcaggacgctccggatctggcgtcgaccgggcggcatccgctgggcctttagggcagcgaggtgcggtcaggggcgcgcggtccacatcgtgggatcacgatgatggtccgggccggcctttccgcaccatccgcggccggtccggcaattcctgtctccagcaggggaaacgaggtcgccgaaccaacggcccgcggcggatgccgggtcgaaggcggtctgaatgacgaatgaggggagcttgggccgggaccggccgcactcaggcggcgcggggtactccggaacgggcggaggccggcggcgtgacggcgccatgccgggcgatcggggtggcagcgtgcagcggatgcatcacggtaccacccggtcgcttgtcatctttgccgcggcgaccgtcgaggtcgaactggcggcgcgagatggagcctccatcggcatggtcggcctgccagccgccaaaccaattgcggtcgcgcccctgattgcggacggcctgcacggtcatcacagtcacggcggcaccaagagtgacggtcgcgatggtggtcgcggtcacggtggtggcggtggcggtgcgagcgggcgaagcggcggcgatcagggcggacatgtcggcgatctccgtatcggcacgcgggccgggacgaagtgtccgggccggggtgcggctagagccgggcaaaggatgcgccgaaatgtcgcgcaatccaaccccgaatccgttgatcctgcgacgatttgatccttatgtccggcccgctgtgtcctgggggtcgcgtgccgcccctgcggtcggatggccgccggccagcgccgcggccatgcgttcggccttgtcgatcatcagcatcgccgccaccggcgggcaggtgcggatcgcggtctcgcgccagatcgccagccagcggtggaaatgacccggcgtcagctcgggcatcgccgcatgggtgcgcatcggattgcccttatagctgccgtcgtggaacagcaccgagcgccagaacccgaccacccgggcgatgtggtcgggccaggcatcatcggcgacccgggcaaagatcggcgccagcatttcgtcgtggcgggcacgatcgtagaaggcggcgaccagccgttccagggtggcgggatcgacggggctgtcggtgacggctgcgcgctggcggagaggtggggaggtggtcatgtacgggctcgcgacggctgcggaagaggcgtggggcggcggcatgcgattggggccttgccccctgccgcgtggcaacgtaaaccattgtggggccaaggggacagacggaaaacccgatgacggatctgaaggatcagaagcactctgtgccacaggggccggcgacgccgggacggcggcgcttcctgcgtttcggcgtggccgggctcgtggccggaacaggcctgcttgcgggctgtgaggcgcgtgccccccgccagatgacggtgatcgagccggcgccgatgcccgaaaccctgccgccgcaggaggtcgtgccgggcatgccgctgttcccgacccgggcggtgctgagcaagatggagcgcagcctggtcttcttcgacggcgaccgcgaggtgaagcgctattcggtcgccatcggccgcggtggcccgggcccgaagcgggaagagggcgacgccctgaccccagagggccgctatcacatgatgccgccgggacgcgaatccctcgacgggttccgctggttcatcccgatcagctatcccaatgccgaagacaaggcgcgtgccgccgcggccggcgggcggcttaagctcggcggcgcgatcggtctgcacggcaccggcgacggcccgtgggagagcattcatgcccgcggcgaccgcagctggacactgggctgcctggccgtcaccaaccaggagatcgacgagattcgcgagatgatctcgtataacggccgccgtccctttccgatcgacatgcgggcctgaggccggccatggggtggcggctccggatcctgcccgggctgatcgcgagcctggtcctcgcggcctgcgggggcggcagcattccggggcccgatgcgccacgggcggcacctctggtctgcgcggcggagccgccgccgggtggcatggttgcggcgatggtcaatgtggccgagggcgaatggcgggctttcggcagtccggtggtcgatttccggggcggcgcaccgtccctgaacccgccgggcctggacgagaccgacagccgggtgcgcggccggcttcagctctactggcgggcggcggcggatgatcacggcctgaagatgggtgcctccgacgtgccggagctgtcgccctggtcggcggccttcatctcttatgtcgcctgcatggcgggcatctccccggccgatctgccgccggcctcgcggcatctggactatgtcgatcatgtgatcttccgcgccctcggcacccagggcgatctcacggcccgcttcgtgcctgccgatccgcacgagacctcgatccggccgggcgatctgctctgcgccgatcgcggccgcgccgagggcgggccggaactcgacgactggcatcagcgcgcgcgggaggtattggatgcccgcgcccgcggctgggatacgcggccgaggggcatgcattgcgatctggtggtcagggtcgggccgggcacgatcgcggcgatcggcggcaatgtccgggatcgggtggcgatgagcctgtttccggccgatgcctcgggacggccgatcccggtcaggggcacgcctcattggttcgtgacgctcgccgcggtcgaccactgaccgggacgtcgctgcggtttcatccagcggtcaccggacggtcacggagcggtccggagcccggcggcaggatcggcggaccggcgggcccttggggcccgcgcgctccagcggatccgaggtttctgatgagcgacacggcacccactcctgaccgcatccacaacgtgctgttcctgtgcaccggcaatgccgtgcgcagcattatggccgaagccctgctcaaccatctgggcaaggggcgtttccgggcctacagcgccggcagccatccggccggtgcgcccgatccgctggcgctggccctgctccaacggtcgcgcatcccgaccgaagggctgcgctcgaagagctgggacgaattccgcggccccgacgcgccgcgcttcgactttgtgttcacggtctgcgatcaggcgcgcgagacctgtccggcctggcccggccagccgatgaccgcccattggggtgtgcccgatccggcggcggttcagggcaccgatgccgagcgtgccctggcggtggccgaggccttccgcatgctcaacacccgcatcggcatcttcgccaatctctcgatcgcggcactcgaccgcctgtccctgcagcagcacatcgacgatatcggcgacaccgccgcagcctgagcaggacctgcccggcgcggtgtcaaccgcgccgggcgatcccgccgccatccagccggcgcagcgaggtggcgagccgggcctctgccgccgcgatctcgcccagcgcctgatggacatagcggatatgagcctctgccgcggtttcggccgcggccgcatcgcccgccagcacggcgtcgtggatcgcgcgatgctgggcgcgcagcgcctcgcgggtttcgggacggcggaacatcgtttcgcgattgtccatcacgccccggcgcagcaggccggtcagggcgcgcatgacctgcatcagcaccagattgtgcgaggcttcgtagagcgccagatgcagggcgacatcggccgcggcctcggccggttccggtccggcctcatgggcccggtcgatggcggccatggcctcgccgatccgggcgcgatccacgtcgttcgcccgccgtgccgccaggcccgcggccatgcgttccgccgtggcgcggaattccagatagtcgtcgaccacctcaccgtgatcggctatcagcgcgatcagcggatcggtcagcccgcggcccagcggtgccaccagccgtcgcccctgatcggccaggatcaggccgcggctttccagcagtttcagggcctgacgcagcgtcgggcgagagacgctcagcctctcggccagctcccgctccggcagcagcggatcgccggggctgagcgccccctccaggatcagcgtctcgatctgccgggcggtccgcgccgccgcgccgtcggcgacgggcttgccctcgtcctgttccatcacgtccgtcctgttgcgcatggctcttgtcattgcgttcctggtaaaatcagtttaccaagatatcggttctggttctcttatacgaccggcaggcccggccgtcatcccctggagagcgtgatgcgccttgccgactgccataatttccacgatttccgccgcatggcccgccgtcgcctgccggggccgatcttcgactatatcgacggggcagccgatgacgaggtgacgctgcgccgcaacaccgccgccttcgacgactgcgatctggtgccccgggtgctgcgcggcgtgggtgcggtcgacatgtcggtgacggtgatgggccagaagctggcgatgccggtctactgctcgcccaccgctttgcagcggctgttccatcatcaaggggagcgggcggtggcggccgcggccggaaagttcggcaccatgttcggtgtctcgtcgctcggcaccgtcagcctggaagaggcgcggcggatctcaaacggtccgcaggtctatcagttttatttccacaaggatcgcggcctgaaccgggcgatgatggagcgtgcccgcgatgccggcgtgcaggtgatgatgctgacggtcgacagcatcaccggcggcaaccgcgaacgcgacaagcgcaccggcttcgccattcccttccggctgaacctcgccgggatcacgcagtttgcgatcaagccgcgttgggcgatcgaacatttcacccatgaacgcttccgcctgccccagctggacgcccatgtcgacatgggtggtggcaccatgtcgatcagccgctatttcaccgagatgctcgacccgtcgatgacctgggacgatgtcgccgccatggttcgggactggggcgggcagttctgcctgaagggcatcatgtcggtcgaggatgcgaagcgggcggtggagatcggctgcaccggtatcgttctctccaatcatggtggccgtcagctcgacgggtcgcgcaccggcttcgaccagctggccgagatcgtcgatgccgtgggcgaccggatcgatgtgatgatggatggcggcgtccagcgcggcacccatgtgctgaaggccctgtcgctgggggccaaagcggtggggctggggcgctattacctttttccgctggcagccgccgggcaggccggggttgagcgggcgctggaactgatgcggatcgagatcgagcgtgacatgaagttgatgggctgcacctcggtcgaccagcttggccgggatggcctgcgtttccgcagccgggccggatgactggcagggacagtcatcctgcgctataccgttgaaggaacattgaaacagaaccgactggcggtacccatatgcgtcgcacctcacgcttccgggccctcgtcgaggccccggagatccttgaaatgcccggtgtgcaggatgcgctgaccgcgcggattgccgctgaagccggcttcgaggcgatcacctgcggcggctatgcctccaccgctgccctgatcggcgagcccgatacctcgcagctgtcgatgcgtgaactggccgatcattatgcccggatctgcgatgcggtcgatgtgccggtctttgccgatgccgataccggtttcggcaatgtcaccaacacccgccgggcggtccgcgcttatgaacaggccggcgttgccgggctgttcatcgaggatcaggtcttccccaagcgctgcggccatatggccggcaaggcggtggtgccggtcgaggatatggtggccaagctgcaggcggcgctggatgcgcggcgcgatccggatctggtgatcatggcccggaccgatgcgctcgccgtcgatgggatcgaggctgcgatcgaccgcgcctgtctctatcgcgagctgggtgccgacatggttttcgtcgaggcgccgcgcacggtggagcagatgcgccggatttgtgcagcggtgcaggcgccgctgctggccaacaacatcgagggcggcttgaccccgatgctgaccgcggcggagcttgaggagatcggctatgccgtggtcacccacccggtggccctgacctatgcggtggccagggccgcgcgcgacctgttcgcgaccttgcgccgcgacggcatcaccacggcctttgccgatcgcatgctcgatttcgacggcttcaaccagctggtcgggctgcccgatcttcgggcgcgcgaacaggcctatctcgaccaggcggcgcgggtgatcgcgggccgcccccatccggatcaggagaccggagaatgaccgatcggtcggacaagccgtccacggggcggcggcgttttctctcagggctcggcgccggtgcggccggcgcggccatgctggccgccggccggccggcagccgccttcacggtagagccggccaccggcacggcaggtgcggtgctggaaaacgcgctcgccgaacagcggcgtcatctggccttccgtgccgaagtgcgtaccgagatggtccggcagggcgccacgcccgagcgcatcgaacaggcgctggcactgatggactgcccgatctgcggcagccggctcggccccgacagcatttcggcactgccggcatcggagcgtggggaggataccgcccgcgggtgaccgcctgccggcaccgtcgacgatgaagctgtttttttatttacatataataatcgttaaataaatattgatttgacgtttcctgacgtgaaatcgtatgaaccgccctgcggaattccggagcgggtccggacgcatgcgggggtatatattcatgacgaatttcggcgtgcatgcggtgatgaccgccgcgctggtggcggcggtgccggcaatggccgccggagatgacgcgatctccgacggcgtgatcaagatcggcgtgctgaacgacatgtccggcatctatgcggacatggccggccgcggctcggtgatcgccgccgaaatggcggccgaagagttcggcggcgcgatccggggcaagccgatcgtgatcgtctcgggcgatcatcagaacaaacccgatgtcggtgtcacacttgtcaatcgctggatcgacgaggaacaggtcgatgtcatcgccgacatcccgacctcgtcggttctgctggcggtgcaagagatcggtcgccagaagaaccggctggtgctggcatcgaccggcggttcgtcggatttcaccggcaaggcctgtgcgcccaccggcatccactggacctatgatacctatggcctggcggtcggcaccggtctgccgctcgcagatcaggggccctggtatttcctgaccgcagactacgccttcggccatgcgctggagcgggatacgactgccgccgttgaagccgcgggcggcaaggtcgtggggggcgtgcgccatccgcagggaacctcggatttctcgtccttcctgcttcaggcgcaggggtcgggggcgcggatgatcggccttgccaatgccggtgccgattcggtgaacgcaatcaagcaggcggcggaattcggcctgtcggcctcgggtctcaaactcgccggactctatctccacatcaccgatatccatgcgatcgggcttgagaccgctcagggcctgatcatgacccaggccttttattgggatctgaacgacgagacccgtgcctggtcggagcgtttcttcgcccgccatggcgccatgccgaccatgggccaggccggcacctattcggcggtccgccactatcttcaggcggtgacggatgccggcaccgatgcgaccgatgcggtgaacgcgcagatgcgcgcgaccccggtgaacgacatgttcgcgaagaacggccatatccggcccgacggccgcgtggtccatgatctctatgtgctggaggtgaagtccccggcggaatcgacccggccctgggattatctgaagctgatccgcacggtgccgggcgatcaggccttccggccgctcgaccagggtgggtgccccctggtcaccggcggggcggccggctgaggccggtcaggaccggccccggccccatcggtcacgatccctgtcccggtcgcgatcccgatcgcggtggtggggccggtcgtcatcccagcgaccatcgccgcggccgtggtcgtcccggtcccgggggcggtggtgatgttcccccggcctcggcccgcgatgcggcggcggcgtcaccacccgcaccggggggcggggcacatagatcacccgtggcggtggcggcggggcatagccgtagcggggcgcatgatagacccgcggcggcggatcgccatatccccagctacgccgttcatggggaacgcaggcgccgagcagcagggccgccgccgcgatggtgatcgcgatggcggccgggccgcccgggcgggatgccggacgggcaggctgtgggtccgacatgggcttgcctcctcaggcaggggcttgctggggcaggggcctgcgggcaccggatcagtcgtcgcggcgctcgcgcaggatgttcagggttttgggatcgatctcaagctcgacgcgctgattgccgcgggcgacggcatcgacctcgatcagcccgtcatcgatgctgacatcggtgatggtcgcgtagccccggtcgctgagcatccgggcaagggccggcagatccagcgcgatgtcggggcggcggtcgtcgtcgtcacggcgctcgcggatgacttcgtagctgcgcggatcgatgcgcagctccacctgcaagccgtcgcgggagacggcttcggccgagatgtggcggcggtcgagatcgacatcggtgatccgggtatagccgcctgccgccagccgttcgcccagcacccgcagatccagttcggcggccggtcgcggaccggggccctcatgcggccggtcatggcgggggccgtgatcgcgatcccgttcggccttctcgcgttccttgccgccccagggcggcgggccgtcggcggggcggacggtgaagctgcggccgtcatcccaggtgatggtggtggcgtcgaaattcgggccggcgatgcggccggtgaccgtcagccggtcgccttccttcacccccacatcgtggtaccagtggggaccggcatggacgagcaccttgccgctcggatcttcgaggacgaaatcattaccccagacacccgtgacactgccatggatggtgatgtcacgatactggtccagctggccgatcggcgtgtcgagcgcccgggccggtgcggcgggcagggtggccgcgatcagccccagggccgcggccccgagggtggctgcggcgatcgggcggcgtcgcgtcgtcctggcggtcatgtcgtcactcctctgcgtctccacacgccggatccggcgcgtctcgatgaagccatcatggcagcccggctctcgccggaaactgaacgatccgttcatgtaccgttcatggaagatcgggcaggatcccgcgcatgcgcgtgatccgtctccaccgccacctgcgccgcatctcgaccgccctggcccttgtcgtgccggtggcgctgaccgttttcgccccgcagccgggccttgccgatccgcccggggatcgccgggcgctgcgcgaagctgtgcgcgaaggtcgggtggtgccgctctcgcgtatcgtcgcctggatcggcgagcgctatcgcggccgggtgatcgaggcggaactcgaacgcgacgacgatgacgacgacgacatgatctatgtcgtcgacctgttgaccgaggccggaaccgtgctgaaattccgcttccgggcctcggacggcgcctttctggaagtcgccggccgggggatcgaggctgcgaggatccgatgagaattctgctcgccgaagacgatgccgagcttgccgaccggctgaagaaggtgctggtcgaggcggggttcacggtcgacatcgccgccgatgggacgctcgccgaatatctgggccagaccgaaacctatgatgcggtggtgctggatctgggcctgccgggcatgaacggggtcagcgtgctgcagcgctggcgcgaggacgggctcgacatgccggtgctgatcctgaccgcacgcggccgctggtcggaaaaacaggccggcttccatgccggtgccgacgactacatgaccaagcccttcgagatgggcgaggtggtgttgcgccttcatgccctgatccgccgggcttcgggccatgcggcggcggatctgcgctgcggctcgctggtgctcgatacccgcgccggccgtttccggatcgacggcgccgggctcgacctcaccgcccaggaataccggctgctcgcctatttgatgcacaatcagggccgggtggtcggccggagcgaaatcgtcgagcatgtctatgaacgcgatgccgatccggactccaacgtcgtcgacgtgctgctcgcccgcatccgccgcaagctcgaccggccgctgatccgcaccgtgcgcggccgcggctgggtgctggaggcgggcgccagttgagcgaggatcccgcctccgcacccccgccccgccgcgcgggatcgatcgcgctccgcctggccgcggcggccctggtttcgaccctgatcgccgtcaccgccggcggttttgcgctctcccatgccttccatcgctcggtcgaggcggcgttcgatcagcggctcgaagccttgcaccgggcgctggtcgcggcgctcagggtggggcgcgatggcgccatcggtctcgaccgcggcctcggcgacccgcgcttcgaccagatcttttcgggctggtactggcaggtggaagaggtcggccaggaaggcatgaccgacgaggtggtgctcgcctcgcgctcgctctgggatcagacgctggatgtcgccggcacccccggctccggcccggccgccgtccgtcagatcgtcgacgggccgaccgaaggcgtgccgctgcgtctggttgcccgcaccatcacgctccccgatcatgacggtccgctggtggtggcggtggcggccgatgcggccgaaatcgggctggagacccggcgtttcgaccgcttgctgatcctgatgctgggcgggctggtgctggtggcgacgttgctgacgctggttcagctgcgctgggggctggcgccgctccggcggctctcgggcgatctggatgcgatccgcgccggccgggcggcccggctcgacgaacagcgcccgcgcgaggtgctgccgctggtccgggcgatgaacggcgtgctcgaccatgatgccgaggtggtgcgcagagcccgcgcccaggcgggcaatctcgcccatgggctcaagaccccgctgaccctgctcgcggccgacatcgccgatctgcccgaggaacggcgcgcggcagcccgccggcagatcgacgccatgcggctgatcgtcgagcaccacctgacccgcgcctctgccgccgccaatgccgcggtgatcggggcgcggacgccggttgcgccggttgccgccgacattgcccgcagtctggagcggatgttcgcccgccgcgatccgccccttgccatcaccgtcgatctggccccggatctcgagtctcgtggcgacctcgacttccgcggcgagcgtcaggatctggaagagatcctgggcaatctgatggagaacgcctgcaaatgggccgccggccgcgtccgggtgagcggcgcggcagccggcgacgacatgctcctgatcctgatcgaggatgacggcccgggcctgacccccgaccaggcccgggcggccctccagcgcgggcggcggctggacgagcgggtgcccggatcggggctcggcctgtccatcgtctcggatgtggtcgagatctatggcggcacgctcgcgctgaccgcgagcgaggaactgggcggtctcgccacccgggtgacgctgccccgggcggaagagaccggccggcgccgccgttgaggcgggctccgctcaggcactgagcgctttcagcacccgttccggcaggaaaggatagtgccgaagccgcacccctccggtgagccgggccacagcgttggcaatcgccggcccgaccggtggcagcccggcctgacccatgccgccgacgggacttcccgccatcgggaccacggccacctcgatgtccggggcctcggacatgcggatcacccggtaggtgtcgaaattcgtttcctgcacctcgccatccacgacgttgatctgttcgaacagcgcctggctggttccgttggtgatcccgaccatgatcatggcttcgatgtggcggggctggatcgccacccccggatcgaccgcacaccagactttgtgcacgcggatcgcgccgctggtccggtcgagcgacacttccgccacctgggcgcaatgagagccgaaggcgtcggaataggcgatgccgagtgcccggccctcccgcgggcgcgtccagcccgacatgcgcgcggcggtctccacgacatggcgggcgcgcggctgatcccgcagaagctccagccggagatcaacgggatcgatctctttcgcggcggcgatttcgtcgatgaagcactcgacaccgaaccgggtgtagccgacccccacggcgaaccagaagccgacatccagaccgttgtcctggcgcagatagtcgattcgatgggtcggcagggcgtagttgacatgggcgccttcggtgacgacgtcgtcatggccgccctggcgctcgaacagctcgggcatggtccgggcgaaaatggaatcggccgcgatccggtggcgccagccgacgatgtttccgtcgcgatccagcccggcctgcaggtgctgtgccgcgagaggccggtacttgtcgtggcggatatcgtcttcccggctccagatcaccttgaccgggcggccctccacgtctcgggcgagcgacactgcgtcgaggatgaaatccgcctccgccttgcggccgaagcctccgccgagcagggtggtgtgcaccgtcaccttgtcgggcgtggtgccgatcaccccggccgcaaagtgctgggtgccggtcggcccctgggtcggggcccagatctccaccctgtcgcccatgaccagagccgtggcgttcatcggctccatggtcgcatgggccacatggtcgctcatgtagtcggcctcgatcaccgttgccgcgccggcaatcgcggacgcggcatcgccttctgaatatgcggtcacgccgtcccggccgatatccccggcggtcatgcggtagtcttcgatcagtctgtcgctggtgtagcgacgcacccgcgacgatgtgctccaggtgaccttgaggaggtccttggcccgtttcgtcgcctccaccgtctcaccgatgatcccgacgccgtaagagagcggcaggatgcgtatgatcccggtcacggccctggcctccgcgtcgtcgatcgcctctggccgctcgccctggacgggcgggcgcagcacggcaccgtacagcatctccggacgctggatgtccatgccatagatcgcgcggccgtcgactttcgaggggacgtcgatgcgcagaatgtctcgtctgccgatatagcgccactgcccggccggcttcagatcggccgccgtcgcctgcgggagcggatcggggagcgtggcggtcgcggcgatctccccatagccgagctttcggccggatggccggtggacgacctggcctggtccggtgatcagttcgcttgccggcaccctgagcaatccggccgcggaggccaggatgatcttgcgggtctgtgcgccggccagccggagcagatcgtaatagccacgtgtggattcgctgccgccggtgagctggatgccgtagaagccgggattgccgtatgtctccgcatcggacggggcctggacgatgcggaccctgtcccaatcggcatccatctcttcggcgatcagcagcggcagcgtggtcatgatgccctggcccatttccgaggcgggcgacatgatgctcacgatcccgtcggcagcgatggtcacccaggcattcggtcggaagtcacctgtcgctgcccgcgccatgacggcgcccagggccggccgcagaaggtcgccgaacgcgacgccgatgccgaggttgccggccgtgaccagaaagctccgccgggacatcgggcggacgtgcagatgacgtgtctcatccatcgatcatgcctcccgtgcagcgcgctgaatggcgctgatgatccgcagataggtgccgcatcgacagatgttgccgtccatgtgctcgacgatctggtcgcgtgtgggatgtgcattgcgtcgcagaagggctgccgcctgcatgatctgtccggactggcagtagccgcattgcggcacctgttcggcgatccaggccttctgcagcggatgggaggcgtcgggggacagcccctcgatcgtcgtcacctcgcggcccgcgacgtcttcgagccaggttacgcaggaccgtgccggctcaccgtcgacatgaacggtgcaggcgccgcattgggcgatcccgcagccgaaccgggtgccggtgagcttcagatgctcgcggatcacccagaggagcgacgtgtccggtgcggcatcgacatcgaccgggcgtccgttgatcgtgaatgctgtcatcaaagcctctcctttacgaagctcacctccgcagctgtcttcacgatagaaatcgaggatggggcaggctatgcgcccgaatccgttttatctgcgcaatcgtccgaatggccccggagccagaacaggggtggcagaccatggaaattcgcggccggaacgattagcttcggttcatcccgatactggtacccggtcttgatgagtgtccggaggacccatggatccgctctcggatgtgctgtcgattctgaaaccgcgccgccacatgtctgccggcttcgatgcgggcggcgactggtcggtcagattctccggtcaggagggcagcatcaaatgcggtgccgtcgtctccggcgattgctggctggcggtcgatggcgtggcggcaccatcctgtctggcggccggtgacggctttctgctgcctcgcgggcggcccttcattctgacgagcgaccccgctttgccgccggtggatgccaagcccctgatcgcccatgcaagggatggcgggatcgtcacctgcaatggcggtggggatacgatgctgatcagcagccggttttcgctcgacggcgaccatgcggcgctgttgatgcgccaactgccaccggtcgttcatctccggaaaagggcggatcgggtggcgctgcgttggtgcgtcatgcagatgatgcaggagttgcaggatccccggccgggcggccttctgctgctccagcatcttgcccacatgatgctggttcaggccctgcgcctgcatctgtcggaaaggggggaggggggtgtcggatggtttgccgccctgaccgaccggcagatcggcaaggcggtcgcggcgatacacgacgatcccgggcatcgctggaccttgccggcgctggcgcagtgtgccggcatgtcgcgatcgaccttcgcgcagcggttcagggacctggccggaatggcgcccatggactatgtgacgcgctggcggatgctgctggcgggcgaccggctggaggccgggagcgaccccgtttccgttattgccctgtcgctgggctatgaatcggaaagcgccttcagcaccgccttcaagcgggtcatgggctgtgcgccccggcaatacgggcgccgccgcaacggcgagcgcccgtcggatgacgatctgctgacggcaaccagttagggatcagaccagccggtcgcgcccgctccagaagcggtcgcggaccgcgcgtttcaggatcttgcccaccgggctgcgcggcagggcctcttcgaacagcaccgatttgggcgtcttgaccgggccgagcttcgaccggcaaagggcgatcagctcttccgccgtgacctcggcgccgggaacgggctcgaccaccgcggtcacggcctcgccccatttcgggtcggggacgccgatcacgacgcagttctgcacggcggcatgaccctggatcacgttttcgacctcggccgaatagacgttgaagccgccggtgatgatcatgtccttcttgcggtcgacgatgtagacgaaaccatccgcatccatccagccgacatcgccggtatggtgccagccgaactggctgacttccgccgtcgcctcggggcgcttgtgatagccggccatcaccagatcaccgcggaccacgatctcgccccgctcaccccggggcaggacgttgccgtcgtcatccatgatctcgacccgggtcagcagggtcgggcggccgcaggaagcgaggcggtggacgagggcgggatcggctgccgccgccgcatgctcggcgggcgacaggaaggtgcagagcatcggcgcttcggcctggccataggtctgggccatcaccgggccgaaaaccctgatcgcctcggcaagcttgtcgggcgccatgggcgaggcggcatagatgaaatggcggagcgagccgtagtcgaagtcgcgcagccgcggatggccgagcatgccgtagatcacggtcggcggcaggaacaggtcggtgaccttctcgcggtcgatcgcctccatcacctccagcggatcggcgcgctcgatgatcaccacccgggcgccggcggcaagcgccggaaaagccatggcgcccgcggcatgggtcatcggggccgcgaccagatagaccggccggtcggccggcggcatggcggcatgggtgatggcgatcagggccgtccacaccccctcggtcagccgcacggccttggagcggccggtggtaccgccggtggggaagagggcggccagacggttcgggtcggggcggagatccgggaccggcagcccctccgcctggttcagcagatcatcgagcgacagcacaccgtcgagcgggccgtcgatgcagatcacgtcttcgagcgtcggtaccgtctcgcggatccgcggcaggtagccggcgaagcttgaatggatgaacagcgtccggcagtcggcggtgtcgagaaagtcgatattgtcgtcggcatggccgcgggcattgatcggggcccagacaccacccgccctcacgccgccgagcaggcaggcgaaggcgagcgcgtgattggggctccagaccgcgacggtgccgaccgccgccggatcgccgcccgcccgggcgaccagggcggcggcgatccggcaggtgagggtgcgggcttcggtataggtgaggctgtgtccggccgagaccagggcctcacgatcgggagcgatggccgccccccgatcgaaaaaatcgatgatgcgcaaggggcggttccttcccggttttttattgggagcctggttcctgttgtgaaaccagcatcacttgaccagagggcagccacccttgtcgagcgggcggaaggcctcgtcgcccggaatggcgcgcaccaccttgaacacgtcgccgcgggtcttcgattccgacgacggcttcacctcggtcagcagcatgtcgtggatcatcagcccgtcggcgcggaccttgccgcccttcacgaacagatcctcgaccggcatctcgcgcatcttggccgcgacctgatcgcgggcatcggtgccggcggcctcgacggccttcagatagtggttcaccgccgaatagacgccgatctgcagcgaggtcggccaggtgccgtgcagcttggcgaagcgctcaccgaaagcctgggtctcggcattcaggctcgcctcatagccgttgatcgcggtcaggcccttgaggtcgtcggcgccgatcgcgagcacgtcggtgttgaagaacagcatggcgaccatcttctgacccgagtcggcgagaccgaactccttcgcctgcttgagcgcgttgaccgtgtcgccgccggcattgatcagcgccacggtgttggcgcccgagccctgggcctgcagcaggtaggacgagaagtccggcgtgttcagcggatgcttgaccgagcccgcgatcttgcccccggcctcggtgatcgccttggtcagatcgccggccagagcctcgccgaaggcatagtcgacctggaccaggaaccagttgtcgccgccttccgcgaccgtcgcacggcccagcgcattggcgaccgaataggtgtcgtagctccactggaagccgtagggcgagcaggcctcaccggtgaatttcgacacgccgccacccgaggagaccaggatgccgtccttgttgcggacgatttcctgcagcgccagcagcacgcctgaattgggcacgtcgaagatggcgtccacaccctcgacatccagccagcggttcacggtcgacgagccgatatcggccttgttctggtggtcggccgagacgatctcgacgtccttgcccagcgccttgccgccgaaatcctccaccgccatgcgggccgcgaccacggcgccttcgccggtggcgtcggaataggggccggagcggtcgttcaggatgccgatcttcacggcaccatcggcaccggccatggccggggcggcgagggcgaggctggcggtgctggcgagcagggccgcggccatcaggcgggtcagtggggtcttgagcgcgatcatccttgggatcctcccgggggtcggtggcctctgcggtcttgcatgccgcatcggtcggttctggatgagagactatcagctgatcatagtaacacaatattattgtgctatttggtttgaaacatggctcgcttgaccccggcccctggcgggacgcaggatgtttcaaagcccccagccggagccccgatgtcagacaccccgcgagacccgtccagcccggacctgccgaagcgcgcgccgctcggcgatctggcggatgcgaccgccgccgcccatcgggtcgcgcagctgtttttcttcgcccatcgcggcttcaccggcgatgccgacagcttcctgcgcgagcacggacttggccgcgcccattaccgggtgctgtatttcgcggcccggctgccggggatcacggtgggggagctgctcgacatcctggggatcacggcgcagggcgtggcccgggtgctgaaccggctgctcgatgacgggctgttgcgccaggagaccgaccgcggcgaccggcggcggcggcggctctatctcaccgaggccggcatccggatggagcgggccgcctttgcctgtcaggaagcggtgatttcggccgcgatccgcgcggcggggccgcgccatgccgatgatttctcgaccatcatgatggcgctggcccgggccgaagaccggccgcttctggcgcgggtgatggcggcaaccggggagggtgacggcggcagctgagcgccggtcagcggcagatgctccagcggcccatgtccagatggaaatggtcgcgatgggccgcgttgtagtcggggccgagcacgccgcgaaaggcctcgcaggcaccgtcgcgcagctcgcgcaggaaggcgcgcttgcgggcgtcgtcgcccgaccagtcccgggcgagactgatgcgcgtgccatcggccagcaccacgcctgagatgtcgatggcattggcggtggcatgctggctgggggtgctgccgccacgaacggcgcggcaggcataggtgcccagatgatcgacctgcgcaacccggctcgcgaaatgccggcgggcggcgggttgcagaacatggcgatcgaagatcgaccaggcgaccatcagcggacagctggcggtaaagcccgacgagaagcgcaggccctctgcgccgctgacccggacggcattctcgaagccgcaggtcgctgctgtcttgcggtcgggaaccgtgctgaagcgcaggggcgctgtctccagcacggccagacactggtctggggcatccttgagctgcgcgatcttccagcgggtgagcaggttgggcgcatcggcaatgaccggcggcgcgaaggggttccagcgatccggaatccggatcagcccgccggcgagagcaaggccgccgccgacgaggccgaggatcagggcaagcagggtcaggcgtgcaggtcgcatgacctgtcagataggacgctggtctccgcgaccaagccgggtcacggatcggtcacgcagcggctgtggccacgaccggaatgttgtcgatcaggcgggtgctgcccaggcgggcggcgaccagcagccgtgccggacggcccgataccggtgcccggtcgagtggcgccagggtctcggcatccaccagcgccagatactcgatcctgccatagccgagatccgccagccgcgcacgcccccgggcgagggcgttgccgatgggatcgtcgtcatccggatcggcacccagaatggcggcggccgtgtcgtgcagcacgcagttcagcgcctcggctgccgggcgctcacgggcgtcgagatagacattgcgcgacgaccgggcgagacccgatggctcgcggctggtgggggcgcccacgatctccaccgggatgtcgagatccgtcaccatctgccggatcacctgcaattgctgccagtccttctcgccgaacacggccacgtccggcccgcagccgatcagcagctttgcgaccactgtcgccatgccgtcgaaatggccggggcgccagggaccgcacagcccctcggtcaaccggtcgacatgcacggtggtggcggcgtcggggcggtacatgtcaccgaccgccggcatccaggcaagatcgacgccccgcgccgccagccgggccagatcgccggcttcgtcgcgcgggtagcggtcgaaatcctctccgggggcaaactgcgtggggttgacgaagatgctgaccaccacccggtcggcccgggcgcgggcgatgtcgatcaggctcagatggccgtcatgcagggcacccatcgtcggcaccagggcgatgcgtgcaccctgggcgcgccagcgcagcacccggccgcgcagatcggcgcgatcgcgaacgacatcgatggcggagggcgatgcagcagcgagggagggcgaggacatggcggcggcggtctcctctggcgatcatggcggcgcctctattcgggaagggggggcgcgtgaccggcaagctaacctgttgcggtgcagcacgccagttgttttccaggatcggatacttccatccatcaacagggaacatgctctgcccgtgagaggcattgcgcagcaggcgcaaagcgttcagcattcaatttatcatgggttgaatgtcatccccaggtcatgaaggtctcgtccatgccggggtcgtcttccgccggttccacgcctgctgtcgctgcaccgcccgcgggtgccgttccacgccatgccctgcggctgctgggggcggctgtggcggtgatcggggcaggccaggccatccaggtcgccatcgtgcccgggctgatcgccgccaccggcatcgatgcggccacgctcggcctgctggtggccctgggcgtactgcccttcatggtcggcgcaccgctctgggggcggctgagcgaccggttcggccgcagacccgtgctgctggcggggctggtcggggccgccctggcccatgccctgttcgcgggcgccgccgatcttctggccgcagggcgcatcagccacgggaccggccttggggtgatgatcgtctcgcggctgatcttcggcgtggcgggctcggccatctacccggtcggtcaggcctgggcggtggatctggcagggcccgagcggcgcctggcggcagccggcgcgctggccgcgggcttgagcgtcggccgcctggccgggccggcggtggcgctggccctgctgatggtcgggccggtggcgccgctctgggggctgtcggcgatcggtgccggctcggccgtgctggtcgtggtcgggctgggcggcgccgccgctgcggccggacgctgcggtgcggccgtcgcagccgggcgcccgccccgggcggccgagggcatgatgcggccttttctggtggtcggcatcggcaccttcgccatgggcatgatgcagttcgtgttcggcctgcatgccatggcccggctcgacatggcggcgcccgcggcctcgcagctggtggcgatcgtcatggcggtggcggctgtggtgatgctgggggtccagaccctcgtcctgccgcggcttgggtcccgtccggcactggcggcgcgcgcctgggcggctggcctggcgctgctgccggtgtcgatcgcgctcggctggtggggcggtgcatggtgggcctttgtggcctcggcgatgctgaccggcgccgggatggcggtggtggtggcgatgctcttcgcccgcgtcaccgccgatccccgcctgcgtggtacccgcgccggcctgctgaattcagcccagaccgcaggctatgccgcgggatcggccgtgggcgggctttatgccgcaggggcggcgctgcccttcgggcttgcgcttggggccctgctggtggcggtgatggccggctggcgtctgccggcccgcccgatctgatccttattcaccgacgaagcggcagacgaagcccggcacttcgggggtgaaggcgatggtcgcgtcgatgtcgcaggctgcagccgcgatattgcccgccgccgtccagtcgggataagcggcgtaggtccggtcggccttggcggccccggccggggcattggcggcataggggacgtagccgcgcaggggattgccggccttgcaggtccgcgccagaagcttgcggaccgccgcggcgaaatcgccatcctgcgcggcgccgcgtgtggcgagcgcgttggtgcggtccacatccacccagcagaccggatcggcggcctggccttcggccgtcagggcgaagaggctggtggcgacacctgcggccagcacgatctggcgcaggaggtgtggcatggggcgcatgggatctccgcaatggctcgatagggcccgccccgtctccggggcgggcgggcaggtcaggcggcgtcggccctggcagtgatgcccagccggtcgcgcacggccggggtggcaaggcaggcctcggcggcctcgtaccccttggtggtcatatggccggtgaagaaggcctgatggacatcatgctcgtggaagtggtgcggtgtcagcaccaccgaaaacaccggcatgccggtgtcgagctgaacgcgcatcagcccctcgatcaccgcgcgggcgacgaagtcgtggcggtagatgccgccatcgaccacgaagcccaccgcgatgacggccacatgccggccggcttccgcgatgcgcttggcctccagcgggatttcgaaggcgccgggcaggtcgattacgtcgatggcgtcggcggggatgccgcgttcggccatgcgggctacaaagccgtcgacggcgcggtcgaccagttcggcatgccagcgcgcccgcaacacggcgaaacgcggcgcgaccttgccgtcctggcggatggtggtgggggtcgtctgactgatctgattcatggcggtcctcatcgggataccggtttgccagaatcagggcgcacggggaaacgcccccttggccgtacgggcggtcggggcacacaggtgcaacgccgcccgtcccaccggggacgcgcctctccgttctcttccatccggactgtaaccgtcggctccggcatcgcaccggatctgctgaccccgccatcggttccggccgaccggccttgaacctctggcgggcgctcgcgggctcgcaaccgggcctgggcccgcttgcataccgccggtggggacttccaccccgccccgagaacgtatcgcccgcaacccgccttgcggaaggacgcggaccgcctcaccatacgcgcgccctgccgtttgcggcaacagcttccgatcacgccgccggagacgccttcagatgccggaaacccagccccgccgctatgccctgctcgatcgcgacggcaccatcaatctcgacaccggctatctggccgatccggccgggttcgagctgctgcccggggcgctggcgggcctgaagcggcttgtcgccgccggtttcggcctggtggtggtgaccaaccagtcgggcatcgcccgcggcctgatcaggcccgaggcgctggaggcgatccacgagcggatgtgccagcttctggcaccgcacggcatccgcttcgatgcgatcgagatctgcccccacgggcccgaggagggctgcgactgccgcaagccgtcgcccggcatggtgcggcgtgcggcggcacggctgggtttcgatccgacccgggcggtggtcttcggcgacaagccgtcggatatgggcctcgcccgggcggtgggggccatggccgtgctgatcggggacgaggcggcggcaggggcgtccgagccggcacccgatctctgggcgccggatctggatgcggcggcgcgtctggtgatcgacggcacgcccccggcctgacctcagcggccgatgaaccggggcgcgcgcttctcgacgaaggcctgcgccgcctcgcggtggtcggcgctttccgaacagcgggtgtgctggatcgcttccagatccatcacctccgacagcgtgccggtctgtgccaggttcatattgcgcttgatggcggcataggtcagcgccggcccacgggcaagcgtctcggccgtcatgcgagtctgggcctccagggcctcggcgtcgaccacccggttgaccaggcccagcttctcggccgcggccatgtcgagcagttcggcggtcaggtaaagctcccgcgccttggccgggccgacgagttgggtcaggaaccaactgccgccgaaatcgcccgacagcgccaccttggcgaaagcggtggtcatcacggcggtgcgggcggcgatgcgcatgtcgcaggccagtgccagcgacaggccggcaccagctgcggggccgggcagggccgcgatggtcggcttgcccatctcgtgcagccagcgcgacgcttccatgacctggcgcagttccgtggcccggcgctcgctcgacttcgcggcttcggcctcggcggtttccgccatgcgcttgacgtcgcccccggcgcagaaggcgccgccggcaccggtcagcaccaccacacgaacctcatcgtcggcggcgagccgggtgagggccgagaccagtgcggccagcatgggccgcgacatggcattgcgccgttccggccggttgagcgtcagccaggcgacgccgttttcgatgcgttcgagcagttccgacatggggttcctccaccagccgtgccggcgcagctggccggctggtcatgatgattttgagcgatgcgccggtccaagcttagcccggcaccgcggggcgggacatgctgcggcaatgcgggtccgccatgcgaagtatgactgcatacactgagatgacataacgccgttactaaaccgttccgcgattattatagaatcatgatgcgttgtagtggtcgttcgactatcgtagatagataagaagtgctgcagaacgagacggatggtagcgaggtgccagcttccagcagccccgtgaggaagctggacgtatccccccgaaccgtgctctgacgcatgaggcgcccgagatggttcgaccggcccccgcccggagatccgccagggaggatgttccatgaaacgggtacttctcaccacggcgcccaaggaggcgctggtggagatgaacggtatcggcggcaactggtacgatcgcaccgatacttacatggcctggacctgcgccaacgacctcgccgaccgcctgtcggtgacctgcccccccaccggtctgaacttcctgaaggccaatgtgccggatgtcgaggttctggaatatcccacctgggccgaatacgaaaaggcgctcggctccgagcagtgggacatggtgggcatcagcttctacacctggtctgtgccggtcgcgatccagatggcgaaactcgcccgagactacggggtgaaagaagtctggggcggcaattacggcgcgatcacgcccggaatccagccgcatttcgaccggctgatcaaggggccgggcgaatacgtgctgcatcaatacgtctacgggcggccgctggagcacgtcacccatccgccgatgatgggcgagtcgagcttccgcggcgtgagttcgaaggtcggctatctctacagcaagcgcggctgcaacatcggctgcaccttctgctcgacgccggtgttcaatccgaaggaagacgcgatcttcatggaggacatggagtacgcgctcgacacctataaggagaacagcgtcgcccatgtcatcatctacgacgagtcgttcttcctgaagaacgacatcgccgagcgggtggtcgacgggctggccaagcgcggcctcggctggatctgcctgacgcgtgccgatctgctgcgcggccggatttcggaactcaccgatcgctgcatggatggcgcgatcatcggcatcgaaagctatcgcgacaagaacatcgccgacgtgcagaagcgcgacgacgtctacaacgtccgcgccaccgtccgcgagctgatcaagaacggccgccgtgccctcggcaccttcatggtcggcttccaggacgacagcatcgaagacatggaatacgacatcacccagctggccgacgaggggctgttcgcctgccagctgaccctgctcacgcccttccacggcaccaagctgtggaagcagatggagcatctggtgaacgagccggacctgtcgaaattcgacctctacaacctggtctggaagcaccccaagatgtcgccgtcagaggcccgcgacctgatggcctgggcccagcgcaaggtgaacgaccccggcgtcgtggcgcagaagatcaagcaggacatgaaggaaaagctgcgccgcgaaatggcggccaagcgcggacagctgccgatcggcagccggccgtcgcggctgggcggtggcatggccgccggcgccttcgcggcccccgagcgctgaccggcgcccggaccacctgttccgtctgctgccgaaacgcccggtaccatccgtctgccgcccgcccaccgcaagggcgggcggcgacgggggacctgtccaagggaccgtccgatgagcgcgctcaagattctggccattcagctcggcttccatcccgactatccggatgtgtcgacgctcgccaccacctacaatgacggcatctattacgtcgcctccttcgtcgccgatcagctccccgaggcacagctggacatgtgccagatgttctggggggagaacccggccgattttccgctggagagctacgacgtcattctggtctcggcgctcgccacccatttctggtccaacatcccgacccttgagacgatcgcccggcggcggcgcaaggactcgctcatgatcatgggcgggccgcatgcggctttcgccccgcacgaggcgctgaaatatgccgatgtggcggtgatcggcgagggcgaactgccgacgctggagttgatcgcccgtcgcgccgtgggcggcgtcggcggcccgatcgacgacattccgaacatcgcctggatcggcgacgacggccggctcgccatttccgacgtgaagcggttcgagaaggtctccaccgccatccgcccggagctgctggcgcgggcgccgcggctgcactgggcgacggtgtcgatgtcgcgcggctgccccttcgactgctcgttctgctacgccatccgcctgctgggccggcggttccggaccaagaccgtgcccgatatcgtggccgagctggacggcatccatgcccagaccggctgtacccggttctatgtcaccgatctcaacttcaccacccggcgcgatttctgtcatcaggtggctcaggcggtgcgcgaccggccctacaagttcatctcgatgagccggatcaaccatgccgacgacatggatctggtgctggagatgaaggcctcgggcttcgacgagtattgcctgggcgtggaatccgaagatccgggcgtgctgcgtgccttcaacaagaaggtcgatgccagcgagcagaccgagcgcctctggcgattcgccgagaacgacgtctacatccattcggcgatcatcttcgggctggaagcccaggatcagggcgccatccgccgcaccgcccggtggtgcgccgatgcccggatcgtgcatccgaccttcgtttgcctggccgaatatccgttccagaacctgctgttcggtgcgcgccaggacatcgaggaccaccggatcatcatggaggttccgacctatcagcactattccttcgtcggcatcttcccgcgccacatgcgcccctccgacctgcagcgggcgatcctcgacagctatgacgtgttcttcgagcgcgccttcgaggtcgagacccggccgcagcggcggatgcgtctgaaatcctatcagcgcagcgttgcccagagccgtggcggcatggaacgccatatcggcttcctcgagaatctggagacgccctactacacccgcgagggcacgctgaaagaggatctgctgctgggggatttcgaggcccggcacggtgccacccgtgactggctggcccagtcggcccgtggggccgagccggccttcgccaaggcctatgcccgctgagccgcggaggcgtgcccgagatgaccatggcgacctctcctgcggacccgcatttccgtagtttccatgacgcgttgcctgcggccaccacctgggaggcggtggcccgtggggccgagaccgccccccatggcttcgccttgcgcgtgatcgaacgcggcggcgccgaggcggtgctgacgcgcggcgatcttgcgacgctcgccgccgccggcgcccgggctctggcggcggccggcatcgcggccggtgatcgcatcgtgctggcgctgccggcctcgcggctgttcctggcgctgcatctgggcgccggtgcgatcggtgccctgccggtggtcgtggccccgcccgccgtgccggtgccggatcccgcccgcgcccatctggccgatatcgcccgcagggcgggcgcccggctgctgatcgccgaggcggaaccggccgcggcactcgatggcctggaggcgcaggcccccggattgacggttgccgcggccgaccggctgctggcggcggggctgcgtgcagccctgccggcgatgaccgccgatccccgcggcatttcgcatcttcagcagacatcgggatcgaccggagcacccaagctcgcggtggtgcatcacgaccggctctcggccaatctcgcccagatcgcggcggcgatctgccgggggcccgagggtgtgggtggcgatgttctggtctcgtggctgccgctctcccacgatatggggctggtcgggctcaattatgcgctccgttggggcgtgcccatggtgctggccgataccggcgagttcgtccgcaatccgatgaactggccggcctggatgtcgcggcacaaggggacgctgtcgccggcgcccaacagtgctttccagatgtgcgcgcgcctcgcccggctgcgcccgccgcgcgggctggacctctcggcctggcgggtggcgctgtgcggggcggaaccggttcatgcccgcaccctgcaggatttcagcgccgccttcggcagccacggtttcgcgcccgagaccctgcgcccggtctatggcctggccgaggcgacgctggcggtggcgatcccgccggtgggtggctgcgtgaccgacccggtcgatgccgaccggctggcggccgaaggggtggccgcaccggcgggagacgaagccgggcgccggctccatgccgtcaccttggggccggccgtgccgggggctgcgatccgcatcaccgcgcccgacggcactgaactgcccgaacgccgggtcggcgagatcgaggtcgccagccccgcgaccgtcggtggctattggcaggatccggccgaaagcgcccggctgacccggcctgacggctggctgcgcacgggcgatctgggctatctggccgatggccggctgcatgtcaccggccgggccaaggatctgctgatcctgggcgggcgcaatttcacgcctgcccagatcgaagatgtggccgaagccgcggccgatgccgcgatcacgcccgcggtcatcgcggtcggcctcaccgacgagaccatcggcaccgaaaccctgcatctgctgctcgacacccgcctcggccccgaagaggcgcgtcccgccattgcccagcgcatccgcgatgccctggcggaggctttcggcctgaccggcatcggcacgcattggatcgccgccggcctggtgccgcgcacccccagcggcaaggttcagcgcttccgctgccgcgagatcgtggcagcgcgcctggcggaccgtcaggccgcggcctcaaaaaacaagacgacacccgccccagggaggatcaccggatgaatgcgcccaaggatatggccgccgcagaggccgccgccgtggtttcctccgtggccgagccggtcgccatcatcggcatcggctgccgtctgccgggcggtgcctccagcccggcggccttctggtcgctgctccgcaaccgggtggatgccatccgcgaggtgccctccgatcgctggaacgcggccctgttccaccatcctgatccggcctcccgtcccggcaccgtcggcacccgcatgggcggtttcctggacggcatcgaccgcttcgacccaggcttcttcggcatctcgccgcgcgaggcgcagctgatggatccccagcagcgcctgctgctcgaatcggccgtcgacgccctcgacgatgccgggctgaagcttgaagacatcgacggcacggatgtcggcgtgttcatcggcatcgcggcctatgactatgccgaaatccagcacggcatggccaatcgcgagctgatttccggccacaccaataccggcctcgcgctttcgatcgccgccaaccgcatctcgtatcttctgaacctcaaggggccgagcgttgcggtcgacaccgcctgttcctcgtctctggtcgccctccacctcgcctgtcagtcgctgcgatcaggcgaaagccgggcggcgatcgtgggcggggtcaatgcgatcctgaagccggagccgaccatcggcttcagccgcgcttcgatgctggcgccggatggccgctgcaagaccttcgatgcccgcgccaacggctatacccgcggcgagggcgccggcatcgtcgtgctgaagccgctctcggccgcgcttgccgacggcgatccggtctatggcgtgatcaaggccacggtcgtcaaccaggacggccataccaacggcatgaccgtgccgggcgaggatgcccaggcgcgcatgctggagaccgcctatgcccgggccggcatcgtgcctggcacgctgcaatacatggaagcccatggcaccggcacgccggtcggcgacccgatcgaggcccgcgcgctcggccgcgtgctctctcagggccggccggatggcgatcgctgcctggtcgggtcggtgaagaccaatatcggccatctggaggcggcggcgggcattgccgggctgatcaaggcgacgctcgcccttcatcaccggcatgtgccctcgaacctgaatttcgagagccccaaccccgagatcgatttcgatgggctgaagctcgaggtcgcgagcagcgaccggccctggccggataacggccatccgccccgcgcgggcgtcaattcctttggattcggcggcaccaacgcccatgcggtgctggaagcggcacccgccgaagccgtgcgcccggccctgtcggacgagggggcgcctggcatcgcctccgatgccggcaggaccggcgcacccgtcctgatcccggtctcggcccgcagcgccgaggcgctggccgaggccgcccgccacctggcggaggcgttgaccgacgaggcacagccggcccggcaccggccgctcgcggaggtcgccgcctgggcgggcacccggcgcagccagcacgatcaccggctcgctgtcgtggcggccgaccatgccgaggcggcggaacggctgcgcgatgccgctgccggcaccgccggccccggcatcatcgccggccgcggccgggcccgttctgcgcccggcaacccggtctatgtcttctcgggcatgggcccgcaatggtgggcgatgggccgccagctgatcgagcgcgaacccctgttccgggtcgcgatcgaggaatgcgatgcccatctgcgcgcggccggcgcgccctggtcgctgatggacgagatgtgccgcgacgaggcacagagcctgatggccgagacctatatctcgcagccctcgaacttcgctcttcaggtcggcctcgcccggctctggagccattggggcatccggcccgcggccatcgtcggccattcgaccggcgaggcggccgccgcacatgtcgccggccagctggacctcgccaccgcctgcaccgtgatctatcaccgctcacgcgtgcagcagcgggccagcggcaagggccgcatgctggcggcggcgctgaccgaggccgaggcgctggagcggatcgcccccgtggccgaccgggtgtcgatcgcggccatgaacggccccggcatcctgacgctcgcgggcgatgccgaaccgctggaggccatcgcggcgggccttgccgcagaggggcggttcaaccgcttcctgaccgtggccgtgcccttccacagccaccacatggatccgctgcgcgaggatctggaagcctcgctcgccgcgatccggccggctgcggcggacctgccgctctattccaccgtcaccggcgatctggcggaggatctgccctatgacgccgcctattggtggcgcaatgtccgccagccggtgcgcttcgccgatgcgatccgcagcctgatccgcgacggccatcgaaccttcctggaggtcgggccgcatccggtcatctcatcctcgatcgacgataccgcgggcgagctgggcgagcgggtgatgacggcgcattcgctccgccgccagacggaagagcgtgcggttctgctcggcaatctgggccagctctatgccgccggccaccgggtcgactggcaggcggtctcgggcgtcgaccggctgcggccggtccggctgccggcctatccctggcaggacaagcgctactggcaggaggtggcggagagcctggacggccgcgccggcctgcctgcccatcccttcatcggccggcggatcgccgctggcctgccgctctacgagatccgcatcgatctggagcggctgccttatctcgccgaccatgccgtcggcggctcggtgctcttccccggtgccggtttcatcgaagcggcgcttgcggcctggaccgcggccatgggcgccgtgccggccgcggtcgaggatgtgcgcttcctgaaggccctgatcctgggggccgatcgggcggtgaagctgcaggtggcgctcgatcccgccagcggtggcgcgcgcgtcctctcccggccgctgggtgaggacgaggcgccgtggacgctgcacgcgtccatgacgctgaaggctcagggggcgctcccggctcaggccgtggacctggcggcagcagcggcccgctgcattgacgtcgtggaggatcgtggctacggcgccttcgcggcccgcgggctgaattacggcccggccttccaggccatcgcggcgctgtcgcgcgggccggccgaggcgctggcccggctgaccctgccggccgcggcgcgggcgggcgacggcgcgccggatgccgcgggcggctatctcttccatccctcgctgctggatgcctgtttccaggcggtgctgggcgcgatcgacagccgcagcgcggccgccggtgcctatctgccggtggcggtggagcggctcaggctgtcggggccgatcgacgacggtgccgaactccacgcccatgcccggctgctgacgctgaattccaggcagctggatgccgatatccgtctgaccgatgcggcgggtcgggtgctggccgaggtgcagggcttctcgtgcatggcgctggatcaggccgagggcggccgcggcgccggccgcgacatcgaccgccggctgttcgccgagcattgggtggagcaggcggcgggcgtcgtggcggcggatctgcccgatccggccgatctggtcgacgaaacccggccgatggtgctgccgctgatccgcaagctcgaccgcgccggctattatgccgaggcgcagccgctgctcgaccggctgaccgccgcctatgccgcccgcgccttcgccgagctgggcatcgacgccgatgcgcccgatccggcgcgggtcgatcccgttcatcaccggctgctggcacggctggcccaggtggtcagggccgagacggcgacgggcccgttgcccgagcccgaggtgctgggcgccgagatcgaccgccgtcatgccgggcttgcgcctgagatggtgctgatccgccgctgcggcgaagcgctggcccgggtgctgaccggggcgcaggatccgctggatctgatcttccccgacgggtcgcaggtcgatgccgaacgggtctatcgcgacagcccgagcttcggcacctataaccgcatcctggaacaggcggtccgcgccctgatcgaccggctgccggccgaccggccgctcaggatcctggagatcggtgccggcaccggcgccaccgccgcccatctgctgccggtgctgccggccagccgcaccgattatgtcttcaccgacatttccaccgccttcaccaccaaggccgagcagaagttccgcgccttcgattttgtccgctaccgcctgctcgacatcgagaaggagccggcggcccagggcttcgcgccggcgagcttcgacctggtggtggcgaccgacgcgcttcacgcgacccgggcgatcgacaccgcaattgcccatgccgccggtctgctccgtccgggcgggttgatggcgctggtcgagctgaccgcgccgccgccctggttcgatctggtcttcggcatgctcaagggctggtgggccttcgacgacgccggaacccgtcccgatcatgcctgcatgaccctgccggcctgggaagcggcgctcatgcgcgccggctgcccggcggtggcggcgctcgacgaccgcgaggatggcggggcgaccgttcacagcgtcatcctggcccggcggtcgaccaccgagaccgcccggactaccggcgaggcgccggcggccgagaccgacgagttggatgctctgctggggctcagcaccatcacccgggcaaagcccggctggctggtgctggccgatggtcgtggtgtcggtgcggcggttgccgcagcgcttgaggcgcgcggccatcccgtgagcaccgtgacggccggcgaggttgccgacatccgtggcctggtggaccgggcgctgatggatctgcccgaggtgggcggcatcctgcatctctggtcgctcgatgccggcccgaccgaagcggccgacatgacggccgtggaggcacgtggtgctgcggtcctgatggagctggtccaggcggtgaccgatccgagtttcggcaatccgccacgcctggtgctggcgacttcgggtgcccggcgggtgcggcccgacgatccggcccccgaggctgcccaggcgccggcctggggcttcgcccgggtgctgaccaacgagcatccggaactggggacggtgatggtcgacctgccggccgccgtctcgtccgacagggccgacgagatcgaggcactggcccggatctgcgccgagggggccggcgacgagaccgagatcgcgcttcgcggcgcgcggacccatgtcgcccgcatccgggccgagacgctggacgggctccgccgccgggcgctcgaccccaggccggcggcggcggggaccgccttccggctcgatgccctcaagaccggcgcactcgacaatctgatgctgaccgaggcgcgtctgcgcgagccggggccgggagaggtcgagatcgacgtcgccttcaccgggctcaatttccgcgacgtgatgaaggtgatgggcatctacccgaccgagggcgacgagcccctggtgctgggcgacgaggtcgccggcaccatccggcgggtggggccgggggtggatgatctggcgcccggcgaccgggtgatggcgatcgcgcccggctttgccagccgcaccgtggtcggccgcggcttcgtggcgaagctgccggaaggcgtgccgctggatggtggcgccaccatcccgatcaccttcgtcacggtctggtatgcgctgcatcatctggcccgtgccgaggccggggagcggatcctgatccatgccgccgccggcggtgtcggcctgaccgcgatccaggtcgcgcagcgggcggggctggagatccatgccacggccggctcgcccgagaaacgcgatttcgtgcgcagcctgggcgtcacccatgtctatgacagccgcagcctcgacttcgccgaccagatcatggcggcgaccgacggcgaaggtgtcgacatggtgctgaactcgctggcgggtgaggccatcccgaaatcgctcggcctgctcagggcctatggccgcttcctggagatcggcaagaccgacatctacggcaattcccgcatcggtctccggccgttccgcaacaacctctcctatttcgccatcgacctcgaccgggtgttccgcgagcggccgaagctcgccgcacggctgatgaccgaggtggccgatgccttcgccgaaggtgggcttcagccgctgccgcggcgggtctggccggtgtccagggctgaacaggccttccgccacatggcccaggcgcgccatatcggcaagattgtgctcgccatggaagacgatgccgcgcgcatcgcccggccgctgcccaagccgctgccgctcaaatccgacggcacatatctgatgaccggcggtctgggcggcttcggccttgccgtcgccgaatggctggtggccaaaggtgcagggacggtggtgctggccggccggtccggcgccgccacgcccgaggcccaggccgcggtcgaccggctgcgcgccggcggcacccgggtgcgggtggaacgctgcgacgtcaccgaccgggcggcggtcgaggccatgctcggccggatccgggccgatctgccgccgctcaagggcgtgctgcatgcggccatggtgctggacgacgatttcgtgctgaagctcgatcgcgatcgcctgcaccgggtgatggcacctaagatcgagggtgcgctcaacctgcatctcgccacccgcgacgatccggtcgagatgttcgtgatgttctcgtccttcgcggcgatggtcggcaatcccggccaggccaattacgtcgccgccaaccagtatctggtggcgctggccgaacggcgccgggcgcaggggctgccggcgctggcggtcgactggggggcgatcggcggcgtgggctatgtcgcggcccatgacgagatcgcccggcatttcgaacgccatggcctgacccccgtccaggccccggacgcgctggcctcgctcgaagccctgctcggggcgggggcggtcgcctcgggcgtgatcgacatcgattgggcggtctgggcccgctacatgcccgagctggcgcgcaacccgcgctatgccgacctgccgctgaccgaaggcgctggtggcgccggcggtggcggcggagagggcgaccaggtcctggcccggatccgcgaggcggcggccgaggatcgccaggccatggtcgaggcggcgcttgcggcacggcttgccaccgtcctcggcaccagcgccgaaacgctcgataccggccagccgctggccgaactcgggctcgattcgctcatggccgtcgaactcagttgcctgatcgaggacgatctgggcgtgaagacacctgcgatagaattgacccagagcccgtcgctctccaagctggcggagcggttgctgcctgcgatcgcaccctgacccatccagggctccgcagacgagccctttcccaagccggagagagacgccgatgttcgaaccccgcaaccccgctttcgccgaagccgcccgcgccatcttcggtcaggccggtttcatcaccgatctcggcatcgagccggtgacggtcgagccggggctggtcgaaagccgtgtcatgatccatccgcggcacatgcagcatgacggcgtgatccatgccggcgtgcagatgaccatcgccgaccacaccgcgggggccgcggccttcacgaccatcgccgccgatgaattcgtgctgaccaccagcttcaccaccagcctgctgaaggcggcgctgggcacggagctgcgctgccgggcgacggtgctgcaggcggggcgccgtctggtggtttgcgaatccgaagtcttcgccgtcagggacgacacgcccgtgcgggtgtccaaggcggtggtgtcgctggcggtgctgcagcggcgctgagccgccgcctgcgggcccgcccgaaaactgccgaccggcggagccggcggccggaaggaggagatcccccatgaccgatacgctcttcaatgatgtggtgacccgcatcggcgagtatctggaaaccgatgtgagccatctcacgcccgactccaagctcgcgacctcgatcgacgggctcaactcgctcaagatgttcgagatgatcctctatctggaggattgtttcggggtcgaattcgacgaggcggtgatggatcagatcgacaccctgggcgggctcgtcgaccatatccgtgaacagcgcgccgcggcggcctgacggaggcagcggcacccatgaagccgatgcgctggccctggcggcggatggccgccggagacgatcccctgccgtccggtcagccggccggcgctgcggcagacaggcccgccgttgcggtgaccggcattggctgtgtcaccgccttcggcgtggggcggaacgtgctcgacgacgccctggccgaaggccgggtggcggcagctccgatcacccggttcgatccggcccgcttcacctgccggatcgcggccgaggtgccggaaccgtccctgcgcttcgctcgtgatcacctgtcgcacgagctggagcggatgagcctgttcgtccgactcgccgttcatgcctcgatgacggcactgggtgcggatccggccgcgaccggccggccgcgcctgcccgaaggccgcgggctgatcgccatgggggtcgccatggggggcctgccccatatcgagcagggggtgctgaagcaggaacgcgcgggcccgcgcaagaccacgcctttcctgatcccctcgctgatcccgaacatggcggcgagcatgaccgcactcaggctcggcttcgaggggccgcaggtgacgcttgccggcgcctgcgccagcggcacccaggcgatcggtcatgcgctcgccgaacttcgggccgggcggatcgactgggcgctggccggcggatcggaagccgtcaccacccccatcacctggtcgggcttcgaggcaatgcatgcgctttcgcgcgggagcggggacgagaggccggccgcgcggcctttcgacggggcgcgtgacggcatgatctgtggcgaggccgccgccatgctgctgctgcaccgggccgatgcctgcgacggccgggcggtgctgggccgcatcctgggctatgccaccaattccggcgcgccggacctgacccgcattcccgaccgcgaaggcctggcctgcatgcgcctggcgctggaagatgccggcgtcgatccgaccgatctgggcgcggtgatggcccaggcctcgggcatgatcaccggcgatgcgatcgaggcggcggcgatcgcggagctgaccggcagccaccgcccgccggtcacctcggtcaagggcgccaccggctatctcttcgccgccaacgggccggtcagcacggtggcggcgctgggcgccctgtcacgccggcgcctgccgccggtcgcggggttccgggccgcatcggaggacaccgcctgcatcgacgtggtggcaggcgcaccgcgggacatcgatcccggccggccggtgctggtcaacagcttcggctttggtggcatcaatgcctcgctggtggtcgccggatctgacgggatcggcagatgacggtccggctctgatatcaattcttgatgtggtgcattttggcgcagaattgatcgcgctcttctgcacatatgtagtgacttgaaagcatgatcaggcgatgatggccgggatccatcaacccggccgtccatctctgtccgatgcccgggctatgccaacctgccgggccggtaccgcctgcccgggacatgcatgaaggaggaacggggatggacccgttcatcggagagatccgcattttcgccggcggcatagtgccaaccggctgggccccctgcgagggccaactgatgtcgatccagcagcaccaggatctctttgcgcttctgggcgatcgctatggcggcgacggccggacatatttcgcgttgccggatctgcgcggccgcacgcccgtctgcatcaccagccagccggttcagggggtgagctacagtatcgcccagacggccggcgtcgagggcgtcctgctcgccgcctctgaaattccggcgcacgaccatccgctggccgctgtctcgaccgcggcctcttcggtctcgccgtcgggggaggtcttcgcatcggcgcagcctgcggtctatgccgcgggtggcggcaacaccattccccttgccgccgggtccgtcacctcggtcggtgacgccggtacgcatgagaaccgccagccgggtcttgcgctcttctattgcatcgcgaccaccggcaactggccgcagcgcagctgacgccgatcgggagagcctcatgtacaagtatctcggcgagatccggctcttcgccggcgacgtcgcgccatccggctgggccttctgcaacggccaggccatgtcgatgaccgaatatcctgcactctataccgtgctgaccacgaaatacggtggcgacggcatcaagaccttcaatcttccggatctgcggggccggatccccgtccatatcggccaggggccgggtgtggacagttactaccgtctgggccagaccttcggggaagagacggtgcccctgaccacgcagcagatcccgccgcacagccacagcttcgaggtcgcagcgaccacggctgacgctacggcgcccgccggtgcaatgctggccgaagcgcccgtgcaatcggggttcaccggcctttataccgatgcgccgcttcagcccggcaccaccggtgccctggcaccccaggcgatcggcagcaccggcggtggtcaggcgcatcccaacatgatgccgtccaccgcgatcaactacatcattgccatcaccggcagcatcgccaccgcggcgacatcctgaagcaggcaccaccatggcagatgctttcaccggagaaatccgggtctacagcttcgactatgccccgcaggactgggccttctgcaatggcggcaggctgctgatcgatcagaacaaggccctgttctcggtgatcaagagcctttacggcccggcggacgggacgttgttctatcttcccaatctgcaggggaccgcgccgatgggcgcggggcaggggaccggccttaccaatcggacgctcggcagtatgaccggcaccgtctcggtcacgctgaccacggcgcagctgccggcgcatacgcacggcattcaggtcgatacgtcgaccacggccacgatccagaccacgcccacggccaatgtctcggtcatcgccacgccggtctcgggcgatgtcttcgcgccctgtgatcagacggcggccgtgaccctggatgtcggggcgatcggcacgaccggcgggggccagccgcatgagaaccgctcccccctgctcgccctgaacttctgcatctgcctcacgggcgtctatcccggctcgtaaggcaagaatgccgccgccggagaggcccggcggcggcatgcccggtggctacatgactttcagtcttgccggaccagcggcaggtagtgatggacctggcgcatggccaccagatccttgcggcgcacgacattggtcggatagggcgagcccggcagcgtgccggtgtcgatggtggcggtcaccaggccttcgccttcgggaatgaaggcttcgcggcgggggaaggcgaagctgtcgggaccgaagatgccgctcttgccggcgaagcccttggcctcgtcgatgtggttagcggcgaccagccagacattgttctcgcccgcccgcacccggaacagcagccagtgatgcggatcggcgccggtcgggatcggcgggttctgcgccactttgctgcccggatggccgaaggagatccgccctgcgatggcggccggtgccgcgatcacgtcgaccccgcgcagcgccaggacgcggccggcctcggggaaagcgaggtcatggccgatcagcaggccgagccgcccgaagggcaggtcgaacaccgcccagtcgtcaccggccgtcgcccagccggcctcggcggtggtgagatggatcttgcgatagcggccgacgatgccctcggggccgaccagaaccgcggtcgaataccgggcctcgccctcggcctcgatcaggccggcaacgatgtggaggcggtggcggatggcgatgttgaccagccgtgccacctccggtccgtcgagcccgacggcattggcgggggcggttccggtcagcgcatattccggcaggaccagcagcacggaccccttcgccgaggcctcggctgcataccgggttgcgcggtccagattggcggccgtgtcgtcgccgggtgtgaactgcgcggccgcaacctcgaacacgccaccctggggcagggcgcggtagccatagaggcggaagaagtcgagcggattccagaggaaggtgttggtcatcagctcggcataaagcgcgggccggcgctgggcgaagaccggctcgcccagaaccttgcgcgcccgggcgcgggccaggtcgaccgtgccgtagacgacgccgtcgccgcagtcgagcaccgcttccatgctgccgtcgggccccaggatgcagctgccgcccgagaattcgaccgtccgctccagcccccagcgattggcctcgatcacatagcagccgttctcgaaggcacgggtgatccaatagggcgccgggcagcgttcggccagccagttgctgatatggcagatcacatcggctccgccgagcgcgtcgagacgggcggtctcgatgaaatggatgtccatgcagaccagcatggcgatgcggccgatcggggtctcgaacaccgcatgctcgtcgccggccaccgcccatttgggctcggcgatgtaggaatggcttttgcggtggcggccgatcacgccctcggggccgatcagcaccgcggtgttgtgatagaggttcgtttcaggatcgacctcgggcatgccgatgacgatgtagcagtcataggcatgggccagcaccgcgaaacggtcggtggtggggccgggcaccgcttcgacgaagggggcgacttcggcgcggtcgtaccagcaatagccggtcgtccccatctcgggcgtcacgatcagcttcgcgccgccctgtgcggccgtctctaccaaagcgaggagacgggtgatgttgcgctccttctcgtagagcgtcggctcgaactggacggcggcgaccttgtaggacgtctcggtcatgatgcggaactctccgtaaccggaaactctgatgcgggggtgctggtcacaccgccatatggcggtggaccagatcgtcggtcagcgtctcgatcgggccacatgcggcgatgcggcccttttcgagcatcacgaagccatgggcgaccgcgcggacgaagtcgatgttctgctcgaccaggatcacggtcagcccgtgctcgcggttgagcctggcgatcaccgcgtggatctcttccacgatcgagggctggatgccctcgctcggctcgtcgagcagcagcagcttggggttggcggccagcgcccgggcgatggcgagctgctgctgctgcccgcccgagagcacgccgccgcggcggtcgtaattctcgggcagatagggaaacagctcgggcaccagtgccggcacctcgatgcggccgtcggtgcgggcgaaggcgcccatcaggatgttttcgtggatggtgaagtcgggaatgatctcgcggccctggggcacgtagccgatcccggcccgcgcccggcggaaggtcggctcgtggccgatttcggtaccgtcgagccggatgctgcccgacatgcggtcggtcaggcccatgatcgtcttcatgagcgtggtcttgccggtgccgttgcggcccagcaccgcggtgatccggccggcgggcgcttccagcgccacgccctgcagcacatggctgcggccgtaatagctgtcgatcgcggacatctgcagcatcagccgatccccttcgtgccgagataggcggcgcgcacatccgcattggtctcgatctcggcgaccgtgccctcggccagaacccggcccagatgcagtacggtgatctgggtcgcgatctcgcggacgaaggccatgtcgtgctcgaccaccagcagggtgtggctgcccttgaggtcgttgatgatccgcgcggtcttgagcgtctcggcctgggtcatgcccgcggtcggctcgtcgagcaggatcacccgcgggctgcggaccaccagcaggcccagctccagccactgggtctggccgtggctgaggaaacccgccacggtctcggtctcttgtgcaaggccggtcagctccagcacctcgtccacgcgccttcggccggcggcatccaggccgaagcccagattggcgcggacgctgggcgcgcggaaggcggcgacctccagattgcggcgcacggtcagctcgcggaacacgctcgggatctggaacttgcgccccagcccggcgcgggcgatgcggtgttcgggccagttggtgatctcggtgtcgtgcagatgcacgcggccgcggctcgcccgggtgcggcccgagatcaggtccatcagcgtggtcttgccggcaccattggcgccgagcagcaccctgagttcgccgtcggccaccgtgaggttcacctcgtccacggccctgaagccgccgaaggagacgccgagcccgtcgagggtcagggcgatgccgtgtctggttccggcggtcatttccggccctccgccttgcgcgtcgcaccgctcacccggtcgatcaggtcatgggcgaggccgcccaggccgcgcggcatgaacagcaccaccaggacgaagatcagcccgatcaccgctttccaggcctcgaccagggcctcggtctcgctggcgccggcctcgatcatgttgatgaggatggcgccgatgcaggcgccgagcaggctggagcggccgccgaccgccgcccagaccaccatggtgatcgagaaggcgaggtccatgaaggtgggggaggcgaactccgccaccacgacgtagagcatgccggcaagcccggcgatcccggccgagaccgcaaagaagaagatctgataggccggcacgtcgaagcccagatagcgggcgcgggtggcgtcgtcgcggatcgcctgcagcaccaggccggcgcgggtttcgaccagcagccgggtggcggccagcaccaccagcagggtgatggcgaccagataataggtggcctgcgaatagggatcgaattcgaagccgccgatggtcaaccagccgagatcggtgagcccgttgaagccgttggtgaagggctgggcgtcgatgaccagcagccggaccagcagcaccagcgcaagcgtgatgatcgagacgaacaccccggcgatgcgtttgcggaacaccaccatccccagcaggaaggcgaccgtcaccggcagggccagccccatgaagatgccgaagccctgagagatgaagggcttccacagaaaggacgaaccggtgatgcagcagagatccgtgggcgcgcccggctcggcattccagagcatgaagtcgggcaccggcgtgtccgagccctgggcaaggctggtcgggctcgcgagtttcagcgacatggcgagcatgtaggcgccgaagccgaagaacaggccctggccgagattgaggatgccggcatagccccaggaaagcgagatggccacgcccagcatgccgaagaccaggtacttcgccatgcggttcagccagaaatcatccaggaaggccggggccaccagaaccaggccggcgaaggccagataggcgaggagggtggtggtggtcgagagacgcatctgcatggctcagcgccccttgaaggaaaagaggccggccggcttcacgatgatgatcaggatcaccaccccgaagacgatggcacgtgccagaatgtcgttggtgaccgcggccgcgaccgcgttgatctcgcccagcatgccggccgagagcaccgagcccagcaggctgccgacaccgcccgccaccacgaccaggaagccgtcgaccaccatggagctgcccatgtcgggaaagacggtcttgaagcccgacatcatcacgcccgcgaccccggcgaggcccgatccgaaggcgaaggtcagggcattgacccgggcgacgtcgatgcccgaggcggcggccatacgcgggttgcggatgatcgcgcggacctgcatgccgatgcgggtgcggtacatgatcgcccaggtgagcagggtcagcaccagggtgaccgccacgatgaacacccggtaggcgttgatcgagctgccggcgatggtgatcgtggtctgcaggatatgggggacggcgacgttctgcaggcccgggcccaggccctggatgtggatgccgaagaagctgaggccgaattccaggcgcaccgcctgctgcagcaggatcgcgatgccccaggtggcgagcagggtgtcgagcaggcggccatagagccggcgcaccaccacccgctcgatcgcccagccgatggccgcagccgagaggaagccgagcggcagggccgcgaacaggcccagatccagccagatgccggagagcacggcggtataggcgccgatcatcaccagttcgccatgggccatgttgatgacccccatggcgccataggtgatggcgaggccgagtgcgaccagcagcaggatcgagcccaggctgaggccgatgaaaaggatgtcgagcatgtgggacggactccacccgttgtcggccgccgcaaaggacctgtgggacacacgaaaggccggaaccttcgcagcggccggaattgggcgtcagcccttcagcttggcgctgtcgaggcccttggcggtgcagaacaggttgtccgcggtctcgccataggcggcatagggcagcgggcggatcggctcgggataggcgttgaccaccttgctctggccgtcggcctgccactggccgatgcgcggggtcaggtaggcgtgcagattgtcgccgtcgatggtgaccttgccgcccggcgcgtcatagctctggccgccgatcgcggcacggatgtcgtcggtcttgaccgaccccgccttctcggccgcctgcttccacaggaagacctggaaataggcggcttccagcgagtgataggtgagggcggccgggtccttcacgaaggcgcgatagcgctcgatgaaggccttgttggcgggggtgtcgagcgacatgaaataggggaaggatgtgtagctgccggcggcgtattcggcgcccatggccgcgatctcgatctcggaggtcacggtcgcgcagatcggcacatcggcctgggacatgccctggttcttgtactcgcgatagaaggcgacgatcgagtcgccgaccacgttcgagagtaccacatccgcgccggattccttgatcttgcggaccatggtcgcccattcggaatggccgagttccagatactcgtccgccacccattcggcaccggcctcttcgatcagcttcttgctgaccttggccatctcacgcggatagacatagttcgagccgacgatgaagaacttcttcttgcccagcgtcttgacgatccagggaatgtagttgcccagctgctggttcggcaccgcaccggtatagaccacattcttcgagcattcgaagccctcgtaatgggtctggtagaacagcatgccgtcgcggcgctcgaacagcggcagcaccgccttgcggctggccgaggtgtggcagccgaagaccgcgttcacccggtcgcggaccagcagcttcgaggccttctcgctgaaggtcttggggtccgaggcgccgtcctcgacgatcacctcgacctggcggccgagcacgccgccctgggcgttgacttccgagaccgccatcatcacggcatcggccagcatcttctcgacgatcgagagaccgccggtctgggaatagagcgcgccgaccttgatcgtgtcggcggcaagcgcccggccgatcagcgagggggcggccacggcggcaagtgaggcggcagcggtggatttcagcagcgagcgtcgggtgatgctcatggggtcggtctcccgatgacggtgaggtgaagcctcgggcgttttcgcccgtgatgtttggcgcgcgtggcgcaggtcggagccgttcaaaaaagggccggaagaccgggggtgtccggtcggcatccggggggaggaaggccgtcggtggagggatttcacgcctgtcggacagagcatgaggcgcacttctcccgttctgcgttcaagtagaacgcagtgggttctgcctcgttttctggtcgagggtgagtgccgacagccctgtcggcatgggcataaaaaaacctcgcagaccccggaaggcggggtcgcgaggcatccttgccacgtgccggtcgaacatccccgttcttccggcggcagaacggcgtggtctgaatttataccgggtggcccgatttcagaggacgccgactgctgctcagatcttgagcatgcgcgaatgttaatcagctttgcggggcagggtcaagaggtcctcggtcttcacgatcgcggcggcgatttcttccatcggcacccggcgcgccatggcctggcggcggatgaactggtgcgcctcgttctcgctcaggctcttcgatgccatcaggatcgccttggcgcgggcgagcgtctgttcgccgaccatcttgcggcgcagcttgcgcgcttccttcagcagccgctggcgttccagccacaggctgcgggcgatggcgaggttggtgagaagcccgaagggcttgagcggcttttccagcaccgcgaaggcaccgctttccagcacgatctggagcgtgcccggatcctcgtagccgacgatggcgatgatcgtcggcggcaccggccccagagatttcagcaggcgctcgatccctgcccggtattcgaccgcgatggtcagcagcaccacttcggcattggccggcaattccgccggcaccggccagagcgtggtgaccatgcagccgatacggcggagatgatcgaccaggaaggcgccctcctcgtccggcggatggaccaccaggaccttgaggccgagaagatcacgcagcagggcgaccgacacgtgggggcgctcccgggaaaggagggtcagaggcctgccaccggcaggccatcggccgccggggcgtcgagacgatattccagcatgtacgggtccgggcggacccgggtcttcgggtcatacaccaggtcgaactgaccggcggccgtcacccggccgaccttgggccagagatgggtgtggttgttgtcgcgctcgatccggatccggccctgaggggcatccacctcgacctcgtagagctggggcagcagatcctgcgcccggtcgctttcggcccgggcgagggcggctgcatagagatggacctggaaatacgccgcttcggccgccgctgcaatcaccgcatcggggccgaagcggcgccggaaggccgccacgaacctgtggttggcgggggtgtcgatcgcggcgaaatagggcgagacgccgatatggccctcggcgatgcccgggctcatctgggcgatttcggcctcgctggtcgactggctggcgatcggcatggtggccgggtcgaagccggcggcacgataggcttcgtagaaccgggcgatgccgtcgccgaccacggtcgaatagatcacgtccggccgcgtgcgccggatctgggcgatgacctcgtccatgtcgatttcgtccaccgccagcggcacatacatctcgtgcagcacggtgccgccggattgcagatagagatcggcgatgatccggttggattcgtaagggtagacgtagttggagcccacgatgaacagccgcttgccgtaatgggcggtcagataattcaccagctggaccgagttctggttggggcaggcgccggtatagatgcagctgcgggaatattcgaagccttcatagagggtggggtagaacagcagcgccttgcgcgcctccaccaccggcagcacggccttgcgggtgctggacatgtagcagccgaagatcaccggcacccgctccacatccagcaggtgttcagcctgatcgcgatagagcctgggcgtcgaggcggggtccaggaccaccggctcgatctgccggcctgcaatgccgcccgcggcattgatctcttcgatcgcgagcagcgtgccatggcgctgggtgcgttccactgcggcggtgacgccggtgtcggagaacagcacgcccacgcgccagctatccggtatcgatctcttgcccatggccctgcacataaaaaaagcccccggccggcacgaaatgccgacgggagctgccctgctcacaatcacatggcggagtctgcccgcctctccgaacaggctacgcccaatgacggtgcgttgcaacatgatcggcggtgcctccgcatggctgccatgcggggcgggttgcatcgcgggctcgacagcggccccccggcgccggccataatccgcccaatgaaacgcgcgcgcggcagtgcaccggcgcgcctgggtgtgggaggccggatcatgagtgcgcgcgaccctgcaacgccggacgaggaccggatcccctggcgggcggctgcggcggccttcgcctcggtgctgatcggcctggggcttgcccgcttcgcctatacgccgatgatcccggccctggtcgagggcggctggtatgacggcgcggcagcggccagcctgggagcggtcaatctggggggctatctggccggagccctggcggccgcaccgctggcccgccgggtgccggtcgccatgctgatccggatcgcgatcgcgctcaccgtcatctccttcgccgcctctgcggtgcatctgggctatggctggctggcggtctggcgcgcgatcggcggcatcaccggcgccatcctgatgatcgtcgccgtgccggcggcgctgtcggcgacaccgatccggcggcgcggccgggtggccgggctggtcttcaccggtgtgggcctgggcgtggtggtctcgggtcagctggtgccgatcgcagcaggtttcggcgtggtcgaggcctggggcatgctgaccatcttcgccctggtgctgggcgttgtcggctggagcggctggccgcgtgaggcaacgggaccggcggtcgggggcggccatctgggcgtgccgccggcagccaccggtgcggcgctggcgctgatcggtcttgcctatgccctggatgccttcggcttcgtgccccataccctgttctgggcggattacgtcgcccgcaccctgggcctcggccttgcggccgccggcgcgtcctggagtctgttcggtctgggcgccgctttcgggccgatcaccgtcgggctggtcgccgagcggatcggcttcgggcgcacgctggtgggggggctggtcatcaagggcaccgccatcggcctcgccgccttcaccaccgccccctgggcattggcggcgagtgccgcggtggtcgggctgctgacgccgggcatgggcacgatggtcgccgggcggatcaccgagatcgcgagcccgcatcgccagcgccaggcctgggcggcgatgaccgtgagcttcgcggtggcgcagagcctttcgggttttgcgatgacggaatggtatgcggtgtccggcgagcaccggccgctgttcatcgcaggcgccgtggcgctgttcctgggggcgatcgcggcggcgctgacgcttcgccgacgctgaaccctgcggctcaggtcaggaagtgcaccagggcgtagaccagcgccttgaacagggcgaccacgacggcggcagccagggcgcagctgagcaggcccagcacatagccgatcagcaccgtcagcccgtcgcgttcgatcaggccgagggcgatcaccgagattgcgatcgccggcgggttgttgccgaaggggatgggtagcaccagcacgatcgacaggatcaccatgatcacgccgagcagccgttcggccttgccttcgatcacccaggcgcaacgcggcttcagcaggcgctcgaccttctcaagccagggcagagccttgttgaagaccatcatgaaatcggtcttgcggaacgaccggcgggccaggaaggccggcagccaggggctgcgctggccgagcatcaggccgatggcgaagggaacgatcggcgcgcccagcacggccgagaggccgggaatgcccagcggcagacagttgggcagggcaaacagcaggatcagggcggcaaaggcgcgatcgcccatcaccgtggtcagatcgtgcaggctgatacgttcaccgggccagtcccggatcagccgcttcagaacgtccgacgtccgttcaggacgaggcggatgcccgccgctggaggcggcatcctcgtggagcgtcatcatcccatccgtcacgcggctcgttccgttcctgtatggcccgcttccggcccggaagctgttgcctgcggccgccattctgtcgggcggtcctccccccggatcgtccgtcgggcgatcctcgggtcaagcatgcggcctgcatattaaccaatgctttcggacggagggaggcgcagaatttcataaaatttgcatgtcggcctctcgtcatccggaaagacgatgtccatgtgacacgctcgtgccgcccggcatgccgaggccggttgcaagcaggcgggcagcggcggtaccgtcggtctgcccatcccgaaaccgaggctcggaccacccatgatccggacgcgttcccgcaccgctcttttcatcgctgcggtcgcggccgcgcttgtgcccctgcttcggccgtctccggcccgcgcacacccgcatgtctgggtcacggcggaggcgacgcccgagacggttgacgacaaggtgacggcgatcgagctgagctggaccttcgatccgatgctgagcgcggttctgatccaggatttcgacaggaatgccgacggccgctacgatgccgacgaacaggcggctctgacggccgaactgttgaagaacatgtcggaatacggttatttcacccatatccaggtcgacgcctccttcgtcgacctggccggggtggacggcatggccgccgcgatcggcgacaaggtcgtgaccatgagcttccgcgcccgcctcaccgagccggtcgacccgcggaagcaccggatcaccctcggggtctacgatccggaatattatatcgccttcgacctgccggctgcgtcgctgcatctcaatgcaccgccgctcgacctctgccgcccggtcgcgcgggaggacacgcttaaccccatctatttcggctatgtgaaccccgaggtgatcgatgtcgtctgccctgcgcgctgaccggatgcggaggatccgggcggcggtgcccgcctgtgtcgcgaccctgctgccggccttcctgccgactttggccatggcctccagctatctggggcgtgccggtggaggcacgccaccgccggcaccggtgaccgaggcggcggtcggggccggcattctgggcccggtgctgatgcagatcatcacctggcagggcgaactcaatgcgctgatctcgggccggctgggcgaggcggtgcgcgagggtaccatcctgcccgccctgaccgtgatcggcctcgctttcgtctatggtctgctgcatgcggccggccccggtcatggcaaggtggcggtggcgggctatctggcgggccgaccggccgatgcgcgaaccagcatggtgatgggtgtcgccatcagcctgatgcagggggcggtggccattctggtgatcgggggccttgccctgatcctgggacggcaggggctgggacggatgaccgatccgctggcactggaactggcgagctatgccctgatcgcgacgatgggcggctggatgatcgtaaacctgctgcgcggtcgcgccgcctgcggccatgatcacgggcaccacgatcacgggcaccacgatcatgatgatcacgcccatcacgaccatgggcaccacgatcacgggcaccacgattacgggcacgaccattcctccgggtgccatgcctgcggccacgatcatcatcatgatgaccacgatcacggccaccacgccccaccggcccggcgacaccccgacgccttctggggcatgatcgtcgcggccggcatccgcccctgttccggagcgatcctgctgctgctgttctcgatgagccagggcgccttcctgctgggggtcacgggcgtcgtcgcgatgagccttggctcggccatcaccgtcgtgctgatcggcctgggcgtggtcggggtccggcgatcgctgatggcgctggcggccggcggcgggtcgcgcaccgcacgcctgctggatcgtggcctgggcttcctggcgccgggcatgatcctggtcttcggcatattgatggcctgggcgacctggattcgcatcactgccggtatttgaccgcatcaccagtaaaggctgcatattgtaaccattcggtcgcctcatggtcgacaagtgcagacgattggcctagtctgaatgtaatccgtgttttcgccacccggtgggacatgcctgcgcatgaaaacggacccgacgctgccagaagatccgggcctgtttgccgatatcgtcgacgccacccacgacgcgatcgtggtgatcgacgaacgcgggatcatcaggctcgtcaatcgcgcggcggagctgatcttcggctatacgcctgacgagctggtcggccggaatgtcagcctgctgatgcgatcagaggaagccgaggcccataacggctatctggccgctgccgacagcgatctgcgccgccggatcgtcggccgcggccgccagctgctcggccggcggcgtgacggatctccggtgccgatcgatctggtggtcagcatgctgccgcggccgggcgggacccggttctatatcggcacaatccgcgacctctcggaccggaaacttgccgaggaaagcctgcgcctcggtttcgagagcagcggcgtgggccaggcgatgatgtcccccgacggccgcctgcttcgggtgaacggggcgctggccagaagtcttgggcatgaacaggggcggctgataggcggcgatatccgtgcaatcctgcatcccgatgatgtcgaggccgcgcatgaatggcttgcggccatccgcgcgggcgggcggttgcgggacggcatgcggatctgccgtcatgccgacgggcgcaaggtctggttccgggtcgcaggtgccgtcatccgggacggcaagggccaccatgcgcattgcatcgttcagttcgccgacgtgacgcccctggtcgaagccgagcaccgcctgaccatggcactggccgcggccgagaccgcgagtgcggccaagacggccttcctcgcccatatgaaccacgaactgcgcacgccgctgaatgcggtgatcggctttgccgaactgctgatcgcgggcctgcacggggcgctgccgccccggcagcgcgattatgtggatgccatccatcaggcgggctgccggctgctcgcgatcgtggacgacatcctcgacctcacccggctggacgatccgtcgatgctggagacccaggacgtcgatgtgagcggggtggtgcgcaagggcctggaacgggcggccgtggccgaggggcgggcggatgtggtcgtcaccgtcaccatcgatcagggtgtgaccctgtcgggcgattccgccgcgacggtccggatcatcgccaatctcgcctccaatgcgatcaagttctcaggccctggcgggcgggtcgccatcgaagccagccgctatgacggcgatgccggtcatggggtgatcatccgggttcgggacgaagggcccggcatgccggcggggctcgccgcggatgtcggctggccgttcgagaccggcggcggggttctgtcgcgcaaccatggcggcgccgggctaggcctcgccatcgtgcgccggctggtgatgctgatggggggcacgatctcggtcgataccagtaccggtggcggcaccaccgtcgtcgtcgatctgccggaccggcagcgggtagggcaggtcgcctgatccatggccggcccgcatgcgtaagacgacaggcgtcataccctttgccggaggcttccccatgcatgcgcctggcgtcttccgtctgtgttccctggccctgatagtggctgcggccgttctgcgtccggcccaggcggaggatacggtccaggcggaggatacggtccaggcggaggatacgggccgtgtggtcgagcttctggatctcccccgccacgccgccctgatgcgccatgccacggccccgggcaccggcgaccccgaccatttccgcctgaacgattgcaccacccagcgcaacctgtccgaggcggggcgtgccgaggcgcgcgagaccggccgtctgcttcgggcagcggggctggccgaagccctcgtgctcaccagccgctggtgccgggcaaccgataccgcccgcgaactggatctgggcgaggtggatccgtttccgccgctcgacagttttttccgcgaccgcagccgcgaagatgcggtgcggcgcgatatcctggcgcggatcgccgggcgcaaggccggcgatccgccgctgatcatggtcagccaccaggtcaacatcaccgccatcaccggcatcttcccggcatcgggagagatcgtcgtggtcgaagtgctgccggagggaaccgccgcggtgcgggcgcggctctccccttgaccgcccggccggcgtctcccccctcggaaccatcaggatgctacccatgacctccccttctgccggcctcccccgcaccgcccgcccccccgtcttctcggggcggtcgctgctggccctgctggggttcctcgcgctctctgccgtggtctcggggcttggcggcgcggtcaccacgcccgaaatcgacggctggtaccgcaccctgcccaagcccggtttcaccccgcccgactgggttttcgcgccggtctggaccacgctctatatcctgatggcggtggcggcctggcgggtctggcgcaaggccggcatcgccggggcacgcggggcccttggcctgcatctcgtgcagctggcgctcaacctcgcctggtcggtgctgttcttcggcctgcatcaggtcggtctggcgctggtcgacatcctggtgctgctggtggccgtcacggcgaccgcgatcgccttcggccgtcatgatcgtccggcggggctgcttatgctgccctatctcgcctgggggcctttgctaccgcgctcaatgcctcgatctggctcaatctcagcccaggactgtgacgaagtgcacaggagaggcgggttcgggcttgcagggatcgggcaggtggtccccgtttccggtgcatagacgcaagggccgcgcctccgtagattgcggcatctccgacttgctgctttgcggaaacctgcccctgccatgcagaccggacctgccatctcccacgatccggcgctgttcgcggatatcgtggacgccacgcatgatgcgatcgtcgtgatcgatgatcacggcatcgtgcagttcgccaaccgtgccaccgaactgatcttcggctacagcccggtcgagctggtcgggcaaagcgtcaatctgctgatgcggcccgaagaggcggcgggccatgaccgccatctgcgcacggtcgatcccgacattcgccagcggatcatcggccggggccggcaattgaccggccgccgccgcgacggcacgccggtgccgatcgatctggtcgtcagcatgctgacccgcagcgacgatgtccggctttatatcggcacgatccgtgacctgtcggaccggaggctggcggaagaaagcctcaggctgtccttcgaaagcaccggcgtcggtcaggccgtggtcgggctcgacgggcggatgctgcgggtcaatctggcgctggcgcgcagcctgggccgcgaggcggcagccctggccggggcggatttccgcagcctgatccatcccgacgacctggcggccgcggaacgctggctggcagccgcccgggtcgacggccggccgctcgacggcatgcgccgctacattcatgccgaaggccatatcgtctggttccgggtggccggcgccgtgatccgcgatgccgacggccatcccgcccattgcatcacccagttcgccgatgtgacgccgttggtcgaggcggagcgccgtctgacccgggcgctcgccgccgccgagaccgcgagtgcggccaaatccgctttcctggcccatatgaaccacgagctgcgcacgccgctcaatgctgtgatcggctttgccgaactgctgatcgaagggctgcacgggcccttgccgcagtgccagcgcgactatgtcaccgccattcatcaggccgggcggcgactgctcgccatcgtcgacgacatcctggatctcacccgcttggacgacccgtcgctgctggcgtccgaggcggtggatctggaccagatcgtgcgccaggggctggatcgggcggcagcggccgagggccggcccgatgtcacggtcaaggtggcgatcgcccccgatgcggcgcttgccggcgatgccacggtgatggtgcggatcatcgccaatctggcgtcgaacgcgatcaagttcgcgcggccccggggtcaggtccgcatcgaggcgatgccgggcacggccggggtggtgatccgggtcgaggatgacggtcccggcatgcccgatgcgctggcccgcgacatcggccggcccttcgagaccggcggcggcgtgctgtcgcgcaaccatggcggggcagggctgggccttgccatcgtccgccggctggtcacgctgatgggcggccggatccgggtcgaaaccggccgcctgggcggtgcgatggtgatcgtcgacctgccggaccggcatgtcgacgagcgtgcggcctgatctggagaagagctgatcagaagaaggcctgaatgccggtctgggcacggcccaggatcaaggcatggatgtcgtgggtgccctcgtaggtgtttacggtttccaggttcaccaggtgccggatgacgtggaattcgtccgagatgccgttgccgccatgcatgtcgcgggcgaggcgggcgatgtcgagcgccttgccgacattgttgcgcttgaacagcgagatcgcctcgggcgccgcccgcccctcgtccatcagccggcccaggcgcagcacgccctgcaggcccagcgtgatctcggtctgcatgtcggccagcttcttctggatcagctggttggcggccagcggccggccgaactgcttgcggtcgatcacatactgccgggcctggtgccagcagaactcggccgcgcccatcgccccccaggcgatgccgtagcgggccttgttcaggcagccgaacgggcccttcagccccttcacgttcggcagcaggttttgctcgggcacgaagacgtcgtcgagcacgatctcgccggtgatcgaggcgcggagcgacatcttgccctggatcttgggcgtcgagaacccgtccatgccccgctcgaccacgaaaccgcggatcacgtcgtcatcggtcttggcccagaccaccgcgatatcggcgatcggcgaattggtgatccacatcttggcgccgttcagccgccagccgccatcgaccttcgtggcccgggtcttcatgccgcccggatccgagccgtgatcgggctcggtcaggccgaagcagccgaccatctcgccggtggcgagtttcggcaggtatttccggcgctgctcttccgagccataggcatagatcgggtgcatgaccagcgacgactgcacgctcatcgccgagcggtagccgctgtccacccgctccacctcgcgggagatcaggccataggcgacatgcgagacgcccgggcagccgtattcctcgggcagggtcgggcccagcaggcccagggcacccatctcgttcatgatctcgcggtcgaaatgctcacgccgggtgccgtcgatcacccgggtcagcagccggtcgcgggcgaagtcgcgggctgaatcgcggatcatccgttcgtcttcggtcagctggtcatcgaacagcagcgggtcggaccagtcgaaggcggcggctttgggcgaggtttccatatggctcatcggtgttctggccttgtcgcgggtcttgtggagcgtctcctgccgtcgaatataaggaggcgacagggcggtgtggccgaaaaatcggccatgtccgctttgcggaatatatgactgccacgcggaataaaatcagcggagacggagcatgagcgaagccctgaccggcgaggatctggccccctatggctggaacgggcatgcgcccgaagactgggcgcccgatctggcggcgatcaagcgcgccgcggcggagccggagatcctgccgctgctctcggcacgctggagcccgcgggcctttgccgatgtcgatctgtccctcgacgatctggcgccggtcttcgaggcggcacgctgggcgccctcggccaataatcagcagccctgggtgttcgtggctgccagccggtccgaggatccggagggcttcgagcgtctggccaattgcctgctgccgggcaaccggcgctgggcaccccgggcgccggtgctgatgctggctgcggcgcggacgctgcgtcctgacggcaagccgatcggcacggcgctctacgatctggggctggccgtcggcatgatgtcggtgcaggccaccgccgaggggttgtggctccaccagatggccggcttcgatgccggggtcgccaccggcacgctcggcctgccggaagacgtgcagccggtggcgatgattgcgatcggcccgatcggcgatgccgccgagctgcccgaagatctgcgcggccgggaaatctcggcgcgggaacgccagccccgcgacgccttcgttcaccgtggccgcttcggcggctgaggctgacgtccttgcggccggccgggtcgggccggccgcggatgtctcagttcaggatcgggcagagcgccggatccatcggccggatgacatcggctgccggcacccggtcgagcaccctgtaatagtcccagggacccgtcgacgcggcgggggtcttcacctccaccaggtggtagtcgcgcatcagccggccgtccctgcggacctcggcgtccctggtgaagaaatcattcacccggatctcgcgcatcttcgccgccaccgcccgcggctcgtcggtgccggcggcctccaccgccttcagatagtgcagcaccgccgaataggtgccggcatggatctgggacggcatgttgccgccggtggcggcctcgaaacgtttcgcgaaggcgcgggtggcgtcatccatgtcccagtagaagccggtcaccacctgcagcccctgggcgacctccagtcccagcccgtggacggtgtgcagatagaataccgtcgccgccagcttctgcccgccctgggtgaggccgaattccgaggcctgcttgatggtgttgatggtatcgacgccggcattggcgagcgccacgattttggcacccgaggcctgggcctgcagcacatacgaggaatagtcggtggtgccgatcgggtggcgcaccgcccccagaaccttgcctccggccgcttccaccaccggggtcagcgccccttccatcgccttggcgaaggcgtaatcggccgagatgtagtaccagctgtctccgccctgggcgaccacggccttgccgatcgcctgggcgatcgagaaggtgtcgtagagccagaggaagccggtttcggcacaatcctggccatagatccggtcattggccgagccgacatggaccaccagccgcccgtcgcttttggccagttcctggacggccagcgagactgccgaattggcgatgtcgaagatgccgtcgacgccgtcctgatcataccagcgccgcgcggtgccggcgccgatatccggcttgttctgatggtcggccgcgacgacctcgatcggcttgtcgagcacggtgccgccgaaatcctcgatcgccagccgcgcggcagcggccgagccggggcccgaggtatcggcataggcgcccgactgatcgttcatcaccccgatccgcaccacctcgccgctgatctctgccgctgccgccatgccggccgtgccgcagatcaggccggccgccagcgccgtgccgaacagaccccgcttcacccgttccatcgtcatcgtctccctccctctggtccggctcgtggccgggctcgtttgcgggcgagtttagcagagcttccgacattagaaaaacaagtgtttggtagttttaggggcgggccgctttcggcctggacaggcgggaagatgcaggccagagtcgatataatgaaccaaacaatggtttgtttaatcgccgcccgccgggccactccggcgggaagagccagacggaggacacgcaggagatgaccgtggtgacgcagccggccctctctgaccggacgggatccggggagagtgagggtgcctgggaccggcccgacgacatccatgtctatctgcccgaaatctgggcggtgcatgcccgccatttccccgagaaggacgccatcgtctgtggcgaagaccggctcagctggcgcggtttcgaccaggcgatgaaccggctggccaatgccctccatgcccgcgggctcggccgcggcgacaaggtcgcggtgctgctcggcaacgagatcctcaccatcccggtgatgttcggcgtggtcaaggccagggcctgtctggtgccgctgtcggccatgctgacgcctgaccagctggcccatctgatcaccgattccggggccacgaccctgatcgtcgcctccgggctgatcgagcggatcgcaccggtccgggaccggctcgaccagatcgcaccggaccggttcgtggtgctgggcggcgagcggccgggctgggtggcttacgaagatttcctgggcgatgcgcccgcgacccagccgcccgtgcgctatgccccggatgacccgttcaacatcatctacagctccggcaccaccggcctgcccaagggcatcgtccagacccaccgggcgcggcagcactggtcattctccaacgccatcgagatgcgcttcgatcagacctcgcaggcgctgaccaccaccgcgctctactcaaacggcacctggctgatggtgctgccggtgctgttcaccggcggcacgctccatatcctgccgcaattcgacccggcggctttcattgagacggtggcacgggagcggatcacccacaccttcatggtgccgacccagtacatcctgaccctggcctctccggcgctcgatcaggccgacctctccagcctcaagaccatgctctcggccggatcccccctcaggcccgacaccaagcaggcggtgctggcgcggatggggccggggctttacgagctttacggcctgaccgaaggcttcgcgaccatgctgaagcccgaattccatgcaacccggttgagctcggtcggcacgccggtgctgggtttcgaggtccggatcattgacgacgaggggcgcgagttgccggcaggcgaggcgggcgagatcgccggttatggcgccggcatgatggccggctatcacggccggcccgaggcgaccgccgccgcgatctggcgggacgagcgcggccgcagcttcatccgcaccggcgatatcggcaggctggacgaggcgggcttcctctacatcctcgaccgcaagaaggacatgatcgtctcgggcggcttcaacgtcttcccgaccgatgtcgagaccgtgctgggcggccatcccgatgtgctcgacgtgacggtgatcggcgtgccgcatgaaaaatggggcgaggcggcgctggcgctggtgatcccgcgcgacggcgcccgggtcacagaggccgatctcaaggcttgggcgaatgaccggctggccaagacccagcgcctgacggctgtggagttccgcgcggaatttccgcgcaacgcgctcggcaaggtgctgaagcgcgagctgcgcgcgccctattgggcggcggaggggcgggtgatctgatcggcggtcggttggctggtcgtggtcacgcccgcgccggccgctgcgatatctcgagcgcgagcatggcgaccaccacgaaggcgagcgaggcggcgggcagcagcagtggccccgccccgccatgtaccgccacccccacgcccgagcccagcgacatgcctgcatagagcgcggacgcattgagcgcgagagcgaggccggcgcgatcgccggccagatccaccaggcgcttctgctggggggccatgaacgacatggccgtgattgcccagaccgacatcagcagatagagcggaaccagcccgcccggcaccaccagtgccgcggcgaagcccagacccagggcggtgagggtgatgcgcagcgtgctgacggcaccgaaacggcgttccagcacggcacccagcgcattgccgatcagcccgccggcgccgtagatgaacatggcggtggggaccgcggtttcgggcaggacgcggccgccggcctcggcgacggcggtcatccagggggcgagcagggcgtaggtgacgaagatgccggacatctgcatcagcggcaccaccagcgccatgccgatccgccggtcgaccatcatacgcagcagcactctcgcacccgagcgggagccgcgcagccccccgggcacggtcgcgcgcaccgccagggcgaccagcacggcaattgcagcgatcccccaggtgacgccgcgccagccgatcgcgatcccggccatgctgcagatcggcacgccgatcaccaccgccgcagtcatgccgccgaagacggtagccagtgccgaggcccggcggtcttcgtcgaccagaatggcaccggtggccgagacggtcgggccgaccagacccgcccccagcgccatcaccgtgcggccggcgaccagcattccgtagctttgtgccagcgcacagagcacggcgcccaggcacacgcctgcaagcccggtcatcaccatccgtcgccggtcgcgatcgccgaacaggatctgcatggccggtgcggcgagcgcataggtgatggcgaaggccgtgaccagcccgcccacggcagacggggggaggttgaggtcggcggtgagcggctgggcgaagccgatcaccgacatggaggcgacacccacggtgaaatagccgccggcaagagccagcagggcaggaagacggcgggtggcgcgggtgtgacggggcatgcggacgtcctgtgcgccggcagggccggcgattgcgatggaatgtcgggtgcggagatcggatggctccggccgttgaagctgccttcggctctggcataattcaaatcgatgtttcgtataggaaggataatctgcatggatctgccgcggcatgatctgggcctgctgctgtcgctggatgtgctgctggcggaacgcagcgtcacccgcgccgcccgccggctggggatcagccagccggcgctgtcggcccagctcgcgcgcctgcgcgacctgttcgacgaccccctgctggtccgatctggccgcacgttggtgccgaccagccgcgccgaggcactgcgccagccgctcaatcgcctgctcgacgagcttcagtctctggttgccgcggaactccccttcgatcccatggccgggccggtgacggtgcgggtgatcgccaccgactatattcacgccgcggtgaccggccggctggttgcggccttcgaaggccgcggcgatgtgccggcaccggatacacgggttgtgcccgacacccgggtggtcatgatggcccacgacccgcagcgcagccgtcaggatctggaagagggctgcgcggatctgatgatcgcctcagagcccctgttgccccagggggcgatccgcagccggctgttcgacgaacgtttcgtagccgtgcaacggcgcgggcatccgcgtggtacggggccgttcgatctggatgaattctgccgcctgcctcatgtcctggtgtcgccggtcggtggcgcactgcgcggggtgaccgacgaggcgctggcggccctcggccgtacccgccggatcgcggcctcggtgtcgagttttctgcaactgccgccgctgctggcccgcacggacctgatcgccatggcgccagagcgtctggccatggcctgcacccgcgatctcgacatcttcgagccgccggtgaccgtgccggggtttaccatccatctggcctggcatccgcgccgcgaccgcgatcccaagatctgctggctgcgccgtgaaattcaggcgctgcatctgtgaccggttccgcccggccatgctatatctccgccgtcacattcgtgcaggaaggcggcccgtcatggcgaaatccgggaaacccacggcatccacccgcgccacccaggccctcgcccgcgccggcatcgccttcgagacgctgacctatgactatgatcccgatgccgagcgtatcggcctgcaggcggccgaggcgatcggggagccgccgcggcgggtgctgaaaacgctgatggccgaggtcgacggccgcgcggtctgcgtggtggtgccgtcggatcacgaggtgagcatgaaaaggctcgcccaggccttcggcggcaaggcggcggtgatgatgcgcccgaccgatgccgagcgcatcaccggctatcatgtcggcggcatcagccccttcggccagaagaagcgggtgccgaccgcggtcgaggcggcggcgatggccgagccttatgtcctcgtgaatggcggccagcgcgggcttcaggcgaagctcgcaccggccgatctggtccgggcgctgggggcggtgaccgcgccgctgatcgcctgaccccgtcagacggatccgaagcccagcttcccggcgaggaaccgccccgcctccatggcgcccgcctgggagatggtgtggccgagcccgggctcgaaccgcgcctcgacatccatcccggcttcggccagccgctcggcggcctgccggctctcttccgccggcaccaccggatcggccaggccgtggatcagcagcagcggcgtcagatgcgccggcgtcagcggatcggccgtgccgagccgccccgagaaggcgacgcccgccgccaccggccagcggccgcgggcgatgccgtccagcagcatcatcgagccctgcgagaacccgaccagcgccacccggtccagccggtcgcgaaagccctgctccgtcacgatccggtcgaggagcgcatcgaaatccgcccgtgccgcggcaatcctggcggcccggtcggcggccgtgatcgacccgatcgagaaccactggaagccggtcggcgcctgatcgaaacgatgcggcgcatccggcgacacgaacaccgcccccggcagcgccccctgccagaaatgcccgagcggctccagatcggcgccattgctgccgaccccgtggagcatgatgacgagggcggtggctgtcatgcccccggcacgcccttggtggtggaatattcgaaatgcatcacctcgcccgggcggcagatctcgcgggcggcatgggttgccgaggcggcctcggcgaagcccgagaggatcagcttcagcttgtgcggatagcgggcgatgtcgccgatggcgaagatgccgggcaggctggtcgacatggtcgcctgttcgaccgtgatgtggttctggtccagcgccaggccccaggtcaggatcgggcccagattcatcgacaggccgaagaagggcagtagcacgtcggcctccagccggcggatattgccgtccagatcggcgaccgtcacgacatccagccggccggtttccggatcaccctccaggccgtggagctggtagggcacgaccaggtcgattttgccctgggccgccagggcatgcagtttcgccacgctttccggcgccccacggaatttcgggcggcgatggatgaccatgatcgcagaggcgatatcggcaagctcgatcgcccagtcgagcgcgctgtcgccgccgcccgcgatcaccacccgcttgccgcggaaggcttccttgcgggcgacacgatagaagaccgcgcgttcttcataggcctcgatgccggcaagcggcggccggttgggtccgaaggcgccgacgccggcggcgatcagcaccgccttggcctggatctgcgtgcccttgtcggtgcccacgatccagtcgcccgtggcctcgtcgcgggaaagatccgtgacctgctggcccagatgccagaccgggtcgaagggggcggcctgggcggccaactggtcgatcaaggcctgcgcctcgatcttcggccagccggggatgtcgtagatcggcttttccggatacatggcactgcactggccgccgacatgcggcagggcgtcgatgacatgcgtcttcagcttcagcatgcccgcctcgaacaccgagaacaggcccacggggccggccccgatcacggcgatgtcggtctcgtgccgcccgccgggctgggttgcgacgatgtcgccggcggcacccggcgcgatgccataggcggcgggatcgaaagtggtcgaggtcgcggtcatcggactccggtttccgtatcaggtcgacaatggatgcggaccggcgccaggcgccgcccgttccccagatgggggcgatcttgtggctagtccatccggctcggcaaccacaatacgatcctggcgggccggatcagcctgccgctcccggaccaccgggcaccggacggcccgcggatcgagaatttatcacgtccaggttgaattcagcagccattccggaccgtggcgccggttttttgcccgggggatcaccaggcggaacggaatccggcgacagccgggtcagatcccggcctgcccccgggccatgtcgcgcctcagctgtcgggcataggttttgtagtccacctccagcgcgtagcgcgggctgtcgagccaggtccggcgctgaaccgcgtgatgacgggcgatttcgcgacgctgatcctcgggccccgccggggccatcgcaccggacagcaggctggcgagccagcgggcctggatctcgaccagtggaattgtcggcccgatcggctgcaccagcccggcaaaggcgaggccggggcaggcgggggagaggatgcggcgatagagcgccggccggctctcgtcgccgagggcctgccgggcgaggccgggatcgaggaaggggaagctggtccgatagccggtggcgtagatgatcgcatcgaagggatcgcgggcgccgtcggtgaagaccacgccatcgccgtccagccgggcgatgtcggggcgcatggtgatccgtccatggccgatcgccggcagcagatcctggctgagcgtcgcgtgttcccgccacatcggatgggccggacgcggcaggccgaagcgccgctgatcgccgaccgccagccggatcagccgggccatgatcatgcgggtcagccgggtcggcagatgcagacggcgcgagaggagcgccgaccagcggtcgaccggcacacccatcaggtatttgggcatgatccaggcgccgcggcgggtggagatcgcgacatgggcggcccgccggcacaggtcgaccgcgatgtcgaccgccgaattgccgaggccgaccaccagcacgcgccgcccttcgaagggatcgctggtgcggtaatgatgggcatgcagcgtcgtgccgtcgaattgccccggaaaatcaggcaggcgcggatcccagagatggccgttggcgacgacgacatggcgataagggatcctgcggccgtcggacagcgagacctgccagcgcccgtcgcccgccggcgtgaccgcggtgactgcggtgcggaaggtgatcagggggcggatgccgaaatggtcggcataggcctccagatgggccaggaactgggcgtgggagagaaagtcgggcaggtgcttcgggatcgggaaatccggatagcccagattgtcccggctggtatcgatatgcagcgccgcataggccgaggacatgccgttgtcgttgcgatagcgccacattccgccgatatcggaaccggtttcgtagcaggcgaaggcgatgccgcgctccttcagcgccttggcgaccgccacacccgacgagccggcgccgatgatgcagatgtcgggacagccggtgccgtcctccacgcccctccgatcaggacccgacatggccggccccctcatgcctcagatgatcggcgatgagggcgtcgaggctggcatccggccggatacccagaggctcggcccgggccgagacgaagtgctgcggccagccctggacgatgtgggccagatcagcctctggcgcgaaaccgatccctccggtggcgccgcgggctttcacggcggcggcgatctcgccgatggtcacggtgagcgccggcagattgagggcgcgtccgggcggcagatcgtcctccgccaccgccaccagccgcagcagcgcctgtaccaccgcacccgccgaggcgagcggcaccagggtttcgggcggcaggggcgagacgacgtcgcagccggccagcggctcgcggatcagtgcggcgatccggtcagagacggccggtgtcggtgcgccggggcgggtgaccacgatcggcaggcgcagggagcggccgtcgatccggccccggcgcgacagatcggccagcatcagctctgcgatcgccttgtgggtgccatagctggtggcgggcatcggcctgaggtcgtcgctggtctcaggcggcaggtcgccgccgaaaaccgcgatcgaactggtgaagatgaagcgggggtggcccgttgccgcttcggccatccggcgcggcgcctccacattcaccgcccaggcggcatccggcgcgcgttcggcatccagcgtcaggctggcggccaggtgaaagacgatgtcggcgcccctggcgccaagagccgcggccgttgccggatcggccaggtcggcggcggtgcaggcaacgggcatcgccgttccggccggcggttccggtgccgtcagatcgaccagttccagccggctggccggccccttgccgccatccgcccccggtagtggggctcctgcggcaatcacccgggccaggcgccggccgagaaagccgccggcgccggtgatcaacacgttcgtcatggacggcgtctcctcccagggtgcccgaaccggttgatccggtgggatgtttattaacatactactgagtaggatgtttccgggcaagctgctgccgctgatctggcccctcgggacggcttggcttaggatgcccggccatgaagatcgcggaggacggcgtggcgcgacgcgggcggaagatcgacgaggccgaggcggcgagccgccgcatggaactgctggaggcggcggccaactgcttcatgcgcaccggctatcacgccaccagcatcgacgacgtcgcccggtcgatgggctgcaccaagggcttcatctaccactaccacgccaccaagaccgatctgttcttcgacgtccatcgcgagggcatgcggcggctgttcgcggccgtggagccggccatggcatctgccggcgatgcgctggcggtgctccgcgccatgctgctggcccatgcccgggcaatgatggaccatcatgccttcgaaaccgtggttgcccagggcgtgcagatccaccggttcggggcgaccacccccgatcagcgccgcaccctggacgagttgatcgccagtcgcgaccgcttcgaagccctgttcaaggcccagaccctgcgcgcggccgaggcggggctgctggggccggtcgccccctcgatcgcggtcaaaatgatgctgggcgcgctgcaatggtcgatcttctggtatcgccccgaagccgatgccggagagggggcgcgcgaccgtctggcggaggaaatggtccggacgatcatcgatggcctgcgcgcgcgacccgctgcggggtagactgcctggataacgaaaaagtccagggaggttccggaggatgcagaccgtcggtgacgaggcccatcccgagatccgggcggcggtgcgggcgctctgcgccggttttccacctgaatatcaccgcagggtggatgccggtcgcgcctatcccgaggccttcgtcgaggccctgacccgtgccggctggatggcggccctgatcccggaacagtatggcggcgccgggctgggcctcgccgaagcgtccgtgatcatggaagagatcaaccgctcgggcggcaattccggggcctgtcacggccagatgtacaacatgaccaccctggtccgccatggatcggaggaccagcgccggcgctatctgccggcgatcgcggcgggcgaactcaggctgcagtcgatgggcgtcaccgagcccggcgccggcaccgacaccacccggatccggaccaccgcgatccggcgcggcgaccgctgggtgatcaacggccagaaagtctggatctcgcgcattcagcattccgacctgatgatcctgctggcccggaccacgccgctcgatcaggtggcgaagaaatccgaggggctgtcgatcttcatcgtcgacctgcgcgacgcgatcggccgcgggctcagcgtccggccgatcgccaacatggtcaatcacgagaccaacgagctgttcttcgacgagttggagatcccggccgaaaacctgatcggcgaggaaggccagggcttccgctacatcctgaccgggctgaatgccgaacgggtgctgattgcggccgaatgcatcggcgacggctactggttcatcgacaaggtctcggcctatgcctcggagcggcaggtcttcggccggccgatcggccagaaccagggcgtgcagttcccgatcgccgaaagcttcatcgaggtcgaggccgccaatctgatgcgctgggaagcctgccgcctctacgatgccggccgcccctgcggggcccaggcgaacatggcgaaatacctggcggccaaggcctcgtgggaggcggccaatgcctgcatccagttccatggcggcttcggctttgccgccgaatacgatgtcgagcgcaagttccgcgaaacccggctctatcaggtggcgccgatttccaccaacctgatcctcgcctatgtggccgagcatgtgctcggcctgccgcggtcgttctgacgggggaggggctgatggatccgcaggtgcggccgcttgaaggcctgaccgtgatcgccctggaacaggcggtctcggccccgttctgcaccgtgcgcctggccgatgccggggcacgggtgatcaagatcgagcgccccgagggcgatttcgcccgcggctatgacgatgtcgcccatggtgaaagcagctatttcgtctggctgaaccggggcaaggagagcctggtgctcgaccttgctcaggctgcggggcgggtggccttccgcgagcttctggcccgggccgatgtgctggtccagaacctgaagccgggcgctctggcccggatgggctgtgcggttgcggatctgcggcgcgatttcccgaggctgatcatctgttcgatcagcggctatggcgagaccgggccgctcgccgaccgcaaggcctatgacatgctggtccaggcggaagccggattgtgttccatcactggcgggccggacgcgccggcgcgggtcggcacctcgatcgtcgacatcgcgaccggggccaccgctcatgccgcgatccttgaggcgctgatcgcgcgggggatcagcggccggggggcggcgatcgcggtgtcgatgttcgacgtcgccgccgactggctgaccgtgccgctgctgcatcaggaaggcgggcggccgccgcggcgggtggggctgtcccatccctcgatcgcgccctatggcaccttccgcacccgcgacggcgccattctgctggtcgcgatccagagcgaccgggaatgggcggccttcgtgcgcgagattgcgggccggcccgggcttgcgagcgatccgcgctttgccggcaatcgcggccgggtggcgcatcgcgccgaggccgatgcggtggtggcggcggcgatcggcgccgatgacggtccgtcgatccgggcgcttctgcagcgcgtggggatcgctttcgccgacctcaacgacatggccggccttgccgcccacccccatctccgccggatcaccgtcgacacgccctcggggccggtcgccatgccggccccggccccggtcttcgacggtccgccccggcgctacgggccggtgccggcgctgggtgaccatctccctctcgatccggaggcggcatgacgaccgatatcgacctcgatcatctgcgcggctggatcggccgccaggagaccacgaccgaagcggtgacccccgatctggtccggcgcttccgcgccaccttcgacatcggcggcccgatcccgcagccgggggaggcggccccccggctgatccactggtgtctggggcagccggccgtggccacggccgccctcggccccgacggccatcccgcccgcggcggctttctgccgccggtgccgctgccccggcggatgtgggcgggcggcgcggttcgcttcaccggcgatctgcgggtgggccaggtgatggaccgcctgtcgcgcatcgccgaggtcacgctccgcgagggacgcagcggcagtctctgcttcgtgacggtcgagcacctgatctcggccgccggccgggtggtggcgaccgagcggcaggacatcgtctatcgtggggcccccgaccccgccgcagcggggcccgggcctgcgccggaaccggccttcctcaaacctgccccggccggtcgtcatcaccgtccggtcgggatcggcccggcgctgctcttccgttattcggcgctcaccttcaacggtcaccgcatccattacgacagggattatgcgaccggtgtcgagtgttatcccggtctcgtcgtccacgggccgcttcaggcgaccctgctgttcaactatgcagccggcctcgacggccgcgccccggaccggttcagcttccgcagcctgtcaccgcttttcgacggcgatgcggtgcgcctgcatgcttccgagaccgaggacgggttgaagctctggaccgcgcgtgacggcgggccggttgcgatgacggcggaggcgggatgggactaggacacatgcgggcagaaacagggttttaaaatgttataatataacataacataattggtcttccgatacagggaccagttccatgcccaccccgtcagtctcccatccccccacggacacacgcctgccagtcaccgtgctctcgggctttctcggcgccggcaagaccacgctgctcaaccacatcctcggcaatcacgaggggcggcgggtggcggtgatcgtcaacgacatgtccgaggtgaatatcgacgcggccctggtccgcgccggtaccgccgggctgacgcgcaccgatgcgaagctggtggagatgagcaatggctgcatctgctgcaccctgcgcgaggatctgctgatcgaggtcgggcggctggcgcgcgaggggcggttcgatcagctggtgatcgaatcgaccggcatttccgaacccatgccggtggcggaaaccttcaccttcgccgatgaagagggccgcagtctgggagatgtcgcccggctcgacaccatggtgaccgtggtcgatgcctgtaatttcctccgcgactacgcttcacgcgatgatcttcaggatcgcggcgaatccatggggcccgaggaccgccgcaaggtggtcgatctgctgatcgagcaggtcgagttctgcgacgtgatcgtgctcaacaagaccgatctggtgaccccggaagatctcgggcggctgaccggcatcctgcgcagtctgaacccccgcgcgcggatcgagaccgcggccttcggccgggtgccgctcgaccgggtgctggccaccggcctgttcgatttcgccgccgcggccgaggcgccgggctggctgcgcgaactgcgcggcacgcatgtcccggagaccgaggcctacggcatcggcagcttcgtctatcgtgcccggcggcccttccatccggggcggttcttcgcctggatcggccgcgaatggccgggtgtcgtccgctctaaggggtttttctggctggcgagccatccggcgcttgcggggacctggtcgcaggcgggcgccgtcgcccgccatggtgtggccggccactggtgggctgccctgccgcccgaggactggcccgaggatcccgcgcatgtcgagaccatcctggaaagctgggatccggagaccggtgatgcccgccaggaactggtgctgatcggcatcgccatggacgagccccgcctgcgcgccggtttcgatgcctgtctgctgaccgatgccgagatggcggccgggcctgcggtctggatcggctgggacaatccctttcccgggtgggcgtaggcatccgtcccccgcgccgcctccgcccccgcgccgcctccgcccgtctccaggattgtccgggaaaacataaccgtgtctgccgatcatcctttccgcgccgccgatacccggcttcccgacgtttccgtgaccgatcgccccgattttcccctgcccttgcgctgggtgggcttcgaaggcgtggatctgccggtcgttctgccccggcatggccggcttccggcgcgtgccggtgccagggtcgatctgccggcaccggcagtgaagggcattcacatgtcccggctctaccgattgcttgatggcctgaccgacggccagcccgtcacggcatcgcgcctgcgcgcggtgcttgaggcgatggtcgccagccatcaggattgcggcacgaccgccgccggggtggtgctcgatatcggccttccgatacgtcgcgccgccctggttacggaagggctggcgggctggcgatcctatccggtgcagatccgggcgaagctgcgcgacggcgtgttccgcatccggatgcgggtcaccgtgacctattcctccacctgcccctgttccgccgcccttgcccgggaactcgtggccgacggatttgcggcggctttcgacggtgatgccgtcgacccggcggcggcggccggctggctgcgccggcatgccacgctcgccacccctcatgcccaacgcagcgaggccgaagtggaggtcgacgcagacctcgacgacctgatgcccgagcgcctgatcgaccttgtcgagcaggcactcggaactcccgttcaggccgccgtgcgccgtgcggatgagcaggccttcgcggccctgaacggggccggacagatgttcgtggaggatgccgcccgccggttgcgggcgatgctggatgatcggtatcaggcgccgtcgatccgcgtccggcatctggagagcctgcatcctcatgacgtcgtggcggtggccgattgatgcccgaccatccgatgaagcccggacggagaccctcatgatccgcaagaacccgcgtggcgatctgccgcgtgtccaccctgatgccttcgtcgaccccacggccattctctgcgggctggtgatcgtcgaggcggatgtcttcatcggcccctatgcggtgatccgtgccgacgagatggatgccgacggccatatcgagccgatcgtgatcggggcgcattccaacatccaggacggggtggtgatccactccaaatctggtgccgcggtcacaatcggcgagcggacctccattgcccaccgcgccatcgttcacggcccctgccgggtgggcaatggtgtgttcatcggcttcaacagcgtgctgttcaactgcacgatcgaggatcgctgcgtcgtccgccacaatgccgtggtcgatggctgccatctgccggcgggcttctacgtcacctccacccagcgcatcggtcctgcgaccgatcttgcccggctgccgcgggtctccgccgatgccagcgagttctccgaagacgtggcgcgcacgaacaatgcgctcgtccgcggctacaagaccatccagaacgagttctgatccccgatgacccagccctccatcatcgtcaccctgcccgacggagcgcgtcgcagttttccgcatcccgtcaccgtgatggaccttgcagccgcgatcggccccggcctcgcccgcaataccgtggccggcatgatcgatggccgcctggtcgatgcctcggatctgatcgagcgggatgcggcggtcaggatcatcacccctgccgattccgaaggggttgagatcatccgccattcctgcgcccatctgctgggccaggcggtcaaacagctccatccggcggcgcggatggtgatcgggccggtgatcgaggacgggttctattacgacatcgccatcgaccggggcttcacgcccgaggatctggcggcgatcgaggcgcgcatgacggagctgatcgctcgcgagcgccccgtggtgaagcgcatgctgccgcgggacgaggcgatccggatctttgaggcccgcggcgaggattacaagctccggctgatcgaggacatgcccgacgaggcagaactcgccctctatttccacgacgagtatgtcgacatgtgccgcggaccgcatgtgccgaacacccgcttcctgaaggcgttccggctgatgcggatctcgggtgcctattggcgcggcgatgcccgcaatccgcagcttcagcggatctacggcaccgcctgggcggaccgggcggcgctcgatgcccatctgacacgcctcgccgaagccgaggcgcgcgatcaccgccggctcggccgggaactcgacctctatcatttccaggacgaggcgccaggggcggtgttctggcatccgcgcggctggacgttgtttcaggagctgttggcctgtatgcgccgtcgccaggcggccgccggctatgtcgaggtcaacacgcccgatgtcatggatcgcggtctctgggagacgtcgggccactggcagaactaccgccggcacatgtacaccaccgaaaccggcgacggccgggccttcgcgctgaagccgatgaactgccccggcagcgtgctgctctaccgccatgccctgaagagccatcgcgatctgccgctgcggatgggcgagttcggcaaggtgcatcgctacgagccgtcgggcgcgctgcacgggctgatgcgggtgcgccacttcacccaggacgatgcccatatctactgcaccccggcgcaggtggatgacgaatgccgcaccgtcatcgccctggtgctcgacgtctaccgcgccttcggtttcgaggacgtcaccatcaagctctcgacccggcccgagagccggatgggggaagatgccgattgggatctgctggaaggggcactcgccgacgcgcttgagcgtctcgggctttcgtggcggaccaatccgggggagggggcgttctacggccccaagcttgaattcgtcctgcacgatgcgatcgggcgcgactggcagtgcggcacgctgcaggtcgacatgaaccttccggaacgcttcgacatcgactatgtcgacagcgacggcgcccggcgccggccggtcatgctgcaccgcgcattgttcggctcgctggagcggttcatcggcattctggtggagcatcatgccggtcggctgccgacctggctggcgccggtgcaggcggtggtgttgccggtatcggatcgccatgccgcccatgccgccgccgtggcgcaggttctgaccggcgccggcgtgcgggcggaggccgatcttcgcaaccagcgtctgggctggcggatccgcgatcagcgcctgcagcgcatccccttcctgctggtggtgggggatgctgaaatggcggcggggcaggtggcgatcaccgcccgcgacggcgaggatccgggaacagtgccgttgaccgaagccgtggcgctgctggcggaacgtggccgggcgccggatctggcagcgggtattgtggcgcaggatgcgcgcctgcgggggctgatacctgtggcggtgccggcatgacggggacggcggatcttctggtgcggggcggcgtggtcatcacgcccggcggccgcgtccgggccgatatcgcctgtcgggccggccggatcgtggcgctcggcgacctcgccggatcctggtcggcgaagacggtggtcgatgcggccgggctgcatgtgctgccgggggtgatcgacagccaggtgcatttccgcgaacccggcctcacccacaaggagacgatcgcagccggcacccagggcgccgtgctggggggcgtgaccaccatcttcgagatgcccaacaccacgccgcccaccctgacagcggcggatctggaggccaagcttgcgatcgcggcccgtgatgcctggtgtgatcatgccttttatatcggcggcgccgcggccaatgcggatgatctggcgcagctggagcggctgcccggttgcgccggcgtgaaggtcttcatgggcagttccttcggcgatctgctggcggatgacgagacggtgctgcgccggatccttgccaatggcaggcgtcggatggcggtccatgccgaggacgaggcgcggcttcgcgaccgccgggcaatcgtcgaggcggcgggcgatgtgcgcctgcacccggtctggcgcgaccccgagagcgccatgctcgccacccggcgcatcgtccggctggcggcggaggcggggcggctgctgcatgtgctgcatgtctcgaccgccggggagatggcgttcctggcgggccacaagcagcgggtgagcgtcgaagtcaccccccatcatctgacgcttgaggcgcccggctgctatgagcggcttggcagccttgcccagatgaacccgccggtgcgcgatgcggcacatcgcgcggcgctgtggcgtgccgtgcgcgacggtgtggtcgacgtgctcggcagcgaccatgccccccatagccgggccgagaaggcccgaccctatcccgcctgcccgagcggcatgaccggggtgcagaccctgctgccggtgatgctgaaccatgtcgctgccggccggctgagcctggagcggctggtcgatctcaccgcggccgggccggcgcggatcttcgggattgcgggcaagggtcggatcgcggtcgggtccgatgccgatctggtgctggtcgacctgggcgcgcgccgcaggatcgccgatgccgacattgccagcctggccggctggacgccctatgacgggatggaggtgaccggctggccgatggcgaccgttctgcgcgggcaggtggtgatgcgcgagggcgagctgtcgggcctcccgtgcggccggccggtaggctttctggacgtgcccgtcagcccatcggcccctgcctgagcaggcgcaccatctcgcgcccgatctcggccggggtcttgcgtcccgggcgataccaggtccgtgcccagttgagcatgccgagcagccccagccggaacatcggccggtcggcccctgcgggcagcggcagggcatcgacgaaggtggcgaacatccgctcataggcgtcgcgctgggcgatcagccgttcggtcgcctggccgagtttggtggaatattccggcgtcaccaccgaggcgaagccgttatcggccagcagggcgtccatatgtcccgcggcggcggcctccagccgctcccacgggtcggtcagacccttgaccgcctcgcggaccgagtccgtgatctggcgcacgccttcgtcgtggaccgcgacgaacagatcctctttcgacggaaagtgataatagaccgaaccgggcagcatgccgaccgcgccggcgatgtcgcgcatcgaggtcgcctcgtagccctggctcgaaaacagctgggcggccgcttccagcagcttgtcccggcggttgttctggcgttgcgcctcgctgccttcggtctcgatcgccatgcccgtttcccgtctctgtcgtcaaagcccggcctcgtcccgaagccgcatgaaacccaacgccgattgaattgccgcgctcctgtataggcacctccgcggagggcggcaagccggcggatcggcgcaggcaggcagctggccatttaacaaacaattgtttggttaagattcacctgctagcttcggaggaatggcaccaaacgttcgttcgctcaatccccaatctcacccgagaccaaggccgcgacaagatgaccgtcgactacgacccccgcgatccgcagatccgcaacaaccccttcccgtcgttccgccgtctgcaggacgaggatccggtgcattggaacccgcatctgcgcgcctgggtcatcacccgctatgccgatgttcgcaaggtggccctgagcaggcggatgtcgcccgaccgcctgacgcctttctacgacagcctgcccgaggcgcggcgcggcgtggtcggagagctgatccgctatctgaacctgtggatggtgttccgcgacccgcccgagcacacaaggctgcggcggctgatgaacgaggccttcacccccaaagcggtggagcggctgcgccccaatgtcgagcggatcgtcggccggctgctcgacgatctgctgccgcggggggagatggatctggtgcgggatttcgcctatcccctgccggcgacggtgatcatggacatgctgggcgtgccgcatgatcagctggaccggttcaaggactggtccgacgatctggcgctgttcctgggcagtgcccgcgacgtgcccgacaagtatgagcgcgcccgtcgcggggcccttgagatgtcgtcctatttccgcgaggtgatcgccgatcgccgccggcggccgggcgaagacgtgttgagcgccctgatcgccgtcggcacgcccgaggaacggctgaccgaggacgaactgatcgccgccgccatgctgttcctgttcgcgggccacgagaccaccaccaacctcatctccaacggcatctattcgatgcggatgcatgccgatgcctgggcgcggctggtggccgatccctcgcctgagctgctggcgacggcggtggaggaatgcctgcgctatgacggcccctcgggcggcattgcccgggtggtgcgggtgacccacgagatggaggggcgggaactgaaagagggcgaccgggtcttcgcgatgctcaacgccgccaaccgcgacccgcgggttttcgaggcgccggacgacttcgtcatcgaccgcagccccaaccgccatctgaccttcggccagggcatccatttctgcctgggcgcgccgctcgcccggctggaagccgagatcgcctgtcgcgagattgcccggcgcatccccgacctcaccctcggcaccaccgcccccgactggcatgactcgttgatcatgcgcggcatcacctcgctgccggtgcacttccggccggtcaaatcggcggcggcctgaggtaagctgggggctcaatcaaaagccgacccccaggagacgcccgcccgatgacccgtgaagccgacgccgccgagacctctgaaacgcccgagacgcccctgatcgagatcgaccgcccggcgccgggcgtggcactggtgcgcatcgatccgggccccgaggggctgatggatgccgccgccgccgatgcgcttgccggtgcggtcacggcgctcgatgccgatccgggcgtgcgggccgtggtgctgaccggcgcagcgccgggcatgttcgtgcgccattacagcctgatcgaactcggggcaacggcggagaaggtggcggcctccggccggcggttcaacgacctgtcgcggccggtgaaacccgccccgttcaatgcctgtctcgaccggatccaggcgagccccaaaccctggatcgccgcgctgaacggctgggcgatgggcggcggtttcgaactggcgctggcctgcgatctgcgggtggcgctcgacgggccctggaagttcggcctgcccgaggtgcgcgccgggctgttgccgggcggcggcggcacccagcgcctgacccgcctgctgggcgaggcgcgggcgctggatttcgtgctccgcggccgcatcgtctctccggccgaggccgatcggctggggttgctctcggcactggtgcccgagggcggagacgtgaccagtaccgcccttgcgctcgccgcggaccttgccgccctgccgcggctggggatcgcccatgccaagcggctggtccgcaccgccctcgacggcacgctggaacaggggcttgcggccgagcgcacgctcttcgtcgacaccctgaccgaccccgacacccgcgctctggtcgaccgcatggcgagggatgccgacggacggatcgacgaggcggcccttgctgccgctcaggcgccggtcaaggcgcccgaagctggtacggcatgatgtcgggcggcatagtggtcgccggccgtcgcggcctgtcgtatcgccatagcggagggatctgatgaccgtgcgatttttctgggaagatccctatctcgaccggctggacagcagggtggcggcggtcgacggcgactggatcaccctcgaccggacgatcttctttgccttctctggtggtcaggagagcgatcggggccggatcggcggccatgacgtgctcgaggccgtggcggacgggcctgaaatccgctaccgcctcgccccggatcacggccttgaaccgggggccccggtcatggccgagatcgatatgacccgccgctaccggctgatgcggctgcacttcgccgccgagctggtgctggaactggccgaccggcacatgccgggggcggccaagatcggcgcgcatatcgccgaagacaaggcgcggatcgacttcctctggcccacccccgtgacgccgctgctgccggccttcctggccgatgtggccgaactcgtcgccgccgacctcccgatcatctcggccttctcggatcaggcggccggccgccgctattgggaggtcgagggtgtcgcccgggtcccctgcggcggcacccatctccggcgcaccggcgaagtgggcgcgatcacgctcaagcgggtgaatgtcggcaagggcaaagagcggatcgagatgcggcttgtggcgccgtgagtgtcgcggcagaagcaccgccttcgggaacggttggagtgacggccggaagcctggtccgcggtggcatcaccgtcgccgccaccggcttccggcgcgcgggggcaaagctcgacgccgtgctgacggcttgatcgttgataccgcctactctgtccagggtgcgttgaggatcaggctgcagaagtccgtccggcgatagccgggctcgttgcgggccagcacgtcagccttcacattgccgaaagtggtctcgggcttgagccgggtaccattcgcaaaggcgcggatgatgccttccttgaagccgtggccgcgcggatggcatgcgcagaccgcgtcccggtcctcggtagtgaaatcgtgatagccgatgccgagcacatccgcttccacgccagcggtgacgagtgcgaccacggggcgcttgtgctgaggaatgccgggcgtggtgtggagggcgattgcgtcccagacatcatcgatatcgccttcgtcgatatggtggccgcgcaggaagtcgcgggcggcattggctccgtcgacctcgaaacgttctgtggcactggcatagggtggctgaaggcccatgtcgtggaacatcgcgccaacatagagcagttcgtgatcgaccggcagtttcttgcggcgtccggtcagcgcgccgaacagaaaaacccggttggagtggtggtacagcagatcggactcggtatcgcgcaccagctgatcgcattggcgggcaagtgcgctgtcagggatacggattccggcgacggtcctggtcatggctgcctcttgttatcgaaaatgtagtggaggagagtggccggtccgcagccatctcatgcgtgctgagtgttgcaggcgtgccggagcctgggcaacgcgaccagtccgcggtttccggccgtctgtgcgtgcttttcggacgaacgggcggaggcataaggggaatgacagcgcagcgtgtagcgatcctgatccacgagggtgtgcaactgctcgacgttgcaggcccggcagacgtgttcgctgaggccaacggctttatcgacgccaaggcagactacgagatcgtgctggttgcgggacgtgcaggctctgtccgcgccacggcgggcctccgcctgtcagccgatttgtctgtcgatgaagcgggcctcgactaccatgcagttctggtcgcgggcgggccggacctccccgaggctgtgcctgatgccgctgtgacgcgctggctgaggcaggtggcagaagccgcgccactttacggctcgatctgtaccggcgccttcgtcctgggccatgccgggttgctcgacggccggtcggttaccacccactggcagaacgcggcccgacttgcccgcatgttcccctcggctcgggtcgaacacgaccgcatacatatacgtgatggccgtctggtgacgtcagcgggtgtgaccgctggtatcgatctcgctctcggcatggttgccgaggcgcatgggcgtgcggcggcactggctgtcgccagaaggttggtggtggtggcacagcgtctgggcggccagtcgcagttcagcccgttcctgaccgctcctgccgacgaacgttcgcctgtcgcccgggtccaggcccatgtgatggagcagccgtcagcgccgcatggatcggaggatctcgcgcgcatcgcgagcatgagtcctcgcaatttcacgcggctcttcttccgggagaccggtactacgccacgtgactttgttgagagcgcccgaattgatgccgctcgccgcctgctcgaggcggatgatgcgccgctgaaggcaatagcctggacatccggcttcggtggcgtggaccggatgcgggctgctttcctgcgccggctgggcgtgacaccggccgagtaccgcgcccgattccggatgccggaggtgatcaaagctccagcttcatccccagatgactgccggtgaagcccagcctttcgtagaagcggtgggcgtccttgcgggtgaggtcggtggtcagctgaaccaggctgcagccgcgatcggcggcaaggccgatggcgtggcggatgagggtttcgcccaggccctggccgcgggcggtgccggcgacgcgcacgccctcgatctggccgcggatgcggcccttgcgcgagaggcccggaatgatggtgagctggagcgtgccgaggatctggcccgccgcgtccgcgaccagctggatctggttcggatcggcggccatcgcccggaaggccgagacataggcggggtcgagcggcaggcgcggatcctcgcgggtccggcccagcacgtcatcggcgagcagggcgacgattgctggcagatcggcttcggtggccggacggatcacgagggcgggggcggtcataaggcatctcctccgggcgggtgcccgaggctgtcatgcctgtgcggcgtcgtccagccggcgagagaaaaatgcgggacggcccgggggataaggggccgccccgcaagagagccgctgctgccagggacgtgcgagcgcggccggaaagatcatggcgcgtgcgccggacccttgtggtaccggtcaggcgtcggcgcgggccaggatggcgaccgcgcaggcggcttcgtcgaagccgaccacgccgccgccattctcggcgagggcgatcttcgcatctgccacctggcggtcgcccgcctcgtggcggagctgggtggccagttccgagaccatcgacagaccggtcgctcccaccggatggcccttggagaccagcccgcccgaggtattgaccggcagccggccaccgagccgggtctcgcccgcttcgatgaagcggccgctggtgccgggctcgcagaagcccagcatctccagctgatagagttcgcagaacgaggtggcgtcgtgcagttcgaccagatcgatgtcggcggggctgagcccggcgcgggcataggccttctttgccgccaccgaactcaggcccggctcgtcgagatcgcgatatttgccgcccgacatggcgaggccggcgatgcggatcgcgcggtcgcgaatatgggcgggctgaccatcgagataatccttcgagcagaccagcacaccggcggcaccgtcgccgatgggggcgcacatcgaccgggtgagggggaagctcaccggccggtcggccagcacctcgtcgggcgaaacctcgaaccggtactgggccttggggttcaggctgccatgccagtggttcttcgaggcggcaatggcgatctggtgctgggtcgtgccccatttcgccatgtgatagcaggcctgcatggcataggtgtccatgaacaccgtccggtcggggccgtattcaaagggcttgttggcggtctcgccggccgcggcgtagtactgccgccattcgtccgggtccatctggtcgatgccgccctcgaagatctccttggtgcgttcggcatcgccgggcacgaaggtcttctcgacgcccatcgccatcgacagctcgacctcgcccgaggcgacatccttgaacgcgcccgacagcgccatcatcgccgaggcgcagccgccctcgacattgaccatcggcacccgctcggggaacaggccgtcgcgcaccagcggcgtgaagcagacctgaccgcggatgttgcgctggccccagctgcccatgccgcaattgctgaaccagccggtttcgatcccggcccccgtttccagcccggcatcggccaggaggccggtataggcctcgcgggtcagtgccttgaagccggtctcgggcttcttgccgaaggcggtcgagaaggcaccgatgatatagacgtcgcgcatggtcgggcagctccggcgtggggatcgtctcttgggatgggaacttaccaatgggtcatttggcaggcaagtgtcgtgatcggccaactccccgtcgccagggtcgatcgctccggctatatgctgacagcacggaacagtgggggactggcaggaaccgatgcgggccttgctcatcgacaaccatgacagcttcaccggcaatctggcccggctgtggtggcaggtcaccgggcagctgccgctggtggtgccgcatgatgccgcgcgctgggcggagcttgcggcagagggcttcgaggccgtgctgatttcgcccggccccgggcggccggacacgccggcggatttccggctgggggccgaggtgctgcaaatggcgctcagccccggcgcccggctgccggtgctcggcatctgccttggccatcagggcatcgccgcggcggccggcgggcgggtggtgcgggcggcagagccgcgccatggccggaccagtcccgtgcatcatcagggccatccgctgttccagggcgtggcctcgcctttcgacgccgtgcgctaccattccctgatcgccgccgaaccgctgcccgatggggtcgaggttctggcccgcgccggcgatgacggcgcggtgatggcgctcggccatgtctcggcgccggtctacggcctgcaattccatccggaatcgatcctgacgcccgatggtgcgcgactgctggcgaatttcgccggcctggccggccccgggaccgtggcggcggcggtccccgtgcagcggcttgcagtgccgccggtagacgatccctggccgtccggcctgctgcccgaagccggggcagaggggtggagggtgctgcgccggccgctcgccgagggcgtcgatatcgaggcggcggccgaccttgtccgccggctgagcggctggtcggtctggctggatcccgccgatggcgatccggcggcgcagccggtgctgatccccgatcagggaccgctggcacggcgtctgtcctatcgcgtcgccgaccgccggatgaccgttgcggacggcggcgggcagcggctggggcaggttgcgggcgacgccttcgatctgctgggggcggcgatcgaccggattggtccgctggcgccgcttgccgacggcgccggcgggcggctgcccggtcccggcttttacggctatctgggctacgaactggcggagctgtccaccggcgtggcccaccacccctccggccgggatgatctgcgcctgatcctggccgaccggctgctgatggcccgggccggcgccgatggccgttatgcgatcgaggcggtgatgctggtgccggcaggcgatgccggggcatccgctcaggccgatgcctgggcggaggcctgggccgaccgtctggcatcggccggccctctgccgccgcccgacatgacccccgtcgccctgccggtggcggcagcccatgatcgcgtcgcctatcgccgccgcatccgcgctgcccagcggttgatccgcatgggccagtccttcgaaatctgtctgaccacccgcttccgggtgcgcggggcgatcgatccctggcagagctatcgccggctgcgccgcgcggcacgggcaccgctgatggcctggctgggcttcggcgacatggcggtgctgtcgggctcgcccgagcttttcctcgatctggatccggtggcgggcatcgcgaccgcccggccgatcaagggcaccgtccggcgggccgccgatcccgtcgaggatgcgaaacttgccgcgggactggcggcgagcgagaaggaacgggccgaaaacctgatgatcgtcgatctgatgcgcaacgatctgggccgggttgcgcgccccgacggggtggcggtgccggtgctgttcgggatcgagagcttcgccaccgtccatcagctggtgagcaccgtcaccgcccggctggcatccgcgccgccggggcgccgggcgggggagctgctgcgggcctgcttcccgggcgggtccatgaccggtgcgccgaaacgtcgcacgctcgagatcatccaccggctggagggcgaggcgcgcggggtctattcgggcgccatcggccgcatcggcctcgacggttcgatgcgcctctccatggtcatccgcacggccgtggtcgatggcgacggtgcgaccgtgggggcgggcggtgccatcacccatctgtcggaccccgaggccgagatcgatgaagtggcgctcaaggcctcggcaccgctggcggcactttttcccgaaggttttgcgaaggcttgatccggatcaaggttcggatgcatccagggtttagagtgatggccatcggacgggatgccagccccgcccggtgccgcaccggcggtcgccggtggagctttcgcgcagtccccccaggaggtccggtcaatgtcctacaagagcctgctcgtccatgtcgatgatcgtccgtcgaccgaagcccgtctcgacgtcgcgcgcatgctgcaggagcggttcgacgcgcatctcaccgccgtctacctctcggtcgacgtggtgatgcccggctacatgatggagcatgtcccctccagcgtgctggaagctgcggcggaagagcgcaagaagcaggcgaagcagcgcctggccgaaatcgacacgatgctgcagcggcggcacatgaccgtcgagatgcgctccgagagcgtgatcgccaccgattacatcgaccgcgtcgccctgcatgcccgttatgccgatctgaccatcctgggccagcccgagcccggcaccgacgatgctggcgatctgctgatcgaggagaccatgttcggtgccggccggccggtgctggtcgtcccctatatcggcctgcccaagggcggcaaagtcggcagcaaggtgctcgccgcctatgacggcggccgcgaggccacccgcgccctggtcgatgccctgccgatgctgaagaccgcggataccgtgaagctgctggtgatcaatcccaagcccggccgccatggcgaggcccccggccacgacatggcccgctatctggcccgccacggtgtcaaggtcgaggtggcggtcgagaagatgtcgaccagcgatgtcggcatcggcgatgcggtgctgaaccatgtcgccgagaacgatatcgatctgctggtgatgggcgcctatggccacagccgcctgcgcgagctggtgctgggcggcgtcacccgccacatcatgggccatatgaccgtgccggtgctgatgtcgcactgatcgccgaccgcccataccgatcaggtcctgagccattgaggttccgggcccatgacggcccgccggggatgccccccttggcgggccgtcggtcgtttcggctgaagatcaggcgccggtatcgagtagcagggcgccggtgccgagaccggattcaagcctgtcatgcgcgtccgcgatgcggtcgagcgggaaacgaccgccgacgggcaccacgagcccgtcggccatgcgcgcgatcacggcggtgccggcgctccgataggcgtcgctgtccgagatgaaaccgatcacgctcggccgggcgagggcaatggatcgcgccgggcccagatcgtagacggagaccggcgggatccgccccgccgcctcgcccaggctcgcgaccataccgaaacggcgggccatgccgaagctccgggccagcatgtcgccgccgatgccgtcgatcaccagatgggcgccaccaccggttgccgcctgcaccgcagccaccgggtcttccgccctgcggtcgatcaccagatcggcgccggccgcgcgggcgagcgccgccttttcggccccgccggcgatgccgatcatccgcagccccaaccgccggccatgggcgatcgccatgcggccgatcccgccggcggcggcgtgcaccaccacggtctcgcccgactgcatcggccgcacccgcgtgaacagcatctcgaccgtcagcgcccgcagcagagaggcggcggccatgtcgtcaccgacggcatccggcagcttcagggcccgccaggccggcagcaggtgatgggtggcatagccgccataaggggcgccggcccaggcgatccggtcgcccggcgtcagccccgtgacatctgcgcccaccgcctcgaccacgccggcggcctcggcgccgatcaccgtcggcagggccggcagcggatagagcccgcggcggtggtagatgtcgaggaagttcagcccggccaccgtctggcggatcaggatctcgcccggccccggggccggcaccggcagctcctcgacacggaaaccttcggtgcccccggccgcatgaaggcggacggcgcgggtggtggcgacagcggacatggaacggatctccttcagtcccggccgcggcggggtgctgcggccctgaggctgaggatagatctgtggacatccacccaaacagctggcagctttgcgtaatctctgtggaattatccacagatccgggcgtgagcgggcgatgaactgggacgatctgcgctatttcctggcgcttcagcgcagcgggtcgctgttgggggcggcgcgggtgctcaaggtcgaccacaccacggttgcccggcgggtggacgcgctggaaaccgcgctcggcctcaggctcttcgaccggctgccgcgcggctgggtgccaacggccgacggtgagcgtctgctgccggccgccgaacgggtggaagagggggtgatcgctctcggccgtgccggtgcggcggcgggcgggcttgccggcacggtgcgggtggcggtaccaccggtcttcggcgcgcatttcctggcgccgcggctggcgcccttggcccttgcccaccctgagcttgaactggaactggccggcgatatcggcgcggtcagcctgctgcgccgggatgcggatttggcggtccggctggagcgcgccggcgacggcgagctgatcagccggcatctgggccggatgggcttcgctctctacggcacgcccgaacatgccgcccgtccgccggcgcgctgggaattcgccggctatgacgaccgtctggccggggtggcgcagcagcgctggctgatccgccaggcggccggccggccggtccggctgcgggccaatgatctggcggcgctggccgaatatgcggcgaccggcctggcgctcgccgccctgccgcatttccttgccgatcccgatccccggctggtcagggtggtggaagacaccgaaggcgaggccggccgcgacatctggctgcttgtccatgccgatctgcgccgctccccccgggttcgggcggtcatggatgcggtgatcggcgcctgtgcccgcgaccgggcgctgctcgacggctccggcgtggtaaagcccacgggggcgtccgccaccccctgatctgccggcgatggcgacccgatatgccctgtctcagaccatcgatgggggagggggaaggtcatggccgatatccgggatcgacagccgtcgcggcggcgcctgctgcatctctcggccggtgcggccgtgctgctgccctttgcgggcctcgtccggccgggcatgacgcgtgccgcgacgccggcctgcggggcaggggatcccacgccccggcagaccgccggcccctatttcagcccgggatcaccgcagaaggcggatttcacggccgatgcgtctgatggcgaggtgatgcaggtcagcgggcgggtgctcgataccgactgccggccggttgcgggcgcgctgctcgacatctggcatgccgatccgacaggtgcctacgacaatcagggcttccgcatgcgcggccaccacttcgccgacgatgccgggcgctaccgcctgacgacgcttaagcccggtctctatcccggccgcacccgccatatccacatccgggttcaggctccgggcgggccggtgctgaccactcagatctatttcgcggacgagcccggcaatgatcgcgaccggatcttccggcccgacctggtgatggcccagggggccgatggcggttacggcttcgatgtcgtggtggcgaaatagcgggcgggcgaggtgccgaagcaccgtcggaacatggcgatgaaattgctcggccccgcatagcccagcgcatccgagacgatcgccacgggctcgccggccgcgagcatctccagcgcccgcaccagccgcgcctgccggcgccattctccgaaggtcatgccggtctgggtgatgaaggcccggcgggccgtgcggggcgacagccccacctggctcgcccagtcttccagggttctgtcatcggctggatcggccgcaagcgcggtcgcgatccgggccagccgccgctcggtcggcatgggcaggtggagcggttcggccggggcggctgcgatctcgtcgagcagcacggcggtcagccgttcctggcgggcatccagccggtcggcctgccaccagcctgcggcacggcgcaccagcgcccgcatcacctcgctcaccgccagaacctgcggtccggccggcagcccggcgcaggcttcgggtgccaccagcacgctccagcccgaggtgacgccggtcatcgctccccaatgaggtatgccgggcggcatccatcccgcccggtgaggcggcagcagccatgaaccatggggcgtgcggctgtgcatcagcccggtctcgatgcagatcagctggccgcggcggtgggcatgccagtccacttcatggctgccgagcgggaaatcgttctgaagtccgataccgctcgcgaacgcgatgaccggcgggccgtcggggcggtcgaacggatccatgcgcagcgcatctcccctgcgatctggcagcttctcaacatttattgtccggatgcggttaccgctgcaagcgcccgggcgtctagcgtgatcgtcagggcgcatccgtgccccgatccgtcagaggagacccttccgtcatgtccgctatccccggcgccgatctccggttcatcgttcacgacctgtccgccttcccgctggtccgcgcccggcccgatgccgtgcagcccggctatgccgtcgcctgggaagaagagatgcaggccctgctcgaccgcggcacgcctttcgtcgtgatcttctcaggcccgcagccggaagagacgcacgaggaccgcaggcgccgggcgctctggctcaagcgcagccgcgaggtgctgggcctgatctgcaagggcatgatcgtcgtcgaggagagccgcagccggcggctggtgatggaggctcaggcgctgatggccgagaaggccttcggtgttccggcccgggtggtggcgtcggaagccggggtcgaagaggcggcgcgcgatcttctcgcccgcggttgacgcgggcggtcgtcttgcgaagtttgcgaagatggtggcagaagaattgcgaagtttgcgaaggtgccgaaacggcaaccgggatcatccccgcccaagccggcggcgaggatgatcccggagattgacggcggtcactccgcggcggcgcgactcgcctccggcccggcatcgaggcgggcgaggaggcgcttctcctcaacctcggccgtgcgcatggcgctttccttgatatggccatagccgcggatcttctcgggcacggcggcaatgtcgcggatcaggtcgcgattggccgtggtcagccgcggcagcagcccgtcgatccggctgatatagctctcgatcagcgcccgttcggcccggcgctccgccgtgcggccgaagggatcgagggccgtgccgcgcagccgcttcatccgggcgagcaggcgcatggcgctgaacatccacggaccgaacgtggtcttgcgcggcttgccggtcaccggatccggtttcgacaggatcggcggtgccagatgcagggtgatcttccggccgccgtcgagttcggccttgagcgccctggcgaagctgccgtcggtatagagtcgggcgacctcgtattcgtccttgtaggccatgagcttgtagagcgcgcgggccactgccctgctgaggcggagatcgccgccgcccggcagaagggcgcgctctgccgcctccacccgctccaccaccgaccggtagcgggcggcataggcggcatcctgatagcgcaccagttcgtcggcatagaaggccaggagttcgggcaggggggccgtgtccggatcgggcccgcctgtcacctgcggcagggcggtttcggcggccggctggtcgagcccggcggcccgcagcaccgcggcgcggtcgacggcagccttgcggccccaggcgaaggcctgcaggttcatcgccaccgcctgaccattcagccggatcgcctcgcgcagcgcctccagccccaccggcaccagccccttctgccaggcgaggccgagcaggaaggggttggcataaaggctgtcgccgaacagcgcccgggcgatgcgcgtggcatcgatccgctccagcgcatcccggccgatcgaggcctccaccgccatcgcggtcgcgccgtcgcccagcttcatgtcgggctggatcgcgaaagaggcgagcggcacgacatgggtgttggcgacgccgcgggtgcggccggcggcataggtggcgcgggcttcggcaccggcggccacgaccatgtcggcggcgatcagcgcatcgagcgaggccggcggcacccgtccgccggggagcgtggccgtaaccggcgccacccggacatgcgaggtgacggcaccgttcttctgggcaaggccggtctggtcgagcaccgaaaccgcccggccttcgatatgggcggccatgccgatcagcgcgccgatggtgacgatgccggtcccgccgatgccggtgaccaggatattggcccggccacttgcgaccggcggcaccttcggcagcggcaggccttcatccggggccgggccctcgctaccggctgccttgggcttcggggccgctgcgcgcttcgccggctttgcaccggtcacggtcacgaagctggggcagaagccctcgacgcaggagaaatccttgttgcagctcgactgatcgatctggcgcttgcgcccgaaggcggtctccagcggcttcacagacacacagttggaggtggtgccgcaatcgccgcagccctcgcagacccggggattgatgaaggcgcgcagatccggatcggccatggtgccgcgcttgcgacgccggcgcttttcggcggcgcaggtctggtcgtagagcagcacggtcacgcccggcgtctcgcgcagttcgcgctggacctggtccagctcgtcgcgcgggcggatggtcacgccctcggcccagggcgtgccggcgggatatttgtcgggctcgtcggtcaccaccaccacccgggcggccccttcggccgaaacctggcgggtgatctgccagggcagcagctggccgtcgaccggctggccgccggtcatggccaccgcatcgttgtagaggatcttgtaggtgatgttcaccttggccgcgatcgccgcccggatggcgagcaggcccgaatggaaataggtgccgtcgcccagattctggaagatatggccgtccttcgagaacggcgcctggccgatccaggccgccccttcggcgcccatatggctccagagcgtggtgcggcggttgggcatgtagatcgccatgccgtggcagccgatgcctgccagcgcgcggctgccctcgggcagtttcgtcgagctgttatgggggcagcccgagcagaaccagggcgagcgaccgggcagcggcggctcgttgccggcagaggcagccgtccccgcggcggcaccgccgcaggccgcggcgagcgccttcgaggcatcgtcgagcccgaagcgcaccgcgatggcgcgggcgatggcgagcgggtcgagcgcgccatcctgggggaagagcggccggccttcggcatcggtcttgcccgagaggcgcgggcggtcggcgtcgggcaggccgtagagcaggcgggcgagctgttcctcgacgatcgccttcttctcttcgaccaccagcacctcgtcgaggccgcttgcgaagcgcacggcgttgaccggctccagcggccagaccagggccggcttgtagatggcgatgccatgggcggcaaggcgggcctcgtcgacgcccagaaggtcgagcgcctccagcacgtcgccccaggccttgccgaccgcaacgatgccgaagcggcgccgggggcgtcgtgggtgacgcggtcgagaccgtttgcccgcacccaggcctggaccatgggcagcttgtggcggaactgccgggcttcctggtcgaccggcgggtcgggccagcggatatgataaccgccgggcggcggggtcacgtcgtcgggcaggcggaaggcatggcgcgccggatcgatctcgatcgaggccgagccttcgaccgtgtcggccagcgccttcacccccacccagcagcccgaggcgcgggagagggcgaagccggcgaggatatagtcgaccagctcgccgatggtcgccgggttcagcaccggcacatgggctgcgatcagcccgggttcggactgatgggcgacggtggaggatttggcggtatggtcgtcgccgaacaccgcgaccacgccgccgaccggcgccgtgccggcgagattggcgtgcttgatggcatcgcccgagcggtcgacgcccgggcccttgccgtaccagaggccgaaaacgccgtccttgtcggaggtgccgccgccgacatgaagctgctgggtgccccagatcgaggtcgcagccaggtcttcgttcacacccggattgaagacgatcccggccttgtcgacatgtttgcgtgcctgccagagcgcctggtcgacgccgcccagcggcgatccgcgatagcccgagacgaagccgccggtgttcagcccggccgcacggtcgcgttccgcctgcagcagcagggcacggaccagggcctgggtgccggtcacatagatgcggccctggggcagcgtgtacttgtcgtcgagcgtcaccttcggcgcggcggtcgcggcagtggtggcgctggtctccgaccgggcctctgcggttccggtatcgctggtcgccatcgtcgacccgtcctccctgggagcttgcggccgtccgggaaacgacaggacgggcggcggaaaccgccaccttacctctccctcgcgaccactggcacgggaccggcccggcaccgggcgccggtgcactgcctcttcggtagcggcgggcgggcaggcctctggaaaaggcatctcccgccacggacagctcacgaccggtccatacatgccatggtgatgcgcggccggccgatgcgtcaagtaccagacaccgttcgaacgccatgtggaccgacatacacctgggagtgatcccacctgcaggatatgcatgccatggtggcgcgtgcgccagcgacttgacccggggggccggggctctcatcctgaccgccggaccggcgaggcctgccggcgcctgatcaacgaacgaaccgccggccccgatgccggctacccctgggaggtcgcccgccatgtcgccgcagtccgtaccgtccttcgtcttcgagaccacccgcagcatcgtcagcgagccaggggcctgcaccaggctcggccagatcatgcgcgatctcggggcgacgcgggtgctggtcgtcaccgaccccggggtgcggaagttcggcctgaccgacgccgcgctcgaaagcctgaccgccgccgggctggaaccggtgatcttcgaccgcgtggtcgccgacccgccggccgaggtggtcgagaccgccgcggccgaggcccgtgatgccggtgtcgacggcgtggtcggcctgggcggcggcagctcgatggacgtggccaagctggtggccttcctggtcgcaacccctgtcgccctggacacgatctatggcgtcggcaatgccaaaggccgccgcctgccgctggtccagatcccgaccacggccggcaccggttctgaagtgacaccgatctcgatcgtcaccaccggggcggccgagaagaagggcgtggtctcgcccctgctgctgcctgatgtggcgctgctggatgccgatctcacgctcggcctgccgaagaacgtgaccgcggcgaccggcgtcgacgccatggtccacgcgattgaggcctataccagtgcgcacaagaagaacccgctgtcggacgtgctggcgcgcgaggcgctgcgcctgctgggcggcgccatccgccgtgcctgcaccgatggtcgcgaccgtgccgcccgtgccgacatgatgctgggcgcgctgcttgccggccaggccttcgccaatgccccggtcgccgcggtccacgcgctcgcctatccgctgggcggccatttccacgtgccgcacgggctgtcgaactcgctggtgctgccgcatgtgctgcgcttcaatctggagagcgagacggcggcgcgggcctatggcgagctggcgccgatcgttttccccgatctcgatcgggccggcggtgacaaggcggtttcggcgcggttcgccgatgcgctggcggggctgaccgaagagcttgggctggaaacccggctggcccaggtcggcgtcggccataatcacctgccgcttctggccgaggatgcgatgaagcagacccggctgctggtcaacaacccgcgcgaggtgacgctcgacgatgcccgcgcgatctatgaggcagcgctctgacatgacggatgaggcagccccgcttaccctgatcggatcgccgggctgtggctcggcgatcgtcgagatggcgctcgctctgctggggctgccccatgtccttgaggatctgccctatcgggagccggggcccggccgcgaccggctgctggcgctcaaccccaccggcaaggtgccggtgctggtgatccccggcgctgcaccggatggcggcgatctggtgatgaccgagagtgccgccatcctgctgcatctggccgatctggcaggcgcgcgcggggcagagctggtgccggcggcgggcgatccgctccgaccggtcttcctgcgctggctggtcttcctggtcgccgaaatctatccggcgattaccgtgcccgaacatgccgacgataccgggcttgcgggcgacccgctcgccggtttccgcgccggcatgcaggcccggcgcgacgggttgtggcggatggtggaggccgcggccgacccccaggggccgtggttcctgggcagccgcttctctgccatcgatctttatctggccgtgatgagcgcctgggccggcgggcgtgcccgctttgcccgggtagccccgcatctgggcgccatcgccggcagggcccgggccttgccccgggtcgcggccgtgctcgcccgccatggcgatatccaagacccgctccaggacggagagaccgcatgaccatgccggcccgcggcacccgcgccgactaccgccatttcctgccgatcaccacccggtggatggacaacgacgtctatggccatgtgaacaacgtggtctattacagctatttcgacacggtggtgaacgagtacctgattcgccgcgacgcgctcgacatccatggcggcaacgtcatcggcctggtcgtggaaagcgcctgccgctatatggcctcgctcgccttccccgagccggtgaccgccggcctgcgcgtcggccggctcggcaacagctccgtcgcctacgagatcgcgctgttcgacggcgatgccgatctggcagccgccgaaggccgcttcgtgcatgtctatgtcgaccgcagcacccgccgcccggtgccgctgccgccggccttgcgggctgccctggaaccgctggtggtgagctgatgtcggcaggtgcagccggtgacggcatcccgttctggaaggcgaagccgctcgacgggctcagtcccgaggaatgggatgccctctgcgacgggtgcggcaagtgctgcctggtcaagatggaggacgaggacaccggcgcggtgctctcgaccgatgtcgcctgccgcctgctcgactgcgacagctgccactgccgcgattatccgaaccgcaaggcgatcgtgcccgactgcgtggtgctgacacccgacaatctgggcgcgctcgactggatgccggctacctgcgcctaccggctggtggcggaaggccgtgatctgccctggtggcacccgctggtctcgggcgatcccgcttccgtccgccgtgccggggtcggcgcccacggccgggtggtgtcggaagagacggtggacgaggacaggctgttcgaccgggtcgcctcctggccggattaattccgcaatgcggacatccgggccggcatcttgacccctgtgatgcaggggcgttcgatggtctcaaccatgacgccgcgcagaacgcggcaccggaggaccgccagaccatgcgccgccagactttgaccgaccatatccgcgacaacgccgacgccttccagaacatcagcgacgccatccgcgcccatgccgccgaacggcccggcgcaccggccgtcgaggacgagaccaccgccctcgactggcagggcttcgatgcccggatcgatgccatcaccgccgcccttcagcaggacgggatcggtcgcggcgacaaggtcgcgatgctggcccgcaatgcggtcgacgtgctggcgctctatatggcgaccttgcgggccggcgcctgcgcggtgccgctctcgacgctggcgagtgccgaacagctggcggcgatggtacaggattccggcgcccgcctgctggcggtggatgcctattcgctgccgctgatcgaaccggcgctggaccggctgggcgatgtccggcggatcggcttcgacatggcgcccggcggcgagtggcccggtggtaactggaccggctttgccgactggctggcctctgcccccgctacgcctgccccagtggtgatcgaggcgctcgacctcttcaacatcatctacagctcgggcaccaccggcgtgcccaagggcatcgtccacagccatcagatgcgcggtgcgcagacccggcgcatccagaccatgggcttcggccccgacaccgtgtcgatcgtctcgaccccgatctattccaacaccacgctggccgccctgctgccgacggtgctgttcggcgggcttgcggtgctgatggccaagttcgatgccggccgcttcctggaactggccgaggcgaagcgggcgacccatgccatgctggtgccggtgcagtatacccgcatcctcgaccatgcggatttcgaccgccgcgacctgtcgtccttccagatgaagctgtcgaccagtgcgccgctcagggccgaggtgaagcgcgagatcgcccggcgctggcccggcggcatgatcgagatctacggcctgaccgagggcggcatctcgtgcctgctcgacgtcatcgcctatcccgacaagctcgataccgtgggtcgcccgtcggccggcgccgagatcctggtgatcgacgaagaggggcggcaactgcccccggggcagatcggtgaactggtcggccgtggtcccgcgatgatgagcggctaccacaacctggacgagaagaccgaggaaatgctctggcatgatgccgaaggccgggtcttcttccgctcgggcgatatgggtgcgatcgacgaggacggcttcgtccgcctgctcgaccggcgcaaggacatgatcatctcgggcggcttcaacatctatgcggtcgatctggaggcggtgctcttcgcccatccggccgtggccgatgccgcggtgatcggcgtgcccagccgggagtggggtgaaaccccgctggggctggtggttctgaagccgggccggcaggcgacggccgaggagatccgcgcctgggccaatgagcggctgggcaaggcgcagcggctgtcggcggtggaactgcgcgacgagctgccgcgcagccccatcggcaaggtgttgaagcgcgaactgcgcgagccctataaacaggccttcgaggcccgcgccgccgtctgatagactgatcccgcccccgcagaagcagaatacgccacgccctctatggtcgttccggctacgacggcgcccgacctcgtgtcgaccccgacgtcgcccgggccgccgggtgatgtggtaccgccgctcggatggagagggtgcatgcggagggtgttgacggtcaggggcacgctgtttgccgtgcttggccttctgggtatggtcgcggtcctggtgtcgatgaacgggcagcgtgccctggttcgggcggatgccgcgctggaacgggtctatgtcgaccgggtggtgccgctgcaggcgctgaaggcgatttcggatgcctatgcggtgtccatcgtcgatgcggcgcacaagcttcggaacggcaatgccgatcgtgcgacgaccgcggcatcgatcgatgccgcgcgcgcgcagatcgccggccgctgggcggaataccgcgcgggcgtctccggcggagaggaggcggagctggccggtgcggccgaccggctgatgcgcaccgccgatgtcgaagtcggccgtctggcggcgatcgtggcggcgggcgacaccgccggtctcgatcgtttcgtacgcgacaccctgtatgcggcgatcgatccggtgacggcctcgatcgatcgtctgatcggcgttcaggtcaggtcggcagacaccgtctaccgccaggcgcatgatgcacaggcgggggcccgattgtcgtcgatggtcctgatcggcctggcgctggcctcgacgcttgccggcatgctgttggtggcctatcgggtgatccgccccttcaaccggctgaccgccacggtcgccgccattgccggtggcgctctggacgccgaggttccggccacggcccggcatgatgaaatcggcgccttggcccgggcggtcctggtgctgcgcgacggcagtgccgaggcggcccggctgcgtggcgagcaggaaagccgccgccgtcaggcggagcaggaacggcgggccgagctggctgagctggccgcacgattcgaagcgagcatcggcggggcgatggaggtcgtggccggcgcgacctcgcgcatgacggtggttgcaggcaatgtcgccgaagcggcccgccgcacggatgcccaggctgaagccgcgtcggcgggcgccggacgggcggccagccatgtggaaacggctgccgcggcggccgaggagctttcggcgtcgatccgcgaggttgcagggcaggtcgggcgggctgcggtgacggccgcccaggcggttagcgaagccgatgctaccgaggcgcgtgtccgcgccctggtcgaggcgtcggcgcgcatcgacgacgtggtcgtcctgatttcagacatcgcggcccggaccaatctgcttgccctcaatgcgacgatcgaggcggcgcgggccggcgaggcgggcaaggggttcgcggtggtggccggcgaggtcaagtcgctcgccaatcagaccgcgaaggcgaccggcgagatcggcgggcagatcggcgccatacagtcggccgcgagggagatggtcgaggcgatgcatcgcatcggccgcgtcatccgcgacattcagggcatgtcggcggccgtggctgcggcggccgaagagcaggcgacagccacggcggacatcactcgcacggtggtcgaggccgcccgtgcggcaggcgacgcctcgaccaatgcgcacggtgtgggacgtgaggccgccgaaaccggcaccagcgccgcagccctgctcgacggtgcgcgcgaggtgaacggacagaccggtcggctgcgggacgaaatggccgggtttctgcggcagatccgggccgcgtgatcaggccgtctcgatccggccttccatggcgtccatcaggatctccaccgcttcccgcgccgactggccctcgcgcaggcccagcgcatgggcgcggcggttgacccggctgacgaggccgtcttcgtaggtagaggcggcttcgccgatccgggctgtgttgcaactgaccacgaagccggcaatggcgcgggcatcgagcgcgggcaggcgggtggtgccggcctcgtcgatgccgatgccggcatcgttgtagccggccgcgaaggcgtcggtcttgagcgcattccaggtgtcgccgccgatcagcccgccatggctgccggtgatgaccacctggccggcgtcttcggccttcaccagggcggcgctgtcgatcagcacgatccgcggccccagcggcccgcgcggtgtcagttcccggcgcgcctcggcatagggggccggccggtcgaaaggcggggtggcggttgccaggcgttcggccgcctcggcgcagctctggccgggctcgaccccggctgcgatcgcggcgacattggcatgagagatgcgaccgcgcgccatcatgtcgcggccgtcgccgatccgggcgctgtcgtgggaaacggtggcggcggcaaggccgatcttctgggccagatccagccccccgatcccggcgcgatccaggccgagcccggcatcgttcaggatcacccccctgaccttcgacaccgccgccagataggcggcatagacgccgccatggctggcggccaccagcaccgccccttccgcctcggggcccagacgggtgacgctgtcggccacgatcggcctggtggcggcagaaggcggtgtgatcgtgtcggccatgcacgtctctccctgtcgtccggccggtgtcgcggcgcgcccggcttcgtgatcttcacttcgggcatcatgcccggcagccacgcatccgtcgaggtcggggcgccatgatacggacccgctgcaccggctggccgacgacagtggcatgaagaatgatccattatgtggaacttctgttgtggccccttgtgatgccaaagcaatcagtccctggccgaacttggtcactcccgtaagaaacagcataacaaggtccaaatattggacctgagtttgacaggcctcgactgccgccgttatcgtcgttccgtcggcgtggcaccatggtgccgcgatccaagaacgcgagcccgggccatccgaggccgggcaagacgcaaccgacaccgggacagggaggaaaggtcggctcatgaccggcgggcaggacggcgccccagcggcgaccgcgagcaatcacgacattccgcgccttacggcgctccacgggctgatggcccgcatccgtgccttcgagcgcgcggccgagaccgggcagaatcgcggcctggtgctgggggcggtgcatctgtcgatcgggcaggaggcggtggccgcgggcgtctgcgcgcagctgcgccgcgacgacctgctgctgtccacccatcgcggccatggccataccctggccaagggtgccgatgcccgcgccatgatgctggagctgctgggcaaggccggcggcacctccgatggccgcggcggatcgatgcacatcgccgatttctcggtcggcatgttgggggcgaacggtgtcgtctccgccaatatcccgatcgcggtgggggctgcccaggcgatccggctgaagggcggcgaccaggtcgtggtctgcctgttcggtgacggcgcgatcaatcgcggcccgttcatggaaggcctgaactgggccaaggttttcaacctgccggtgctgttcgtgtgcgaggacaatggctggtcggccaccacccgcacctcgaccctgacggccggcgaaggtgccgcggcccgcgcccgctccatggacgtgaccgcgatcgagatcgacggcaacgatctggtggcggtggacgaggcgacccgcgatgccgtcgcccggctgcgggccggcgagggcccgatcctgatccatgcccgcacctaccggctgctgggccataccgcctcggatccggcgggttatcgcccggcgggcgaggccgaaggccgctggtccggcgacccgatgcgccgtaaccgcgccctgctggaagccgcaggcgtgcccgcggccgaactcgacgcgctggaacaggcggcgaccgacgagatgaccgcagcgctggatgcggccgaggcggccccctgggcgcccgcggcgctggcgctcgaggatgtgcaggatgccggtgcgccggcgcgcttctggacccgggaaggctgagacccatggccgacatcacctatctcgaagccggccggctggcgcttgccgaggaaatggaccgcgacccgctggtctgggcgctgggcgaggatctgggccgcggcggcgtgttcaagcagtatgacggcctccaggcccgtttcggcgcgaaccgcatcgtcgacaccccgatttcggaatcgaccatcatgggcgctgccgtcggcgctgcgatgagcggcacccggccggtggtcgagatgcgcttttccgatttcgcgctctgcgccgtcgacgagctggtcaatcaggcggccaaggcccgctacatgttcggcggccagacccgcgtgccgctggtggtgcgcgaaccgatcgggatgtggcggtcatccgctgcccagcattcgcagtcgctggaagcctggtacgcccatatccccggcctggtggtcaccgtgccggcgacgccggccgacaactatgccctgctcaaggcggcgatccgctccgacgacccggtcgtgcatatggagcacaagaacctctgggcgctgagcggccccgcggcggacagcgatgcgccggccgaattcggccgggggatcgcgcgccgggccggcgccgacatcaccctggtgacctggtcggcgacggtctggacggcgctcgatgccgctgctgcgctgggggtcgaggggatcaatgtcgaggtgatcgacctgcgtactctctggccctgggaccgggaactggtgctggaaagcgtgtcccgcacccgccgcgccctggtggtgcacgaggcggtccaggccggcggtttcggtgccgagattgccgcgaccattgccgaggagctgcatcaccgtctggaggggccggtccggcgcctgggtgcgccgcgcgcaccggtgccctatgccccgccgatggaatccgaactcaagatcaccgccggcgacgtctgcaaggcggtcaaggtggccctggggcgctgaacccgggctgggatcgacgaggaccaacgatcggaaaacgcgacgcgcgtcatacgttgcggctttcccaaaggcgcaaagaacgccgagaatggagaccgtgacgggtgtggtcgggagctgcacccgttgccgaagaaacccaagggaggaaacgaaacgatgatgatgcgtgtcttcaaggcggctgccggtgcggtcgcgaccgcggcgctgctggccacggccctgagcggcgcccaggcggccgactacaaggaagaatacaaggtctcgaccgtggtgccggcgccgttcccgtggggccttgctgccgagaagtgggtcgagctggtccgcgagcgctccgacggtcggatcaacatgaaggtctatccgggcgcacagctggtctctggcgaccagaccaaggaattctcggcgatgcgccagggcatcatcgacatggccgtcggctcgaccatcaactggtcgccgcaggtcaaggaactgaacatcttctcgatgccgttcctgatgccggaccatgccgcgatcgatgccctgacccagggccctgtcggcaaggaattgttcgacatcatcgagaagcgcggcgtggtgccgctcggctgggccgagaacggtttccgcgaactcaccaactcgaagcgcgacatcaagaccccggcggatctgaacggcctgaagatccgcgtggtcggctcgccgctctatcttgataccttcacggcgcttggcgccaacccgacccagatgagctgggcggatgcccagccggcactggcgaccggtgcggtcgacggccaggagaacccgctcagcatcttcaccgtcgccaagctgcagaatgtcggccagaagcacgtcaccctctggggctatgtcgccgacccgctgatcttcggcgtcagcaagcgggtctgggacaccttcacccctgaggatcaggatctgctgcgcaaggccgcccaggatgccggcacctatggcatcgaggtcgcgcgcaagggcatcaccgagaaggacgactcgaccttgaaggagatcgagggtctgggtgtgaccatcacccggctgtcggatgccgaacgtcaggccttcgtcgatgccacccgcggcgtctacgagaagtgggcgaaggagatcggtccggacctcgtgaagacggcggaagagtcggtcgccaaccgcaagaagtgagcctctgccggggcgacctcggtgttgccccggcctccggcctcacccggcggttctctgccgaagcgggcgtcctggacgcccgcccctcacagccttcaaccggggaacgactgccgtggcctccagccccgagcatgacgacgtaccggaagcggtccgcgaggtcgaccgtccggtcgtcagcggtcgtatcgaggaattcattgccgccctcgcgatggccggaatctgtgtgatcagtttcggcaatgtggtggtgcgctacgtcaccaacgcctcttttgcagccaccgaggaactctcgatcttcctgctggtggtgatgaccatggtcggcgcctcgctggccttcatccgcggcgggcatatccggatcaccgccatcgtcgaccgcctgccccgccggccgcgcatgggcctgatcatgctcacccatctgctgaccgtgatcatgttcgccctggtcgcctggtatggctggctgctgacgctggatgagatggaatacggcgaaacctcgccggccctcggcctatccgagctggatctacaccatctggctgccgctggtttcgatcgcgatcatcctgcgtgtcgtcggccgtgcccaccgggaatggcgggccttccgtacccacgagacggccgtcgacatcgccaccggcgatgatgtgctgccgggggacgccgccgatcttcccgggccgaagcgggggacgagcttctgatgctgaccgcaaacgtcttcctcatcggcgccttcctgctgctgctgctgctgggcacgccgatcgccgtggcgctcggcctttcgggtgtcgccggcatcctgaccgggcttgaccagtacgcgctcggcaccgttggtaccaatacctataacagcatcgcgaaatacccgttgatcgccatcccgctcttcgtgctgacgggggtgatctttgaacgctcgggcgtcgcccggcgtctggtcgaattcgccgcctatttcgtcggcccccgccggggtggcctcgccgtcgttgccatcctggtctgcatgatcatgggcggcatggcggggtccggccccgccgatgccgccgcggttgcgacggtgatgatccccagcatgcggcgcgtcggctatccggccgccttctcggccagcgtcatcgcatcggccgcctccaccgccatcctcatcccgccctcgatcgcgctgatcgtctatggcgtgatggtgccggggactgatatccgggcgctcttcgcggccggtctgatcccgggcatcctgtcggggctgttcatcgccgtccccaccctgatcatctcgcgccgtcagggcttcggggccgccgaggcgggtgaacaggggccgcggcgccgcttcctggacgtgttcgtccaggcgctgccggggctgatggcaccggtgatcatcctgggcggcctgcgcaccggcctgttcacgcccaccgagaccgcggtcgtcgccgtgttctacggcatcttcatcggcctcttcgtctaccgggaactgaaggtccgcgacatctacaaggcgctggccgaaagtgccgaaacctcggcggtgatcatgctgatcatcgcgctggccggtatcttcgcctgggccggcggcacgctcggcgccttcgacagtgcagcccgcggcctgctggacctcaccgacaacggctgggtcattctgggcatgatcatggtgatcctgctcttcgccggcatggtgctcgacggggtgtcgatctatctgatcaccctgccgctgatcgtgccgatcgcccagacctatgactggaacctcacctggctgggggtggctgatggcgatgaacatcgcgatcggccagttcacgccgccggtcgccgtgaacctgatcgtgacggcccgcatcgccaaggtgccgatcgaagagacggtgccctgggtgatctggatggtgctggccatggtgctgctgctcgcactgctgatggcggtgccggatctcgccctctggctgccgaaaaccctgggctacgtcgtctgacacagcccgcctgaaccacgaacccttccgacacctccggcccacgggctgcgcctttcccaggcgcggcccgacgggtggggtgtgctctgatccccaccgattcccgtcggtttttttcccgaccttccctgatccataaggatgacccgacaatgacgacgcgcgacgcaggcaccgcagccggtgccaatgcactgcccgacggcccgatcaccggcggtgaagcgctcgcccgcatgctgctcgcccacggcatcggcccgctcttcggcatgggcggcttccagctgctgccgttctacgatgcctgccggcggctgggcctctcgcatgccctgatcaatgacgagcgctgcggcgccttcgccgccgatgcctatgcccgggtcaccggccgggtcggcgtctgcgatgccaccctcgggccgggggccaccaatctggtgacggcgctggtcgagagctacaatgccggcgtgccgatcgtcgccatcgtcggcgacacccatcgcgaccattcctggaagaacatgacccaggagacccgccagctcgacatcctgcggccggtggtcaaggaagtgatccgggtggagcgcacccaccgcatccccgaactcgtccgccgcgccttcgccgtcgcgacctcgggccgccccggcccggtgctgctcgacgtgccggaagacgtcgcccatgacgagatcgtcttccaggcctcggacttctatgccgatccggccgccgaggcggcgccctcgctgcgctgccgcccggcctcggccgatctggcccgtgcggctgatctgctggccaaggccgagcgcccggtgatcctggccgggggcggcgtgcatctgtcgcaggcggcgccggcgctggaggccttcgcccatgccttcggcattccggtcgctcacacgctttcgggcaagggcgcgatcgcctgcaccgatccgctgtcgctcggcatcttcggccgctacagccgcatcgccaacgacgtgatcgaaaccgccgacgtgatcctcgccatcggctgcaagctgggcgagatcgcgaccaagcgctacagcgtgccgcccgcgggcaagacgctgatccatctcgacatcctggccgaggaattcgaccgctgctatcccgcgaccgtccggctctggggcgatgcgcgcgaaggcatcgaggcgctgacggaaaagcttgcgcccaccgccgaggcggcccgggccgcacgtgcgggctatgccaccgagatcgatgagcgcatggcgaagtggcgggccgaggtggcgccgaagctcagctccgacgagcggccgatcaccatggcgcggctgatgaccgaggtgaccaaggctctgcccgccgatggcctgctggttgcggatggcggttttgcggcccattggggcggcctgctgttcgacaccaagcgcgccggccgcggcttcgtgcccgatcgcggcttcgcctcgatcggctacggcctgcccggtgcgatgggctgtgcgctggcggctccgggccggccggtgatggcgctgaccggcgacggcggcttcaacatgacgctgggcgagcttgagaccgccctgcgcatgaacctcgccttcaccctgatcatcgtcaacaacgcggcgtccggctatgtgaaggcgctgcagcacctgatgtacggcaccggcaattaccagtcgagcgatctgcgcgagatgaactacgcgaagatcgccgagaccatgggggccaagggcatccgggtcgagaatccggacgacctgtcgggcgcgctggcggcggcgatggccgagcgcggccgtccgacggtgctcgacgtggtggtcacccgcgatccggccaacatgctgccgggcgtcgacagccgggcggtgaaggccaagaagggcgaccgcgtcgcctgatcaggcagcggccggatcagcagaatacctgatcccgaagggggctccgtgctagtctgacgtggtgtcatcccatcgtcacgtgtacggagcccccatcatgaccgagaccacgccccggcgcccgcggatcgccgtcaccggcagtgccggcaccggcaagaccacgctggtcgatgcgctcggccgccatttcggcctgccggtggtgcccgagcacatgcgcagccggatcgaggccgggctcgacctgcacaagctggaatggccgcagttccgggcgctgatccgcgagctgtatgacgaacatctggcggcacgcgatgccgcgatcgccgaaaccggcggcgccgtcaccgatcgttgcccgctggacacgctgggcttctggctgcattacggcttcggctccgacgaggccgaaaccgatgcgctggcggcggatgccgtcgcccagatggcgccgctcgatctggtggtgatcctgcccgcgggcgccatacccttcgtcaccgacggcgtccgctcgcccaatcgctggctgcagatcaagttccagatcctgatcgaaggcctgctggaacgctttacccccgacgtgccggtgctgcgcatgcccgccgacgtgctcgacccccaggcccgcatcgacgcggtgctggcggccctgcccgaaggggtgcggtgaggggagaagaagaaggtggatccccgcctgcgcgggcgtgacggcttcctctttttttacagagagttagccccgcgcaagcggggttccccctgtttcgggcaggagacctgccttcaattcacctggtttttgaccttgtcgaacttcagcttcggccagtcctcgaccgtgcggttcaggtgccaggcgttgcgggccaggaagaccggccggccggtgtggtcgtcggacagcgccgagacgttgttgtcggcgaagcgcttcatctcggccggatcgcccgacacccagcgcgccgcataggcctcgacggtttcatacgatacggggatgccgtattcggtgcggatgcggtcggccagcacgtcgaactgcagagagcccaccacgcccaccacccaggcggaggaggtgatgcgcggcttcatgaccgcggccacgccttcctcggccagctgttccagcgcccggcccagatgcttggccttcatcgggtcttccgggcggatgcggcgcagcagttccggcgcgaaggaggggatgccggtgaagcggatctcctcgccctcggtcaggctgtcgccgatgcgcagcgtgccgtggttggggatgccgatgatgtcgccggcaaccgcctcgtcggcgatctcgcggtcctgggccaggaacatgaccggcgcgctgacattgaccgccttggtcgatcccaccggcagcaggcgcatgccgcgcttgaaatggcccgagcacagccgcacgaaggcgatgcggtcgcggtgcttcagatccatattcgcctggatcttgaacacgaagccggtgaccttgtcctcgtcgggcgccacgtcgcgcggcgtcgccggctggcggcgcggcgagggggcgagccggccgacgccttccagcagctcgcgcacgccgaaattgttgagcgcgctgccgaagaagaccggggtcatgtggccttcgcgataggcctgcaggtcgaaggccgggcacagctcgcggaccatggtcacctggtccttcagctcctgccactggtcgcggggcagatgctcgccgatggtcgggtcgtcgaggccggtgaccgagaacgaggcgtcgttgatgctcgaccggtcgccgcgatccatcagcaccatgcggtcgtcgagcacgtgatagcagccgcggaaatggcggcccatgccgatcggccaggcggccggggtcacgtccagcgccagggtctgttcgatctcgtcgatcagctccagcgggtcgcgggcctcgcggtccatcttgttgacgaaggtgatgatcggcacgtcgcgcaggcggcagacctcgaacagcttgcgggtctgttcctcgatgcccttcgcggcgtcgatgaccatgatcgcgctgtcgaccgcggtcagcgtgcggtaggtgtcttccgagaagtcctcgtggcccggcgtgtcgagcaggttgaaggcgaagccgtcatgctcgaagctcatcaccgaggccgagaccgaaatcccgcgctcgcgctccaccttcagccagtccgaccgcgcacgccgctgctcgccgcgcgccttcaccgcaccggccatctggatggcgccggagaacagcagcagcttctcggtcagcgtggtcttgccggcgtcgggatgcgagatgatcgcgaaggtacggcgacgcgcgatctcggcgccgatgtcggtgatgtcggtcatgcgctcggacgggttcggaggaagggaagggcttcgttcggggaacgggcttcgtttcgggaaaggtctcggtttcccggggcgataggtagcgcgtccgggcgcgattttccagggacttcggtcggatcgggcggcataatcgggcaagcctcccctgcaggcgatgtcacggctgtgccccgtccgcgccgtttgacggacgggaaaccgccttttcgaaagcagcaggccgaagggtggcggtcgggggagcagctaagggagacgcggtgatgtcgaagatggatatgcgtcacgccagactgttccgcgccggccctgatcaggccgtgcggatcccgaagggttttgaactgccgggcgacgaggtgatcattcaccgtgagggcgaccgtctggtcatcgaacccgtcgccaggccggggctgctcgcgcttctggcgacattggagccgattgacgaagcatttcccgacgtggacgaaggtctgcgcgcccgtgacacgaacctccgggtgtcctgtcagggggctgggcttatggtcgagaaccggctcgactgagctggagcgccttcccggcagctacgcccctggcggtcactgccgtatgccgcctcaacatccgaccgccacgacccggggcggtgccgcggatgccccggccgccatgtccggggcgaggtcgaggaaggcgaggatggccgagaggatggcggcctcgtcctggtccggcagatcggcgtagtcatgcccgcccggcaccggcagaatgcggatggttcccgagagggcataacgcccggcatccaccgccgtgccatagggatcctgatcgccctggatgatcagaaagggcgtatcgagccgggcgaggtgatcggtgcgggccgggtcttcgtcctgcaaggggtgcctgaagggatagccgaagcagacgagccgcgtgatcctggggtccgcgccggccagcgaggtcacgatcccgcctgcggaatgggtgaggcaccagatccgctttgccggcagcccgtcgaggaagtcccgcagatcgcgggccgcgacgacattcgcccgcctccgtggccggagggcatagtcccagcggtcgggacgggtgagcaggatcatcgatttgatcagccgttcgacgatccacccgagagcaggccaccggcggcgcagcgccctgacctgcgggccggccagggcctcgaacctgcggtcgagcagcttgaaggtccgggtggtgcgcgtctccagccagcagaccgggatgccccggtcgtggatcacgccaatgatccggtcgatcatcgacgaggcccgccgataattgttccggcccatgacgatcagcagggtgtcggcctcgggcgaccccagatggcgaaccggcccgatgcccggtctcgcgaaaaaatgggagatcggcatcggtggttcactctgtgcgttactgcatatggcagcctgttttattgtaagcgggtgatgattgcctcacaagcgggcgtgcgccaattccgtgcgggggcaggcgcatgagagcctgaggcatgttccgacctgcgggagacggatccatggccgaactgaccgatgccgcaatcgatgccgccctggagcgcggccgccttgcccatgcgcaggaaccgcgcgccgcggcggcacgctatgaccgcggcgagggcctggtcatcgtcgatctggagaatggctgcgtcttcgcctttccgccgcggctggttgcggggctggatggggcaaccgctgatcagcttgccgcggtccggatcctcggcagggggtatggcctccattgggaagaactggatgtggatctgtcgctgcccgggttgatggcggggcgcttcggtcccgggatctgaccgaaatggcagacggagcgggcccgtccgatagcgggcgctactgccgcccgcgctgccgccaggcctcgggcggcgtgaaccggccggcccacaggccacggccggcggcgcgggcgtcggcttccggtgtgaggtaaaggccggaatagcgacgataggccagcgccagcccgtcgcgcaccagccgggcgcccagatcctcgccgttcgcctggcagagggcgagggcgcgcttatagcggtcgcgccctgtcaccacgcagaccacctctcgtccctgtatgagtgcacgcaaagcctcgcttgcggccgccccgcaggcccagggccggccttcgccgtcggtacagatctggtccgtctcctgtgcgtcgatgccgtaaagccggacccgctcacccgcaacttccaatgtgtcgccgtcgatcacccgtgcttcgccggccagttcccgggcgagagcatggggcgacgccaacgccaccgccaaggcggcggcgcatgccgctcctgtccttctcatccggtccaccaactgaagcgcaggacggcgcgcccgccgtgagatgcgcttgagcttttggcttggtggccggggttgagaaaaccgtcacatgagcggccctcggacctttaggcggagccttggacatacgtccgagcccccggccgcaagagccaagatagccgattccagttcggcagaccgcatgtgaaggggtttctcacgccccaggcaccggctgcgtcctccggttcccggctcgacaatgccatgacggtggggataacggaaaggaaaaccgctctatgcgcggcccgcgcgataaatactgaaggatgtcgcagcttttattattctagccgcatggaatatcgcggtgcggatgtatccggtgctgaaatgcggggaagtccaccgccaggaaaaccggcatgaagacgcgttgagcggaggcgtacctccgcccttcggtcatcatcctggactgccgaagcttcgaccgggggtattcagccgatcatgcaatatcggcccccgaacttttcaggccaccgcccttggacatcgttcgggcccccggccgcaagcagtcgtccggcctggggcgaaaaggccggattaccgcatgtgaagggtttctcacgccctgaagcagattgcggcgatcagcttcatgagggagaatagcagagaaataatagttttaaaatgaagaataagacaacttataggagtggaggaattttctgcataactgaaggactaagcagctctattgtgcggcaagccgtcattttatcaagggattatttgtcaaattcaagttctaattgttttttatattgggcagcttgatagtgccagataagtgaatcaaaatcacgccgtgaaatatccagtaagtccgccgcaaaattgaagacgtctcggagataagcgtagccgttattctccagtcccgcgagttctgcgaaattctgaacgtgtcgatccacagcgacacaatccatgccaaccaagcatgccatatagtcaatggttttgggccctataccgtggattttctgcaaacctgagcaaaaagtctcctcccgtaaagacattagaagttcgtcagtattctcaattcgagcatttgatataaaagaaactacattctcaaatcgggatattttttcattatgcgtccactgtaggaattttgaagttccttcatcctgcataatttgtattaccgagccagtggtcgatgcgtgaggaaatctttcaagtatgtaatggatccggggccttataattttctcgtaacttagccctgcctgaagtgtagcatcagctagtacagcgcccatgtggtgataaataggtctgcaggggggccggttcagcatgatgccagtctccacagcgcgatcagcaacgcgtcgtgcagcatatagtgcatctatatacgttaattttcgcgtcattttcctcaacccactacacagtggacgcttccgctaaggcttttaatctctcgacgcagtttggacaagctccgcacggaaacgagcttgaggcctgacaagagaaagtgcgaccgattggcacgttaagttccagggctcgtcgtataacatcagctttagtattttttcgaaacggtgcatggaaacgcacagcacccacccccctggatagctcatcaagaccattcataaactcggtactacagtctatttctttggcatgattgctattgataaaaccagaatatacatcgagaattccaagagtctgtgcacgggccgctgccacggcaaagaatagcatggtccgatatggcaggtaaagatcatcatctgatactgactctctccaaagatctgcctcgcagatcatccgagagcgtgatccaataaaaatgtccgaaatatttagacgctcaggtcttaagacttctggcggcagtaattcattaacatttttccactctatctcaacgcaatgctgtccatagtcaaaaaatattggctgaattttaatatccattttggtgagtaggtagcacacagtggttgaatctaggccgcccgagaccattacgacagcttttttcatgggttgccagcctgcaattttgataggacatcaaaaagaccatttaagcatatatcgaggttgcttgaataaacggtgctccccactattaccatagtgttggcattttcttggagcggatcataggtaactagaggcttcttatttgcaatggccactcccatctcgataagagtacccggatcgcgtcccaaaggtaaggcgaatactacggcacactgactgagaatatttaggtcctcggcgtaaattttatgcatatgatgctccgcactgttagggttgagttctccattttcttgtatcggcctgcgaagtaggaaattatgataattgagggcattgataacctcctcaatatacgttcgatctatgtatgaaaaatcgggggctgcaaagtatattggaaaaagccgtcgcacgtgccaagatagatttgttcctccaagatcacgcatttgctcgactgtgagtgccaagctgcgttgaacatctctccgaaaatcgtcagggtatgtagtttgcgcatagcatgtcgcagctctcgccgctttccatgctgcgccgaatacgtctgtgctgatcaagtaagtaaatacagcggaataaacatcacctacgcccactgaattggtagtttgaccaagaagggctgggacttcgtccccttgatcagtacggagatcaaatacccgactaccaccgcgattttctttcaagagaacaacatccggagataggtgacgtaggcaattcagcagcgccgatatatcatccgatgctctttctaaaaaaaatctggaggaagttgacgtaataagagcagatatctgtcctgaaaacggggagagaatatcaatatcgggaatgtcgtaagcgatatctatgctgatctgcgccttatcagctaatatattctttaggtctccgatgttatattttcctggaaatatcaggcaggaactataattttcgagatttgcttcgccatcatttatttcgcaatatttctcttctaggagaagatcttcatagttttggtctccaatttcgagagggtccctaatcaccataacattcggggcccccttaacttctccgagccatatgaaattactgcattgaagttcttggaggaagtggcgtgcttgatctactagatatcttgggcagatcgcggctactgcatagctggcgttgatagcccagagaccacgtgctgcatgtatgatgccaccaagccgtaacttactgcttgtacctgtcgtgggtagggtaaaatctatgtaaatctcgccgatcagtagaagtgcggaattttcgctcatggttcacccggggcaaaatcaacgctaatagaagtgaatggagttgatgacgatgttacgactcggcccttataggtgaagcccgccacaatgcaatccgctatgtagttaaattttgtcggtaaggcgcccacggattctccattcgcgtccactgtgaatagtctccgctgatgtattatggataaaattgtattcgtaggcggggcggatttatgttttaaaaaataggaacaaagctctacctcttccaaaatgcaagagaatgcacgtccacaacggtcacctccgcttgcgccgctaccaacttcattacctgttcctttcgattgagatcctgggtagtctgttaacctgccagaaccgctgctacccatgccagacgctcctttggatatggtccttctagtttatttttggcgatacatattaaatttcaagtgcatcttcgatcggaagagagggtcttggagatggctgcgtcttcgtgtcggtggtgcgcagcggccgtggcgctcccgcgccacggccgcccgcctcacctcacaccagatcaaaccgatccgcgttcatcaccttcgcccaggccgccacgaaatccgtgacgaatttctcctgcgcgtcgtcctgcgcatagagttccgcataggcccgcaggatcgagtttgagccgaaggtcaggtccagttcggtggcggtccatctggtggtgccggtggcgcggtcgcggaggtcgtagaggccgccgccggcaggcgtccaggtcagggacatgtcggtcagggtgacgaagaagtcggtggagagcacgcctgcgcgactggtgaagacgccgtgtttcgtgctgccgtgattggtgccgagcacgcgcatgccgccgaccagcacggtcatttcaggggcggtcaggcccatgagctgggtgcggtcgagcatcagctcggccgggctgacggcatagtcggccttcagccagttgcggtaaccgtcgtggatcggctccagcggggcgaagctgtcggcgtcggtcatctcgtcggtggcatcgccgcggcccgggtggaaggggacggtgatgtcgaacccggccgccttggccgcctgttcgatgccgagattgccggcgagcacgatgacatcggcgaggctggcgccgctttccgccgcgatcggggccagcacgtccagtacccgggcgaggcgggcgggctcgttgccctcccaatccttctgcggggcaagccggatgcgcgcgccattggcgccgccgcgcatgtcggagccgcgataggtgcgggcgctgtcccaggcggtgctgaccatgtctgcgaccgaaagcccggcggcggcgatcttcgccttcaccgcgtcgacatcccaaccggtcgggccggccggcaccgggtcctgccagatcaggtcttccgccggcacgtcggggccgacatagcggattttggggcccatgtcgcgatgggtgagcttgaaccaggcgcgggcgaagacctcggagaaatagtcctgatcggcgtagaacttctcggaaatcgcgcgataggccgggtccctgatcatcgccatgtcggcatcggtcatgatcggcatgcagcggatcgaggggtcctcgacatcgaccggcttgtcttcttcgcggatctcgaccggttcccactgccaggcgccggccgggctcttgcacagctcccactcgtggttgaacagcatgtggaaatagccgttgtcccagcgggtcggatgggtggtccaggcaccctcgatgccgctggtgatcgtgtcgcggcccatgccgcggccggtggggttggcccagcccaggccctgcgcctcgaccggcgcgccctcgggctcgggtcccagcaggccggcatcgccattgccatgggtcttgccgacggtatggccgccggcggtgagtgccacggtctcctcgtcgttcatcgccatgcgggcgaaggtctcgcggatcgcctgggcggtcttgagcgggtcgggctggccggcgacaccttccgggttcacatagatcagccccatctgcaccgcggcgagcgggttttccagcgaggtttcggcctcgctcgcatagcgctcccgcccgagccaggtggtctcggggccccaatagacgtcgagttccggatgccagatgtcctcgcggccgaaggcgaagccgaaggtcttgaggcccatggtctcgtaggcgatggtgccggccagcacgatcagatcggcccagctgaccctgttgccgtatttcttcttgatcggccagagcaggcgccgcgccttgtcgaggctgacattgtccggccagctgttcagcggcgcgaaacgctggttgccggtgccgccgccgccgcggccgtcggaaatgcggtagctgccggcagcgtgccaggacaggcggatcatcagcccgccgtaatggccccaatcggccggccaccagggctggctgtcggtcatcagcgcgcgcatatcctgcttcagcgcctcgaaatcgagcgtcttcagcgcctcgcgatagctgtagccgcggccgagcgggttggtcttggtgtcatgctgggacaggatctccagcttcagcgatttcggccaccaggccgtcaccgagctgtcggcggtggtgttgccgccatgcatgacggggcatttgccgccttgggggttcatctcgttcatcgcgtcctcctgccgtgctccgctgtcgggctggtcttgttgatgttgatgaagaagaagcatatggcgccggaatgacggatgtacgagccgaatcgggggatcggatgaccgttgtcttgcacttctcccgctctgctcgatatggtgccggacatcctgctccaagccaggtccggagacctctgccccatggccaatgccgcgacggaagagctgatcgagaacttctccctgttcgacgactgggaggagcgctacgcctatctgatcgatctgggccgcaaactgccggacctgcccgaggctgaacgcacgcccgaaagcaaggtcgaaggctgcatgagccaggtctggctgctgagcgaggtggagccgggcaatccaccggtgatccgctatcgcgccgacagcgacagccagatcgtccgcgggctgatcgcagtgctgatgaccgcctattccggcgagcccgccgaccggatcatcgccaccgacatcaacgacattttcaaccgcatcggtctggaccggcatctgagccccaaccgccgcaacggcttctacgccatggtgcagcggatctcggacaccgccgcccgggcgatgaaagcttcgtcctgagagcagccccttccggagtgtcgcaccgccatggctcaagaactgacgatcaccggcgaagcacccgcggtgctgcgcaattcctccatcgaccgggcggcgctggcccaggcgcgcatcgatctggccgccagcctgcgcatggcggcacggctgggctttgccgaggggatctgcaaccatttctcggcgctggtcccggggcgggatgatctgttcctggtcaacccctatggcctcgccttcgccgaggtgaccgcctccagcctgctggtctgcgatttccacggcaatgtgatcgagggcgagggccggcccgaggcgacggcgttctacatccatgcccggctgcacatgaagaagcccggcgcgcgggccgccttccacacccatatgcccaatgccaccgcgctgaccatgatcgagggcgaaccgctcgctcatgccgggcagaccgcgctcaaattcctcggccggaccgcggtcgacccggtctataacgggctggcgctggatacggccgaaggcgaccggatcgccgcggccatgggcgatgccgacatcctgttcatgcgcagccatggcgtgatggtcaccgccccctcgatcgccgaagcctgggacgatctctattttctggagcgtgccgccgaggtgcagatccgggcattgcagaccggtcgtccgctgatcccggtgccggcggatgtggcggccatgaccaacgcccagatgcgtgacgaggatgccgaaagcgcccggctgcatctggaaagcgtgaagcggatcctggcgcgcagcgagcccgattacgcggattgagccggacccacgggcggccccggggggggaggggcgccggcgcgcgccctccgtccggcttgcagccgggcgcatgtaggggtctgatggggggcaccgaccgacgtgcaggagaccccgacccatggccagagcagaggcggcaatcggtgccgcacgctatgccgtttcgatccggaccggcaaccaccagctcgttgccgacgaaccgcagaagctcggcggcgccgatgccggcccggcgccctatgacctgctgctggcgagcctgggcgcctgcaccgccatcacgctcaagatgtatgccgagcgcaagcagtggccgctcaaccaggcgaaggtcgcgctgcattatctggtcgagaacggcaccggccggatcgagcgggtgctgaccctcgacggcccgctcgacgatgatcagcgcgcgcgcctggccgacatcgccgagcgcacgccggtgacgctgacgctcaaatccggcctcgcgatctcgaccagcctgtcttgaccgccgatcccgatacccggcccgccagaggccgggatctgcaaccgatgcccgaggaaatccccatggacgagctgatcagggcgaccgcccgcgatctggtcgcgcggttggcgcgcggcgaggtgaccccgaacgacctgctggatgcgctggagcgacgggtcgaggcggtggatggcgccgtcaacgccgtggttacccgcgccttcgatcaggcccgcgccgccgcccgacactggatgccgacgaccgatcgccgccgtcagccgggccggctgcacgggctgccggtggcgatcaaggatctgaccgcgaccgctggcattcgtaccacctatggctcgccgctcttcgccgggaatgtgccggcgcaatcggacaacgttgcggcccgactggaagagcgcggcggcatcatctacgccaagaccaacacgcccgaattcggcgccggcgcccagaccttcaacgaggtcttcggcaccaccaccaatccgtggaacaccagcctgacccccggcggctcgtcgggcggctcggccgtggcactggccagcggcacggcctggctggcgcaggggtcggatctgggcggctcgctgcgcattcctgccgcttttaccggcgttgtgggtctgcgcccgaccccgggccgcgtgccccacggcccctcggtctcgcccttctcgacgctgtcggtcgaggggccgatggcgcgcgacgtggccgatctggggttgatgctcgatgccatggccggccttcatccgcgcgatcccctgtcgcgcgaggcggaggcggggctgttcgaagcggcggcgactgcgccgcgcaagccgcggcgggtggcggtttccgtcgatctggggatcgtgccggtggcggcggaggtgcgcgccgccttcggtcgcgcggtcgaccggctggcggccgagggcgtcgagatcgtgccgctcgagaccagctttgccgaggccgagagcgccttcaaggcgctccgcgccgggctgatggccaccctgcacgaggatatgctgcaggcccatcgtgaccggctgaagccggatctggtctggaatatcgaacacgggctggggctggatgccgcgacgcttggccgggccgagcgggcgcgggcgaaaatgacgctggatctgatcgatgaactctcacgcgtcgatctggtgctgacccccaccgtgctgaccccgcccttcccgcacacgatccgggcgctggaggaaatcgaggggcatcggttcgagacctatgtctcgtggctggcgctcaccttcgcgatcacgctgaccggcacgccggcaatgtcgctgccggccggacgcatggcgggcgatctgcctttcggtctgcaactggtcggccggccggcggatgaggcagcattgctgacccatgcggcctggatggaaacggtgttcacacccgtcagggaagtgcccgtaaaccctcggattcctggctaaatctgcctatccgggcaggcagatgaatctcattccattgtatgattaatacctacgatagactgtagaagtccatgtaatggactatcgggcgggtcctgcgcaggtgtgcgcgggtctcgcctttttctttgaaaaacaggtggttgtggtgcctgatccgtggcgcttgcgccccatgggagagttgcgcaatccgaaactatcctgaatgtgcatatgtccaattccccttctgcgttcatgatgcgaaattcgatcgctttttatgttgagaatacatcctggaagttgctctaatacacgccagggatgcaatgaccctcaatgatagcgacagcgggccgataccggacccaacccgcgcggggccacccgaccctttttgatcggggcgacatgaaccgctgcatcggtacggccggcacggccattgccggcgacggcggagacaaagggggacgacgatgaaatccgagctgcgaaaggcccggtcgcgtgaacgtgtggcacgcatccaggccctgacggcggaggaccccgtcctcggggcccgcctcaaccgcatcctgacccacgcccggaacgtcagggtcaccgaataccacctgaccaacgcctgcaacatccgctgcaagggctgctggttcttcgaatacggccacgacaccgccacccgcgaggtcaaggatctggcgacgctggagagcttcctcatcgacgagacgaagcgccggcgggtgaatgctgcgctggtgatcggcggcgagccgacgctgttcccggaccggctgcggctgttcgtgaagcacctgcgctatgtgacggtctcgtcgaacggtctcaggcgtctgccctgggacgggttcgaagacgtgaacgtgatgctgaccctgttcggcggcggcaagctcgacgacgagttgcgcgcgatcaagccgagcggccggcagttcaccggcctgttcgagacggtgctcgagaactaccaccaggatccgcgggcgaacttcgtctatgcgctgaccgaggacgggatcgaatacatcgaggacaccgtccggcgcatcgccgagaacggcaaccgtctgtcgttcaacttctacagcaaatacggcaccgacgatccgaccgcccaggcccatcaggatgccctgctggccgaggcgctgagggtcaaggcgctctatccggatgtggtgctgagccatccctattatatcgaagcaatgatcaccggccggacccattggggcgccgatttcggctacgacgtctgcccgtcgatcagcatcgatcatccggatcatgccgagcggctggagaacggcaacccggtgctgcccttcttcaacacctgggcggcggacctgaagacggtgaaattctgctgcacctcgggccattgcgacggctgccgtgacagccaggcggtgaattcctggctgatggtcagcatggaccgcttcctggacagccgcgagatgctggagacctggatcggcatcgccgagggctactggaatcagttcatctggacgcccttcaacccctatgccgccgcccatcagacgatgaaggcggagcgggccgggccggtggaagaggtcgaggacggtggccatgtgcccgcgcgggtgccgcatgcaccggcggtccccgtctctgctcagttccagggcgtcggacactgatcgccatcctgcgggtcgcatctcgcaggaaggaggggagatgacggctgcagatctgatcacgggtccggaggggggaacccccgacgccgtgctcacccgcctgaacgcgctcgatgtgctggtccattccggcatccgtgtgaccgccggccccgatggggcggtggtcgcgcgggtggcggatccgggccccgagcatgtcgagcagggggcggcgggaccggtgatcaacgtggtcatgatcatggggctggccgattgcgccctggccgtacccgccattctggcggccggcggggcgcggtgcgccacgctcgaaagcgccatcaagctggcggaaccactcaagcccggccctttcgagggacgggggcgggtggtcggccggcagggcgacctgttcacggtcgaggtgacggtcgtcgatgatcagggccggatcggtgcgaccgccacggggctggtcgcccggatctgatccaacgagccggcggccatgcaccgccagccaatcggcctcagggggttactgtggccattttctcaatcacaggtaaatccggagacaggacatgaacgagtccgttgcaagcgccgccgaagcccccctgatcgtcgaggggcccgagcagttctacaagatgccgaaggaatatcaggatctggtcatccatcagcttcgcgcccataccgagggcgagctgaccggcgcggacgactacacccagctgctctatccgatggcgccggatccgtatgagcgcaagatgtgctgcgagcgggccgccgaagaggtcgaccatttcatccgcggtgccgaggtgctcaaggatctgggcatcgacgtctactacatgatggatcagcacttccaggagcggcagcactaccgcaccgatgcggtgcgcaagatcgacagctgggtgcagcgcggtctgttctcgatgatcggcgagggcgccgtgctcgcgatgatcgaggaaatggcccagtcctcgtacaagccgatcgccgacatgtgcatctcgatcgtcatggacgagtacaaccacgtcgcccagggccgccgcatcgtgaagcagttctgcgcgacgcccgagggccgcgccctggtgcaggccgagctggaaggtgtgtggtggtcgaccatgctcgacctcttcggccgctccgagagcgagcgctcgaagctctacgtgaagtggggcctgcgcaaatataccaacgaggaggcccgccagcgctactgcgcccatatcgtgccgcagctgcgtgaactgggcctcgacgtgccggacgactggacccggggccgcaagttcctctgatccgtccgtctgcatcggaaggggcgtcgcctgcgagggcggcgccccttcgcttttgcgagggtgcattgcacaatgaatgggcggtgcttccccagatcggggagtgtcgccttaaaaatgtgcagaactgcagccgacagctgagcaaggggcggtatgtggcctccaaacccctgcgattccgccgcttgggagatttggcacgggcattgctaataatcctgtggacgcaggtgacggggcggggagcgccccagtcggatcctggtgatgcacagcgcgccaccagtattcgatgtgtcgcctgctggtcttatgaagacgaactggtatcgaaactaagagggcgaaaaaaagatttgaccgacctaagtaaagttggtctaatcacctcgaagggacggcttcacgagactgaatgtccttccgaaaggcaggactggccgggttgagggcacggacggagtgcttgaagcgggggtgagtgctttccgctcgaccctcaacccggatcgcctctcgaagttttggtgcctcttcatccatcttctgcttaggctcttcggttacctctccacactgtcgactttacggccggtcggatcccaggatccgccggccgtttcttttttctgcggccgcttccgacgcagggcagatcatattcctctgtcccgtctgggattttcctgaagccccgggcaacgggtgcttgacccgccgtctcacccggctatcgtgcggcggcctcttctggggcgggacgtttcaggtcatgatgacgtccggacggtgcggaggcggccggaaggaccgggttcgcgcgggctgaggggaagcgaggcatgggcggtcagatccctgcgcatatcatcgtgctgggcaacgagaagggtggctccggcaagtcgaccacggcgatgcatctggcggtggggctgatgaagcttggccagaaggtcggcgtgatcgatatcgacagccgtcagcgcaccatcagccgctatatcgagaaccgtgccgcctttgcccgcgaacagcaggcctggatgccggtgccggaaagcgcggtcatcccgcgctccgacaagccgagccgggcggagatggaggcggatgagcgcgaggccttcgtgggcgcgcttgcacggcttgcccgcgacaacgatgtcgtcatcatcgacagccccggcagtgaccattttcttgcccgcctggcccattccttcgccgacacgctgatcaccccgatcaacgacagcttcatcgatctggacgtgctggcccgggtcgacccggagacgctgaaggtgctgggccccagcgtctatgccgagatggtctggaacgagaagaagacccgggcgatccgtgatcgcggcaccatcgactgggtggtgatgcgcaaccgcctctcgtcgaccgaaagccgcaacaagcgcgatatgagccgggtggtggagcagctgtcgcgacgtgtgggcttccgcgtcgcgccgggcttcggcgaccgggtgatctatcgcgagctgttcctgcgcgggctcaccatgctcgacctgcgcgacgtggatgcgaacatctcgctgtcgatgtcgcatatcgccgcccggcacgaggtgcgcggcctgatcgaggccctgcggctgccgatgctggacggccgcgacctgatcctctgatcggccccctttccacgacgccgcaagcccccatgtaggaaacgagtgtgtgaagatccgcttcatgcgccgtcagacctgtgggagaccggcatgacccgagaccttcgccccggccaccccgcgcgcccgccggccagctctgccgaggtcgatggcttcctggccgaggcgcgccggagcgtgccggcccggccggccaccccccgatcgaccacccatggcggggtcgccgcgcgcctgatcctggcgatggacgcgacccagagccggcagcccggctgggatcttgcccaggggctgcagggggagatgttccgcgtggccggcgatggcgggcttgcggtccagctggtctattaccgtgggttcgacgaatgccgcgccagccgctgggccggcgatgccctggccctggcgcgcgtgatgtcgcggatcgactgccgggccggtcgcacccagctggcccgcatcctgtctcatgccgtggccgaggcgcgggccgccccggtccacgggctgatcttcgtcggcgatgcgctggaggaaccggtggcgccgctggaggcgggggcggcggatctggccatgctgggggtgcgggccttcatgttccaggaaggcggccaccccgaggtcgccgcagccttcggacggatcgcccggatcaccggcggagccttgctgcccttcgatcccgctgcccccgaccggctgcgggctctgctgggcgccgtcgctgcggttgcaacccggggggcggcggccctggagcggccgggccgggccgatcccaaggcgctcagcctgctgatcgggcgcatgggcgagaggtgagcgttatgggggtgaggtggtgatctgggccctgcttgccggtttcgtcagcctgattgccgtgctgaccctgggcggacgtctggggcgggtggatcgggccgtgctgaagcgcatcggcctgtggagcctggtggtgctggcggcggttgctgccgttctgcttgccgtaaccggcaaatggccggccgttgccgccgtggcggcggcgaccctgccggtggtgatgcggctggcgcgcaccgccctcgggcttgtgcccgtctggcacctgtttcgccgggcccggccccagggcggggcggggctcgggacggcaggcacggcccgcagccgcctgcgcacgatcgagacccgcagcctgcgcatgacgctggagaccgataccggcgccatgtcgggcgtggtcctggacgggccggagcgggggcagggccttgaggagttgcgcgtcgagacgctgatcgcgctgctgcggcggttgcgggtggaggatccggacggcgcccgtctgctggaaaactggggggagcggacctatgggccgggctggtccgacccttctccgggcagcgccggtaccgggaacgatgctacggctgcggacgagatgtccgaggccgaggcgcgcgccattctgggggtggaggccggtgccggggccgccgagatcaccgccgcgtggcgacggatgatggcccgggtgcaccccgatcatgggggcagtgcagctcttgcagcgcgggtaaatgccgcccgcgatcgccttctgggcacccggtcgcgtgcgtgatccgggggcggccgccccttccgcccgcgggctgcgatttgcgtctgcggccgttcaaggctataagttgtgccgttcgtcggtcagacatgtgaccatcgatgccgtgagatcgcctctggtgacaaattgggggcaggtcaaaataggcgtcgcatcgtgttctgttgcgatgcaatatatgtagggtcgatcggcggatcgacggtgcgcctgcccgaggcgaggcagtgccgtgcatccgctgcggaccatgtgggcagcatgagccgcgatatcgaatgacacgtgaccggtcggacgatcgttccgaagaacgcctcaagaattcgatccagcgattaggtccatgagcaacaccaagcccgttcgcaaagccgtcttccccgtcggtggcctgggcacgcgcttccttccggccaccaaggccatgcccaaggaaatgctgccggtcgtcgacaagccgctgatccagtacgccgtggaagaggcgcgtgccgccggcatcgaagagctgatcttcgtcaccggccggaacaagaccgccatcgaagaccatttcgaccagtcgtttgaactggagtggacgctgcaggagcgcggcaagcacgaccagctgacccagctgcgccgctggctgccgaaggccggcaatgtgtcctatacccgccagcaggagccgatgggcctgggccatgccgtgtggtgcgcccggcatctggtcggcaacgagcccttcgccgtgctgctggccgacgatctggtccttgccgaccgcccgtgcctcagccagatggtcgaggtctacgagcagaagggcggcaatgtcgtggctgcgatggatgtcgcccctgagcacacctcgcgctatggcatcatcgacatcgcccaggatgatggccgtctggtcaccgcccgcggcatggtcgagaagccgaaatccgacgaggcgccttcgcgcaccgcagtgatcggtcgctacatcctgcagcccgagatcttcgatcatctgggccgccacgagcgcggttcgggcggcgagatccagctgaccgacgcgatccgcgccatggtcgaaagccaccccttccatgcggtgcgcttcgatggcgagcgcttcgattgcggcgacaaggccggcttcatccaggcgaatatcgccttctcgctggcccgcgtcgatctgcgcgaccaggtgaaggacttcctggccgagcgcctttcgacctaccgcgacgccgcccagtaaggctatagttcggcgcgcagggcccgcgatcccgtcctccagggggcaggatcgggggctttgcgcgccgttcgcgctcactggcaaaggaattggcttccatgcgcgtcgcgatgatcggcacgggctatgtcggccttgtgtcgggcacctgcttctccgaattcggccattcggtcgtctgtgtcgacaatgaccggtcgaagatcgagcggctgctcggcggcgagatcccgatttacgagcccggcctcgacgatctggtcgcccgcaatgtgcgctcgggccatctgggcttcaccaccgatctggcccaggccgtgcgcgatgccgaggtcgtgttcatcgcggtcggcacgcccagccgccgcggcgacggccatgccgatctcagttatgttttcgaggccgtgcgccaggtggcgatggctgccgacggctaccggctggtggtcaccaagtccaccgtgccggtcggcaccggtgccaaagtgaaggcgcttctggccgaaacccgtccggatcttcccttcgacgtcgcctcgaaccccgaattcctgcgggaaggctcggcgatcgaagacttcatgcgccccgatcgcgtggtggtcggtaccgaaaccgcgcgggcgcgcgaattgatgaccgaactctaccggccgctcttcctggcggagacgccgatcgtccacaccacgatcgagagcgccgagctgatcaaatatgccgccaacgccttcctcgccaccaagatcaccttcatcaacgaagtggcggatctgtgcgagaaggtgggcgcgaatgtgcaggacatcgcccgcggcatcggcctggacggccgcatcggccgcaaattcctgcatgccggcccgggctttggcggatcctgcttccccaaggacacccgcgccctggtctcgtccgcccaggaatacaacgcgcctctctcgctggtggagcaggtcgtggcgtccaacgaggcccgcaagcgccgcatggccgaccgggtgatcgccgccgccggcggcagccttgccggcaagaccgtgggcgtgctgggcctgaccttcaagcccaacaccgacgacatgcgcgaggcgccgagcctggacatcgtgccggcgctgatccgcgccggcgccaccgtccgggcctatgatcccgaaggcatggccgaggcgcgccgcctgctcgaccgtgtggtctgggccgaggatgcctatgatgccgtcaccggcgccgatgtcgcggtgctcgtcaccgagtggaaccagttccgggcgctcgaccttgaccgggtcaaggcggcgatgaaggctccggtcatggtcgatctgcgcaatgtctacaagccggaagagatggccgcccgcggcttcgcctacagctcgatcggccgcccggccgcagggcttggctgaaccggtggccgctgccattctctacccccgagccgttcttcaaaaccgaccctgagaggccgttcgtgaccaagctcgtccaccgcttccatccgaccgtgctgcgcgaatacgatatccgcggcatcatcggcgagaccctggggaccgaggacgcctatgccatcgggcgggtcttcgcctatatgctgaaggcccgcggcggcgcgtccgctgccgtcggtcgcgatggccgggtgagttcgcccgatctggaagcggcgctggtgcgcgggctgaccgaaggcggcgtcgacgtgatccgcgtgggcctgggccccaccccgatgctctattacgccgcccagacccgcggcgtggacggcggcatcatggtcaccggctcgcacaacccgccggaccagaacggcttcaagatggtcatgctcggcaagcccttcttcggcgaggacatccgcgagatgggccgcatcgccgccgaaggcgagcttctgccggcaccggcgacgggggccgacaacgacgcgcccgacgtgctgtcggcttatgtcgcccggctgaccgaggggctgttcaagacggtcgcccgcgaacccgtggtggtctgggatgccggcaatggtgcggcgggtgaggcgctgaccatggtggcgcgcaaccttcccggccgccatgtgctgctctatgccgatatcgacggcaccttcccgaaccatcaccccgacccgaccgagccgcacaccctggtcgacctgatcgcgaaggtggccgaggaaggtgcggatctgggcatcgccttcgacggcgacggcgaccgcatcggcgtggtcgacggcaaggggcgcatcctgtggggtgatcagctgctgatgatcctggcccgcccgatcatcgaccgcatccccggcgccaccatcatcgccgatgtgaaggcgagtcaggcgctgttcgacgagatcgcccgcctgggcggcacgccggtgatgtggaagaccggccattcgctgatcaagaccaagatgaaggagacggcaagcccgctcgccggcgagatgagcggtcacgtcttcttcgccgacggctactacggctatgacgatgcgctctatgccgcggtccgcctgctcgaccagctggcgaccaccggcgagagcatcacggccattcgtgacggcctgcccgagatggtcaacacgcctgagatccgcattccctgcgccgacgaccgcaagtttcaggtggttaccgatatcgccgccaagctggcggccgagggcgcccaggtcgaccggaccgacggcgtgcgggtgaaggtcgatggcggctggtggctgctgcgcgcctccaacacccaggcggtgctggtggcccgtgccgaggcggccgacgatgcccggctggcggcgctgaagggcgaactggcccgggtgctgacggcggccggcgtcgaggtgccggcggccctcgcagtctgatccgcctgccgtcttcctatatggaaagggccgctcccggttggggcggcccttttctttgcgtcggcggcagggagggcggtggtcagaagccggcgccggctgcgtgcatcacctcgttgctgccgcgccagatcatgtcgagcgccacatagctgatgatggcgaggccgacataggccagccaatgatggcgttccagcagcttggcgacatagttcgccgccaggcccatcagcgcgatcgacagcaccagaccgatgatcagcacctccatgtgatgacgcgcggcgccggccaccgccagcacgttgtcgagcgacatcgatacgtcggcgatgatgatggcggtcagtgcctgacgcatggtcttgggcgccgccgccttttcttccggcagttcgtcgacgccgtcggcaggggcgctgcctggggcggatgctgcggccgccgcctcggcggctgcggccttgcgggcctggcgcagttcctgccacatcttccaggcgacccagagcagcagaatgccgccggccagcgtcaggccgatgatttcgagcagttcgacggtcacggcggcgaaggtgatgcgcagaaccgtggccgccaggatgccgtagatgatcgccttgcggcgaagggctgccggcaggccggctgcggccatgccgatgatcaccgcattgtcgcccgacatcacgacgtcgatcatgatgacggtcagaagcgcgccgaggccgtcggcggagacgaggaattcgggcaagatcccaaccttcgtgcagcggcccggatgatgagagggggagggggccgcgggagacgggcgtccctcgggtgcagggggcgcgcccttgttctatgcctgcccaaccgccttcacaagccccgccccgcagcccggcgcccggcccgccccctctgttacccccgaccttggtccctgggcctttgccatcgggagcggcagactggcacgaacggtatagttgcgacatcatggcggaaagaatgcgtgcaaagcgcatcaagccgtatgggggcgccgaatcctggggaggcatagatgaccgcaatgaccatgaaggatcactctgcccatggtgacggcctgtcgatgagcgatacgatcgcccggctggccgaccgggccggagggctgggggtgcggattgccgacatcgtcggcaaggtggacgaggttgcccgcgccctgcgtggccagtctgacggtctgggcgggctgaccggcctggtcgaccgcatggccgaagacaaccgggcgatcgatcaggcggcccggaccgccgacgagcgggcggcggaggcagcccggcaggccgcaagctctcgtgccgaagcggcacagacgctggacgagatccgcgagctgaccggcagcgtggccgacatcgcccgccggctggatgtgcttgcccaggcgctggaccgggtcggcaaggtctcgagccagatcgatggcatcgccaaacagaccaacctgcttgcgctcaatgccacgatcgaggcggcgcgggcgggagaggccggccggggcttcgccgtcgtggccggagaggtcaaaagccttgcccggtccacccaggaagccaccgcccagatctcccagaccctgggcgagctgggcctggaggtgcgggccctggtcgatgccagcggccggacactcggcaaggcggagcatgtgcgcgagggcaccgggcggatcggcggcgtcatcgacgggctggccgatgcggtgggcatgatcggcggcgaggtcgggcggattgccggtcaggccgcctccaacaccaccgtctgcaaccaggtcagcgccgaaatgcgggagctgaacaccggtgtcgcccagtcgcgtacccgcctcgacgaggccgatgcgcgcctggtggagctgctcgatctgtccgagaacctgatcgagctgacggccggggccggggcggagacggtcgacacgccgttcatcgcggccgcaacccgggctgcggcgcaggcgaccgaggcgttcgaagcggcactggcggccggtcggatcgatatggccggcctgttcgacgaaagctatcggccggtccagggatcggatccggtgcagtacacaacccgcttcaccgagctgtgcgaccgggtcctgccggcgattcaggagccggttctggcgatcaatcccgggatcgtgttctgtgccgcggtggaccgcaacggctatctgcccacccacaacgcgaagttctcgaaaccccaggggcgcgacgcggtctggaatgcggccaatgcccgcaatcgccgcaagttcgacgaccgcacgggattgcgtgcggcgcgtagcaccaaacgctttctgctgcagacctatcgtcgcgacatgggcggcgggcagttcgcgttgatgaaggatctggcggtgccgatcacgatccgcggccgccattggggggcgatccgcctggcctatcgcgcggaatgatcagctgaccggggcaagggggatgcggtgtgcggccggcagggccgccgctgccctgcggatcgccgcggcatcgggggtggcggcgcgcgcccccagggcggcacaggcgagcccgccggctgccaccccctcggccagggcccgggctgcctccgcgccacgggcgagggcggcggcataggcgccgacgaaggcgtcgcccgctccggtgctgtcgaccacggcgacaggggccgatggctggcgcaccagagtggctgcgtctgcgatcagcgcaccggcggcccccagggtcatgaccaccagctgatccggccgcagcccggcggcgctgcggccggaccggatggcggcggccagggccgcatcgggcgcatcgggatcgagtgtcgcaccggcgaaggccgcccattcggtttcgttgaccaccagatggtttaccggcgccatcggcaggtcatccgccccacgggccggggcggcattgtggacgaccacggcccccgatgccgccgcccgggcgtgcagacggccgataccggcggcgggggtttcgttctgggtgaccagtacggcatttgcgagcagcgcatcggccaccgccgcatcgtccagatcgtcattggcgcccggggagacgatgatctggttgtcggtgcgatcatcccccgcccggcgcggcccgacggcgacgattgcgaggcccgtggggcgatgcgtgcggatcacgccggacatgtcgcaaccggcggcggccaggccgcccagggcaatatcggccgctgcatcgtcgccgaccgcggcaatcagagagacgcgggcaccggcacgggcggcggcgaaggcctggttgccgcccttgccgcccggcagatgcagcgggtcgcgggcggcgacagtctctcccgccgtcggcagatgccggcaggcgagcaccagatcctgattgaccgagccgaagaccagcacgcgcccatccggttcgggggctctctgcgtcgcggagggggtgttcatagtcggggggccccgcaggtcagtgatcggatgtcagcgtcggggccggtaccacatggtgaaggcgaagagcacggtcatgatcgccaccaccaccacgaccgacagccagtcgaccgcgcccaccgaaagcccgagcaacaggatgccgagcagcaccggggccatgacgatcagataggttttcatgcgggtgtgcatcctgtcggccggcgccccggggaaccggttggcgtgaagggagggtcaagggtggcgtcggccgcagcgccggtcaaggggcgggagccgcccctcgacccgccgggcatgcccacaaaaaaaggcgcccggccggaggccgggcgccttttgatatcgcgatgcagacggatcagccggcggcggacagcgccgtgatcggcggcaccaggatgcaggcgatgccgcgcttgtcgagcagggcgcaggcctggcgggccgggcgctcgccctcgaaacccatcatgcgggcgcggtagatatagcggccgccgattgcgtgcggctccaccgcggtctgcgcgccgccccgcagatcggccggcagcagatcctgggcgcgggtcaccagcccctgggcggcatcgacccggccgaaggcgccgaactggatgccccagcgaccctgggtgtcgaagacccgcggcttcggggcgatggcggcatactgggtgtcgccctgggcgaccggctgcggcgcgggggccgcggccacggccgcaaccggcgtcgcggcaaccggggctgctgcaaccggggctgctgccggaacctcgagcgctgcggtctggactgtcgcctggggagcggcatcgctgccgaactcggcatcgtcctcatcgacggcggcgattgcggcctcgccggtcatctcgcgttcggccgccctcacctgggcgtcgctgatcgaggcgaccttgaccgaggccccgccgatatcgtcgaggtcacgctccagcttggcgatctgcagttcgccgcgggcgcgggcctgggcgatggcgcgctgacgctcggccgggctttccgctgccaggcggacgaaggccttgtccagcagcccggccaccgcctgatcgcgggaggctgcgctggagccgccgaagatcacgccgatcagccggtgatcgtcgcgcaccgccgagaccacgatgttgaagcccgaagcgcgggtatagccggtcttgatcccgtcggtgccggtgtaagagctgagcatccggttgtggttgcgcagggcctggcccttgtagctgtacgacttggtcgagaacatggcgtattcccgcgggaagtcgttcatcagatgcacggccagcgtcgccatgtcgcgggcggtggagaactgatgccggttgggcaggccgttggcgttctggaaggtggtcttgtccatgcccagcttgcgggccttggcggtcatcatgcgcgcgaaagcgatttcactgccgcccagcgcctcggccagcaccacggccgcgtcattggccgatttggtgatcaggccgtagatcgcatcctcgaccctgatggtctggccggcgcgcaggcccagcttggtgggcgccatgccggcggcgcgggccgaaaccggcagcgcctgatccatggtcagccgctttgccttcagcgcttcgaaggtcatgtacagcgtcatcatcttggtgagcgacgccgggtagttgcgcacgtcggcattcttcgcatagagcacgcggccggtttcggcctccacgatcaatgcggcatagccggcggcggccgtgcgggcgaagccggtgccggcgatcagcgccaccagcagcaccatcatcagccggaccaggccgatggcgggcagagcggcgggccgacgggcaaaggcgccaggccgggcgcatccgtcgggcagggcaatccgcagccggctgttgcgaccgaatgtcatagcgtccgtccccgtcgttttcgcccggaccgtgcgtcccggtcgggctggaaccattgatctccgcgtcccggatcccgaccttatcgcccgagggcagaccgcccggcctcccgtgggccggccggtctgcacgaaggcacgaccgcaggtttcacgcgtctggtggaacatccgcgcgcaacccgtccgcatccgccgcatccggacccgttccgtcggcggaagggtgcaacccggcatgatgtggtggatgaacggctgttaatccgtggactcgcatcctagccatgcccgggtggttgcggcaacctgaaaattcttgttgtgtatgggcttaattctgtttcctcgcccagggtgtgaccgaaggagcgcgtatgtcaggaaagatgcccccgaagcccgccgcccgccgcgacatgcggccccggcggttcgcctggttcgcggcggcggtggtggcgctcgtcacctcaggttgtgcggccaccgggcccgcgggcgatccgatcacccgcagcttcacctggttcgactatgtcggcggcggcgagttggcgcgcagctgcatgatcggggcgcccgaccgctatcggctggtctataatgccgtcttccccgagcaggtccgcacctatgatctggtcgtcctccgcgacagccgggcccgcatctcggggtctgaactcaccaccaatgtctggcagcgcgcggatctgacgcggatccaggtgccgcagctgggggcaccctgggcgccggtggaggcgcgggtgcgtctggatgccgcacagaccgccgcgatcctggaccggtttgcgtcaggcggtgccttcgcgccggccccggcgggggaacggctgcattcgctgggtttctactggacggtggcgcgttgcgtggacggccggttcggtttctgggcggccgaatatccggacccggcgttccaggcttttcacccccagatcctgttctccgtggacggcaacccggtgccgcccagggaaccgcggccgacggtgaccaacccgccgacgcggtcgcgggacggtggcatggtcgacgggcattcgcccttcaccctgaccgtggtggaaaacggcctcgccggggtcgattacggtcgctgacggctgcaccgcgagagccggaccggcttgacctgagtggtatgaaggcgttaagttatgttgcagcgcagcatggccagggcgactgcatgccccggcctcgctgtccggtttcattgttccgcagccccaccgccccggccgtttgcccggggccgatcggacacagggacccgcgcttcgccgcccaggatcggcagcccgctccacgcggaaccgaacggagagagacgcatgaccacccgcaagactcccggcaccggcacccgtggccggaccacccgcggcaccgcgtccgacgcgaccggtaccgccacgcccaaggtcgccgcaaccaaggcagcccccgttgaggccgccgccgaagcgactaaggccgcgaccgataccgccgctgaaacggtgaagacggcaaccgataccgctgtcgagacggtgacggcaaccaccgaggcagcggcagaggccgcagccgacgtaaccgagaccgtggtggaggcgccggttccggcgcccgcatctccggccgtccccgcgatgaagagcggggccgagctgatggaagagatggcggcgatggcggccgccaccaccgcagccgacatcgccgccgaggcggtgcgcaccgccagcgccatcgccgaacgctcggccaaggcggccatggaggtgttcgacggcgtgaagaagtcggtcgcgcccgagggcatggccgacggtaccgtgatgctcgacgaggcaaaccggcttcgtgaacgtgcggtcgaggatctgatggaggcctcgaacgagaccgccaaggcgctgagcgacgccacggacggcatcatcgccttcacccaggcccggatcgatttcggcgtcaacacggcgcgcgaggcctttgccgcgcagtccttcgaagagatggcggcggtgcaggagcgctatgcccgcgggctggtcgatctttatgtcgagcacgcggccaagatgtccgaggtcggcattcgtctggcgggcgcggcactcgcccctctgaaccggcagtggcagaacgcttttactccgccgtccgcccggccgcgggtctgaccgcgtcacagccttcgaagcccggatgccggggctccaggggcccggtgtgccatcgtccagacccgcagccggcacgccggttgcgggtcttcgtcgttgcagggaagcgacaccggcgggcgtggtgaaaatttctcgggcagggcttgcgccgatagggcgacgcatcactgttttcaaggtcttttcctctccggggcgaatccaatatcctcattccgaggaagggtgccaggaacctgatcgattgcgacggaatggccgaacacgacggaatgggcatgagcggcgaacgcagatccgatgacgaccgtcccggcttcgggacggtgacggaggtcgcgacccgaccgaaggcggcgacccgaaagccgtcgatgtacaaggttttgctgctgaacgacgattacacgccgatggagttcgtgatcgacgttctgcagcgcttcttcagcaagggtgcggaggaagcgacccgcatcatgctgcacgttcacaaccacggcgtcggtgtctgcggcgtgtttccgttcgaggtggccgaaaccaaggtcaaccaggtgatggattacgcccgccgcaaccagcatccgctccagtgcacgatggaaaaggactgatgtcgattctttccaagaacctcgagcagagcctgcaccgcgccttcgccatcgcgaatgcgcggcgtcatgaatacgcgacgctcgaacacctgctgctcgcgatgctggacgatcaggacgccgtggccgtgctcaaggcctgcgacgtcgatgtcgaccgcctgcgtgtcgacctgaacgatttcctggacaacgagctggcgagccttgtcaccgacagcggtgtcgaggcgaagcccacgatcagcttccagcgcgtcatccagcgcgcggccatccatgtgcagagttcgggccgggccgaagtgaccggtgccaacgtgctggtcgcgctgttctcggagcgcgagagccatgcggtttatttcctgcagacccaggacatgtcgcggctggatgcggtcaactatatcagccacggcatcgccaaggcgccgggcatgaccgagaatcgcagcgtccgcggcgcgccggtgaccggctccgcccaggaggaagaagcccagcgcgaggcgcagaagggtgcccagaagggcgccgccaaggcgctgaccagctattgcgtgaacctgaacgacaaagccagggccggcaagatcgacgtgctggtcggccgtgacggcgaggtcgagcgcgcgatccaggtgctgtgccgccggaccaagaacaacccgctgctggtgggcgaccccggcgtcggcaagaccgcgatcgccgaaggtctcgcgcgccggatcgtgaccggtgacgtccccgaggtgctgaaggatgccaccatctacgcgctcgacatgggcgcgctgctggccggcacccgctatcgcggcgacttcgaagagcggctgaaggcggtggtgaccgagcttgaggcccaggatcatgcggtcctgttcatcgacgagatccacaccgtcatcggtgccggcgccacctcgggcggggccatggatgcgtcgaacctgctgaagcccgccctgcaggccggcaccatccgctgcatgggatcgaccacctataaggagttccgcaactacatcgagaaggaccgcgcgctgctgcgccggttccagaagatcgacgtgtcggagccgacccctgaggatgcggtcaagatcctgaagggcctgaagccctattacgagaagttccacgacgtccagtataccgaggcggcgctgaaggctgcggtcgacctgtcggtgcgctatatccacgagcgcaagctgcccgacaaggcgatcgacctgatcgacgaggtgggcgccgcccagcggttgctgccgccctcgcgccggcgcaagcagatcagcgtcaaggagatcgagggcatcgtcgcccggatcgcgcggatccccgagaagagcgtctcggcgcgcgacaaggacagcctgcgcaatctggccgacaatctgaagaccgtggtctatggccaggatcaggcgatcggcgcgctggcgaatgcgatcaagctggcccgggccggcctgcgcgaccccgagaagccgatcggctcgtatctcttcaccggcccgaccggcgtcggcaagaccgaggtcgccaagcgtctggccgagatcctgggcatcaagctgatccgcttcgacatgtcggaatacatggagcggcattcggtgtcgcggctgatcggcgcgcccccgggctatgtcggcttcgaccagggcggcatgctgaccgatgccatcgaccagaacccgcatgcggtgctgctgctggacgagatcgagaaggcccatcccgacctgttcaacgtgctgctgcaggtcatggactacggcaagctcaccgaccacaacggcaagacggtcgatttccgcaatgtcgtgctgatcatgacctccaatgccggtgcggctgaaatcgccaaggcgccgatcggcttcggccgtgtcgaccgggctggcgaggatcaggatgtggtgaagcggatgttcacgcctgaattccgcaaccgtctggatgccaccattcccttcggccgcctgccgatcgaggtggtggaactggtggtcgacaagttcgtcaaccagctggaggcgcagctcgccgatcgcaagatcacgatctcgctcaccgaagaggcgcggcgctggctggccaatgccggctatgacgaggcgatgggcgcccggccgctggcccgggtcatccaggagaagatcaagcagccgcttgccgaggaggtgctgttcggccatctggtcgatggcggccacgtggtcatcgatatcgaagaggacaagcctgtcttccggttcgaagcgaacgagccgaagccgcggagcggccgcaagggcggcggcggttccgggcccgatgccgggccggaggatggacacaagctggatcccagccgggacgagatgccggagcccgttgcctgacatctccggtgcctctctgaaagctgcacggccgcatgcgacgcatgcggccgtgtttgcgttcagggccatggcccgccagttgtcgacgccggatcgcggggaaagacttgacccggcggtcatttgtccaataacctatagtagaaaaatatctacacggatgaacgtgtgacagcggcgtgcccgatcgccggcggggcatgccgggccagaccgccgggaccgtcgtcagatcggcacaccccatgattcctgcgatcaccgccgaagatccgcgtctcggcgacccgctgccccccgggccctatcgccgcgccgtcgtccgggcggccattgcggccgggccgccggcgccggtgcttgtgccggcccatgacagtcgcgccgccgcactcgtctgggcggcggaggaggtgcggcatctggcacatcagatccgcgcctcggcgctgccctgtgcgccgattccgctcgatctcaagctggccaggctggcggcggaactcgaccggatttcggcggtgctggatccggagggggtcgatcagatgcccccggccggggggcccacgctctgcagcgaggggctgctcgtcgccagcatggtccggctcagcctgccgatcactggcatcctgctgcgcctcgagggtatctcggggcccgaggtggcgatggcgtcagagaccctgcgggcagggcttggtctgacacttctggtcatcggtcccgccatggaaggcgggctcggccccttcgtcgaaaacgtgctgcgcgaaaccctcacggccgccagaagcccggcctggcggcggccggtcagcgtcgctgcgacggcggcatcacggtcggacgggctgccggggccggcgtcgggccgggcttgaagaacaggatctggaccagccggccgttttcgggggcatcgccgaaatccaccccgctggtgtgccacagccaggggcggaacaggatcagccggttgaacttcatcggcagaaccgtgatctgctcccatttcgaccggtcgcggccgtcctgcttcagcacggtatccagcacggcctcgcgggtcggcaggccgaacttctcctgcgcctcctgatcgctcaacggtgccctgtcgctgccgctggccttgtggcggaagaattccgtcccgccctgcgcatgctcgtcgaggctgagaaacacgatcccggcccaggcgcagcccgggtcgatatggaccaccccggcgcgggtatccgaggcaaaggacagccggcacttgccatgcgccatatcgcgattgccgatcaccggctcgcgcaggatgtagctgaacatgcggtcgctgtcgggcggcagcatgaactgcttcgaattccggcccggataatagatctcgggtcccgacagatgcggatagtcgagcttgagcgcctgcgcccgcacttcgagcgggttctcgtaaaagtcgtcgacgacgatcatcgactgatgcatggcatgcgctccgctgaagcttccggttcgcgcgcattccaccatgcccgcgaaccggcttcaacccgctcgctcagccgccgaacgtccagccgcccggcaggatcatcgcggccgaggcggcgcccccggccacgccttccagggcggcgtcatcgagtgcggcatcatccgtccggcgcctcagccgggggatcagggcgcgccagtcgaatttgaagccgcgggcttcgccggtttcgcccaggatgcgggcggcctcttccggggtcatggcggcgatcagcgctgcggcggtggccgggtcgctggcaagcgccatcagctgcgaagtcgagatcatcgtcgggctccgccgctcagttgccggaaatcatccagccgccacccagcggcatataggcgccgttcaccgcgacaccgccggccacgccttccagcgccgcatcgtcgatctcggtatcttccgaccggcgcttgagccgggggatcagcgagcgccagtcgaatttgaagcccttggcttcaccggcatcgcccagcaccttggcagcctcttcggcagagatggcagaggcgagtgcccaggcgacggtcggatcggaggtcagcatcagcaggtgagaggtgggcaccatggcggcggctccatcggcggtggcggatcgtgaggcagagcatgcgcctgatcgccgctgctgcccagcctgtccgtcgcccggcgttgcccgtcgtttattctgcggaggtctgatcccgtctgaagggcagatgctcgccaagcgcctcggcctcggcatcgacggcggcccgttcgcggtccaggaagtccttcacggcatgggcaagccgcggatcggccagccagtgggccgagcgggtggtgacgggttcgtagccgcgcagcagcttgtgaccgccctgcgcgccggcttcgacccgcgccaggccgcggtcgatggcgacctccatggcctggtagtagcaggtttcgaaatgcaggaagggcaggtcgaccaccgccccccaattgcggccgtagagcgtgtccttgccgaccaggttgagcgcgccggccaccgggcggtcgccgtcatatgccatgatcagcaccacccggtcggccatggtctcgcccagccggtcgaaaaagctgcgggtgagataggcctcgccccatttgcgatcgaccgtggcgcggtagaagcggtggaaggcatcccaggccgcgggggtgatgtccgcgcccgacagcgcccggaagaccaggccgctgtcgcggaccttctcgcgctccttgcggatcatcttgcgcttgcgggcggacagcgccgccaggaagtcgtcgaaactgccatagccgcgattgtgccagtggaactggacgtcatgccgcgccatgaagcccgccatggcgagcggggccacgtcttcgggggcgaggaaggtcacatgcacgcccgagacgtcgaggctgcccgccaccgccgccagcccctcggccagggtgcggcggatggcgggggcatcggggccgttgccggccagcaggcgcgggccaggtaccggcgtgaagggcacggcggcctggagcttgggataataggcgccgccggcctgttcataggcgcgcgcccaggcctgatcgaagacgtattcgccccaggaatgagccttgaggtagagcggcaccgcgccgatcagccgcccgtcggcggtgctgagcagcagatgacgcggcagccagccggtgcgctccgacaccgatcccgaggtttccagggcgtgcaggaaggcgtgcgacgggaacgggttgtccgggccggcaagggcgttccacgcctcgggggcgatctctgccatgctttctgcggtggtcagggtcaggcgctggtcctggtcggtcatcggctccggttccggcggatcgggtgggcggcggccctcctatacttggcgcccggccggcgatggacaagtctctcgcgcgaccgcggcccgccgtgcccggacatagacggtgcagaacaccagtccgatgccataggagggcgcgatggtggccagcacatggggcgtgcctgccagggcatgtgccgtggcaaagaccacggccagcagggtgatcggcaccaccgccgccacgattgcgccggcccgcagccgtcgcgccaggatcgcatccatggcgagcgtgagcacggcggtcgcgccgaagctcagcaggaactgaaccgcggcggccctgagccccgcaggcatccccgcgccgtgattggcgaagaacgcccagccgccatagagcaggccggaggcggtgcccaggacgagcgcccgccggttcaagaggcggccgcctgcaaaggcgtgtcggcgccgtcggcctcggcgatctcttccatcacgaagccggtcagggcctcgacgctggcaaaggggctgaccttgcgcgacacggccttttccgaggtcagcgacacggtgacgcccaagtcatcctcgagcttttcctcgaccgtggtcaggaagttgaccagccccatgctgtcgaacacgccgccgctgccgtagaggatgagcgcgggccccggggcaagatcgaagggttcctcgcgttcctcgttcacctcggcgagggtggccaggatcatgtcgcggattgctgcttcatcggccatcttcgggcctcctctgtcttgggcggggtctgtggcgaagggtcaggcggggaccggttcgggggctggcgccagcgcccggaccagatccggcatcatccggtccgacagcagatcgaaatggccggcatccagcccgatcagccggaagcggccggtggtatgggcggcccagcgttcgggacggcgttctgccgggtcgcgccgggcggtgatcatggtgatgtcgccgtggatgacgccgcgagcccgccagccggtggtggcccgggcattgcgcagcacccgcgccttcagccgtgccaccgccggccggccgagaccggcggcaaggcggcccatggcatccgtactgtcggccgcggcccgggcgaattcgcggtcgaacttggccgcgaccgcatcgggatgcatcggcaccggctcggccgaggtgtcgagcagcaccagatcgacccggccgccggtctcggcctcgatcagccgggcggcatcgaaggccgccatgccgcccagcgaatagccgatcagccgccagggtccgcggggtgcgatctccagcaccgtgcgggcaagatggcgggcgaattccggcaggcccgcggccggatgcgccgggaagcgcagcccccaggcggtctggccgagccgcgctgcaagatcgaggaagatggccggctctccggcgaccggcgggatcaggaagaccggcgcggttcgccccgtccctggcagccccgacgctggctgccccgacgctggccggaacagcggcagcggcccgtcatcctcgtgatcgccggcggcgatgcgggcctgatccagcgccgccgccagcagccgcggcgtcgggttgaggaacagctgcttcaggtccgtctcgagaccggtcgccgcgcggatctcggcggtgagccggagcgcggtcagcgaatgcccgccggccaggaagaagtcggtggcggcgtccacggctaccccgtccagtacccgggcgaaggcgccggcgatggcggcttcaagggctgtcgccggggcggtgcggaccggcccttcggcgagggcgggcaccggcagggctgcggcgtccagcttgccgttgggccggcgtggcagctggtccaggcgggtgagcacggcgggcaccatccagccgggcaggcgcccggcggcccagctccgcagctcggccggggagacgccctcgccgacataccagccggccagccttgggccgcgggggccggtgatggcccggacggccgcctcctgcacggcgggatggccggccaggcgtgccgcgacctcgcccggctccacccgcgcaccatcgatcttcacctgatcatccagccggcccagatagaggaagaccccgtccggcgtcagcagtgcctcgtcaccggtgcggtagagtcgggcccccgggtttgccggatcctcgggaaagcgttcggccgacagctccggccggcccagatagccgcgggcgagctgaacgccgccgatcaccagctctccggggcggccgaccgcgactggttgcagtgtgtcgggatcaacaactagaagctgcgtgttccagaccggccggccgatcggcaccaccgtctcttcgggatcggcatcatggcgggcgacgtcgatcgcggcctctgtcggcccgtagagattgacgatccggacacccggccagcgggccgcgacccggcgcaccgtttcggcccttaaggcctcgccgctggtcacgatcagccgcagccgtgacaggcgctcgtcatcgccggcgggcaggccggccagcatggcatccagggcgccgggcacgaaatgcaggcaggcgacgccccgcgcctcgatcaaccgggccagcgcctgcgggtgatgggcggtcaccgccgggcagagcaccatgggcgcgcccatggcggggggcatcagcatctcccagaccgagacgtcgaagctggcggtcgtgcggtgcaggatcggctcgtggtgccggtggcccagggcatgccattgccagaccagccggttgagcagggcggcatggtcgaccatcacccccttcggccgcccggtggtgccggaggtatagagcagataggccagatggtcgggggccggatccgatagtgtcacttcgggcgcgtcgagcgcacccgcgtcatccatcaccagcagcggccggctcgtcgcgatggcagcgaaatcccggcaggtgatcacggtgatcgcctcgccatccgcggcaatctccgtcagccgcgccgccggcagggcggggtcgagcggcaggaaagccgccccggatttgagcacgcccagaaccgccgcaatcatcgcgggccgccggtcgatcatcacgcccacgatccgcccggggccggccccgcgggcgatcagggcccgggcgaccctgtcggaccagagatcgagggccgcaaagctcgtgacttctcccgccgcggtcaccagggcgggatcggcggatctgagacgcgcggtgtcgcggatcagctccacgacgctcgcggcgccgccggcccgccccggcagtggccgggccgtgtcgttcacccgcgcgatcagggcccgttcggccgcgggcatgggcgggatcaggtgtgccagcggcgtgtccggggtcgcccgctccagcgcctccaacatcggccccagccggtccaccaccggtgcggcacccagcgggtcccaatgggcagcatccaacgccagatcgaaatcgaccggcccctctccgcccagatcgcggacatgcagggcgagggcgtatttgtcgccctcgtgactgaccgggtggagcagggtgcggcagccggcgaagccctgtgtggcctgccgggtctcgaaggagaacagcacatcgccgagcatggcatcgccggcgccgggcctgcggccgagtgccttgccgatcgcgcccatgggcaggcgctgatgacggaagccacggcgcattgccgcctgaaccgcggctgcggcctccccaagggaggtggcagggtcgatctgcaggccaagcggcatcagccgcacgaagggggcgatggccgcacgttcggccgcggtcatccggttgcggaccggggtggcgacgatcatcgccgcccggccggtcaattcgtggaccagggtcgcgaacagggtgagcagcagggccggcaggggaacgccggccgcagcggcgaccgcctcgatccgggcaaaggccgcccggtcgcgggtgatccgggccttgagcgacggcccgaagggggggcggcgcagaaaggcccgggcgggcagatcgcccagctcgcgggcccagaaggcgctgtcttcggccgccttcgggctctggatccaggcatgttcggcggccggatcgggcagcggtgccgggtcgggcagcggcgtcccgccggccaggatcgtgtcataggcccggcggaaacgatcgaagagcgcgagcccggcccagccgtcgacgatcagatgatggcagcggaacagaatggtccgccggtccggtgccgccttcaggatccacatgtcgtgcatgacccggccgtcctcgggacggatcggctcggcccagagggcggctgcccgggcggcgacgctcatcccgggttcggcgtcggcgctgaaatcttccagccggaacgggatgggacctgcgtcgtcgggcggggccaccgccagcatcggctgatgatcccgcagtaccaggcgggcccgcatggccgccacgtcgcgcatgaccgcccgataggccgccgccgccgcccgatcgtcgaaggcgccgtccacctgcatctcgcccccgaccagatagagccggtcggggttgagcgtgcgatcgaagaatatgtcgcgctgggcaaggttgaggtgatgcagcatggggctgcctcccggacggggcatctgcgcccgttgagggaatatgcggggggacggaatatgcggggggtgccgtgggcggcgggcgggggcgccgcgggcggcgggaggagagggtgaggtgcggggccgctcagaggtcctccatcaattctctcaagagatcctggcccagcggccagtggccgaagcccgaatcggcgttgatgtggccggcgccgggaatgagggtgagatcggcgccccaggcggctgcgaagccggcggcccgctcgggcgcgacataggggtcgtcgtcgctcgccaccaccagggtgcggaagggcaggaccagggtcggcatcggggcaaagacccgcgcctcttccggcgtgtgatccgggctgtcgacatcggccggagagacgagcagggcgcccgtcacccggccagcgcgggcggaggtttccgcccagcgcaccaccagcgcacaggacaggctgtgcgccaccagcaccaccggtccgggggccagcgcgaccgcctcgtccagggccgcaagccattccgacgcgaccgggcggtcccagtcgcgctgttccacccgccgccaggcggggttttcgtccagccacaggctttgccaatggtcggggccggatccgcccagccccggcacgatcagaacggttggggtcaccatggggtctcctgcctcgacgctcagacctcgtattccgcgccgacaccgtcgaagcgcagccggtgctggatctcgaccggctggtcgtcgcggtcatagcctttcagcatcccggcctcgatcaggcggatcacgatctgcgacgacaggtcggggccgtcatcggcctgtttcagccgtttcaccagctcgcgatagccgacggtttcgtgcgacagcccggccagcacgtcgcgatgggcttcggtcatcgaatacttcatcatccgccggccgcgcccgtcggcgaccaactggcgctcgaccaggctgaaatccatcgggtcgaccttgaaggtcggcaccagtgagacctcgccgccggtccattcgaaccgcttgatcgaattgagattgcgggtcagcgccccgatccactgcacccgcttggcggcgagttcctcttcggtgaagtcgtcggtgagttcggtgcgcagatgctggccaaggctgatcatgttgccggagcggttgacgaatttgcgcagcagctcgtcctcgtccgtctcttcggcctggccggtcaggcgggcgaaccaggttttgtccgagaagcgcttgtcttccagcccctgcacccggcgcttggaccagaagctcgacgccggcatgacctccgacgcgtagctgtagaacgaggccaggaactcgtgatactgcgaatagctctcgcgataggcggcgtcataccaggcatggacatcatcggcccggtcgggatggtcgatcaggaagtcgatcgcagccccggcatagacaccggactgggtggcgagatgcacgccctgcgagaacagcgggtcggtgaagcaggcgctgtcgccggccaggaaggcccggcccatcgacatgcgctcggcattgtacgaccactcgcggatgatccgggcctcggcgcggggatcgtccagatcgacgatggaggcaacctccggcgcggcccgcaggcagtcttccaggaatgcctggcggccgcgggcgttgatctcggcggcattgtcgacatcgaccaccgcgcccacggagtaggtgccgtccttcagcgggatcatccacacccagcccttctcgaaagtgatcgagaaggtggtgccgtccagatcgccggtgaatttgcggatcgaggggtagtagttccagaccgcgagcgagcggtagaactcgtcataccgcctgagccccagctcgcgggcaatcagcccgttctggccggtggcatcgacgacataggatccgggcagcaccacctcggcatcgtcggccacccgccttgcgcggaccagcacgccgtcgccatggtcgtaatcgaccgaggcgacggcatggcccatgcggatatcgaccccggcatcgcgggcggcatccagcagcaggccgtcgaattcctggcggtagacctggatcgcgtggtcgtagatccagggctcgggccgcggggtggcgaaggagaaggtccagggcgcctggcccagcccccagacgaaggtggccgagggcttgcgcacgaagccgcgctccatgatccggtccatcagccccagccggtcgagcagcgacagcgtgccgggcagcaggctttcgccgatcttgtaggcgggttcggtcgcacgttcgagcaggacgacgtcgcgaccgcggcgacgcagggtgagggcggcaacgcagccggccgggccggcaccgatgatcagcacgggatcgctcatggggtcgtgacctcgttggacggggtgggcgtggcagcttggggggcgaacaggaaggcggtcttgggctggtccttgcggaagacgaaggcaccggacgagacattggccgcgaccgacacgccggcctgtatgcggttgccgtcgcccagcgtcagccgcggctgaaccgaggcggcaacgccgaagaagttgttggcgccgagcgtgacatagcccgcaagctgcacccccgacgagaacacgttgttgcggcccgagacgccgtcatggccgaaagagcagccgtaattcattacggtgaaggggccgggccgggcgttgacgccgatatggacccggggcccgagcaccgtgcccgggccgatctccgcacccggcatgacggttgcggtcggatggatgatggtggcgacgggccagccggcgtcgtcgaaccagcgggcgatcagctcggtgcgcaccgcgatctcggccatgccgagcgcgaagacctcgcccggggccggctgataatcctcgggccgccccagccaggcgggggccggtgcgccgtgctcttcccaggccgtacgggacaggtcgaggaagccgcggagcgtgaagccggcatcggcggcataggccgcgacttcccgggcgaaaccgcccgacccgaagatgaccagatccgtcatgacgcctcccgcgagatgagcttcttgaaccgggccgaataggggatgtcggtcacgatcttcacccggaccggcaccttgaacgggtcgagccgctcgcgggcatgggccttgaccgctttcaccagggcggcgggatcggcgggcaccgcgtcgggggccggcacgatctcggccatcaccgcctgaccggtgatggcgttgggctggccgaagaccttgcagtcggcgaccagacccgaggccatcagcacgccttcgacctcggccgggaacaccttctcgccgccgacattgatgatctccttggcgcgccctttcactttcaggaagccgtcgggggtttcctcgaccagatcgccggtccggaaccaaccgtcatcggtgaaggcatccatcgggtggttgagatagccgacgatccgccgccggctgcgcagccacaactcgccatcgacgatgcgatgctcgaccgcgtcgtcgtcgaagcgcatcgcgagactggtcgacgcccggctgacggtggagacgatgccggtttcggaggtgccgaaggtctggagcagccgggcgcggggcaggcggctgcgcagcaggccgagcagcccttcgggcatcggctcggtaccgtaggtgatcatccgcaaggtcgagaaatcatgggcttcgactgcgccgctcatcagcatgagattgaggaaggtgggcgaggcgggcagcacctggacccggtgccgggcgatggcgccggcaaccgccaagggcgtgcgctccgccggcagcaccagggtcgtgccctgggcgaggctcgagaagatggtgttgatgccgccgatatggtcgaacatcaggaaaagcagcaggcgcaggggcttggtgcggggggcgccgcccagatagctggcgctcagccggtccagatcgtgcagcatcgccttgggccggccggtggtgccgctgctgaacaggatcagcccggcatggcccgcctcgcgcagttgtgccaccagcggcgcctcgtcgccttcgggggggatcgcttccggccggtggccggtttcggggcgcagctgccagaccgcccgggcaagcgcggccttgtcgctgcgttcggccggcacggtcgaggtgtcgagcgccacgacggtgcccagcgcctgaagcgccagcagcagggccagggtatttgcgccggcctcgccgtcgagcttgaccacatcgccggcggaaaccccggccgcccgcagccgttccgtcgcgtcccgggcctgatcggcgagggccgcgaatgacgtctcgatgccggttgaatcgtcgatcagggcgaccgccgcgccgataccggcgatccggtcgagcaggctttcggtcatcgggatacccctcccagatagatgatctggccggtgaccatcgcggccgccgggtcggccaggaaatcgatcacccgcaccacctcgtcggtggtggccagccgcgacacggtctgggccgaaagcagccggtcgatcgtctcgggcggcacggttcgggtcatgcgggtgcgcaccggcccggggccgacggcattgacggcgatgcccatgggggcgagttcccgcgccagcgtctgggtcaggctttcgaccgccgccttggcggcggcataggcggccgcaccggcgagcttcaggggcacggcgacgctggtgaggttgacgatacgaccgcccgccgggggcgtgtctgccggggcgtcccgatcccggcggtgggcttcgggccgcatcagccgcgccgcttcccgagcgcagacgaagctgccgatcacattggtgcgcagcagggcctccagcgtttcggccggggtcagcagcgcatggttcatcgaggcttcgccggcggcgttgatcagcacgtcgatccggccatgggcgcgcctgatggccgacatcatcgccttgaccgccgcctcgtcggcgacgtccagccggtggtggacataggccggatgctcgatgggcgaggggctgcgggcacagccatgcaccagatcaccccgttccaggaaatgtgcagccgtccgccggccgatccccttgctggccccggtcaccaccaccacccggccggatacgtccggcccgcgggcgacagacgccgcccggctggcgcctggggtcgtctctgtcgtgccgtcctcggccggaagcggggcgtcttcatccatgaggtgcaacctcgaagaagaaattaccctggggttgatcgcttgccagcatcactccgtatcgctcgtcatccacggcgagcggcttgagatatgaacgtctgggttgcttaattcagggtagacctgcgctctggcaatatccaaccttatttttggttgtgatatattcaatgatatacgcgtatcgccccatggtacgcggatggtgcccggcgttcagggtcacgagccggagggcttgtcgctgttcttcagccgctgacgttccggccccgaggccggcgggccggatgcagaagaaccgccgcatatgcccttgagcgcctgccagtcggcttcgctcagcagggcggggccgtcggtggcggttccgggcgcggcggttccggccgcggtcaggcgggccagccggtcggccccgaaggggtggctgtccagcagggtgccatggccttcggtttcgccggtcacccgcaccagcaggtcgccgaaggccgcgggagagcggcccagcctggtcatggccgcggccgaaaagtcgtcggcggcggtttccgcatcgcgggaataggcggcattcagcacggcatcggcggcggtgacgatcgccgcgccacctgccacgtcgccgaacagcagcccgatcacgaaagaggtgctgccggcccggatcaccatccggagcccgtcgcgatgatgaacatggccgatctcgtgggcgatgaccccggccagctcgtcgggggtttcggccttctgcaacaggccgtcgaagacgtagatccgcccgcccggcagggcgatggcgttgaccacgtcggacgacagcaccaccacgtcgacgacggtctcgtcgtcctcgggcggcaggccggcatcgatcagggcctggaccatctgccccagcgcggcctgaccctgggggcgggtgcaggcctcgccacccagcagcgcccggacctgacggtcggtggcatctcccagccgggcctcgaccgaacgcggcaccagcggcgtgatccggtcggcggcgaatgggatgccataaagcgccagcagcacgatcgagacgcaggcggcgaccgaccagccgagcacctggcgggtgcgcccgcggccctggccatgatcgagcgcggggcagcgcgtttcgacggcgcgcgcaagcccggggtcggcgatctccagccgtgccagcgggttgctccccgccagggttttcaggcgcagccggccgtggccgtcggcccggcggatgtcgtcccaggcccagcgggcgagcggcgtgccctcttcgacgatctccagcaccgggccgatgatgatcgcgacctgccgtcggcgcgcgctccggccgtcgaagaagatcgcgcgggcatcggttccggacgcctcggtcatgctcagagacccccgatattgagatcgagcccgccggcgaagccttcgccgatcgcgtccaccgcctcgccctgaccggttgcatggtctgccgcctccagcccgtagaccgcggtggtctcaacgatccgtgcccagatatcgcgggtcaggtagatccgcaccaccacgcccgcggcgagcgccatcagcagatagccgagacccagacctgccagcgccagcggatgggcgaaggcggcggcgtaatcgggcgtgccgtcgggggcgggctgcgccagggcggcggcgaggccgaagatgcctgacacccaaagacccatcagagtgcccagcaggacccaccagccggtcgccttccaatagatgccgaagagtgctttgcgctcaagatagctgtggaagcggacctcgccgaagcggacattggacacccaccattgcagcatggtcgcccgccaggcggcgatcaggaagggcagggggataatggtcagcagggccggcacggtcagcagccagagatgccagccgcggcggaacagctcccgcccggtgccgtcgaacccgccctgaaggtcgccataggcggtgtggcgcatgcgatagcgctccagcgccgcctgccgccagggcagggcggcacccaggctcagcagcaccgccagatcccagagtgccgcgcgccaggcatagccgatgcccgacccggtcatggtgaagcgcagcccccgccagacggtgcgggtcacccgatagcggcgggcgcgatagatcgcgaactgggcaaagagatagaggaacagagagagcggcaggctggcgaaggcctgcacccgctcggcctcgataccgaccagaaaatacacgagataagccggcatcaggatcgcggttgcgatcaggaaaccgatcagcagttcgcgggcgcggccgacatattccagcgggtcgccgtcgaccagggtatgggaccacaggtgccggcggatgtcggtggccagccagaagcggtagaagccgaaggtgacgagttcaagcagcgcaccccgcagaaccaggttgcggaaggcccgccgcaccccgtggaagcgggtccagcgggtggacggggcgggggcgggcagtgtctggtccatgggggcggctcgggaaggttggggggcgccggcacacggcggtcttctcagatagccggcaacggcgccccgcgcaaccctgtgttcatgcgagccgttctcatcaccttttggtggggtggtcagagcggcccgtaggccgagatgtccctggggtcggttttcacatgcaccagcgccgggccgtcatgggccatggccgcgcggaaggcctcggcgaaatcctccgtccgctccaccgtgaaaccggcggcgccataggcccgggcgagcaaggcgaaatcgggccgtgacaaggcgatcccatggccgcgatcgcggccgatgcgccgggtctggtgcatcaggatggtgccgtagacgccgttgtcgaccaccaccaccttgaccggcaggtcttcgagcacggcggtcgccagttcctgaccggtcatcagaaagccgccatcgccggcaaagaccaccaccgggcgatcgggatcagccatggcggccccaagccccgccggcaggccatagcccatggcgccggcctgggtggcgaactgggtgtcgggccgcaggaagggccagtagcggtggacgaagccggcgaagttgccggcatcgatcgcgaccgcggcctcggggccggcaatctctgcggccatcgtcaccaccgcggccatgtcgaccgcacccagcaccggggtgaccggccgggctgcgaaatcggcgacacccttgtggatcgcatcgcgccagttgatccggtcggccggcggttgatgctctgccagccggtcggcgagcgcgtcgagcccggccgccacatccgccaccagcatatggtccggcaggcgggcgctgcggccggcggcgcgggcgatttccccggcatcggggtagagatggatgaccgtctgatgcggggccggaagcgtccagccctcgctggtcacgtcgtcgagccggctgccggcgaccaggatcagatcggcttcggcgaaggcgcgcttctgcgccgggctgcggcccagcccgagatggccgaaccaggccggatgatcggccggcaccaggtcctggcggcggaaggcggtggcgaggccgcagccgctgacccgggccagccggtcgagggcggcatgggcgcggtcgaaggcggcaatctcgcccgcgatcacgatcgggcgggcggctgccgccagcgcctcggcggcggcgatggtctgggcggcaccgggcaggccggccgcggcccgcagccggccgagatcggggccgttggcgcgcacgccgccggcgatatcgggcagggcatccgccgcggtctcgccttcggtcacgtcctcgggcaggaccaggatcaccgggccgggacggccggccatggcgatgcgcagggcgcgggcggtggccccggcacaatcggcggcggtgcgcggttcgatcaccgccttgaccgcatggccgaacatggcgccgtaatcgacctcctggaaggcttccagcccatgctcgcgggttgcgacctggccgaccatcagcaccagcggcgtggaatcctgggcggcgacatggacgccatgggcggcgttcgatgcgccggggccgcgggtgaccatggcgatgccgggcaggcggcgggcccgcgcccaggcttcggcggcgcaggcggcgccggtctcgtggcgatggaccagcaggcggatgcggtcggcatggatgcgcagcgcctccagcacggccaggtagctttcgcccggcacgcagaaggcggtgtcgatgccatgggcgatcagggtgcggatgatggcctcgccgcccgagggcggcgtcgtcgcggaggcgtcgggtccggtcatgggcggggatcctgcagcggggggcacaagcgaaaccgccgcagccccgggggctgcggcggttcggatccggatcaggcgatctcggcgacgatctcgacttccgccgtcacgtccaggggcagttcgttcacccccaccgccgagcgggcatgcttgccggcatcgccgaagatgtcgaccagcacgtccgaggctccgttgcccacctgcggctggccgttgaagccggcggcggaggacacgaagatcaccactttcacgatccgcttcacgcggtcgagatcaccgccgcaggcggccttgagctgggcgatgcagttgagcgcgcagagccgcgccgcggcggcgccgtcctcgatcgaccgctcgccgccgaccttacccttccagacgaccgcaccatcggcgaccggaacctggccggaggtgtagaccagattgccggtcacggcgtaaggcacgtaattcgcgacggggacggcgggcaccggcagggtgatgcccagttctgcgagacgcgcctcgatcttgcccgacatggctcagcttgctccttcggtcgtggggaggacgcccggaccctgtcaggcgcccggacggccggtcgcgccggcggtcagccggatcgcgacattcttggtctggacatagccgagcagggcttcgacgcccttctcccggccataacccgaccgcttcataccgccgaacggcgtttcgatgccgccggcgaaccactcgttcacgaagacctgaccggcgatcagacggtccgccaccagatgcgcccgggccagatcgcgggtgtagacacccgcacagagaccgtaatcggtgccgttcgcgatggcgagtgcttcttcggcatcatcgaagggcaggatggtcaacaccgggccgaagacttcgttctgggcgatttcggaggagggcgtggtgccggcgatgacggtcggcgccatgaaatagcccggccggtcgacccggcggccgccggatgcggcagtggcaccggcctggaccgcgcgcaggcacatggcctcgatcttgtcgagctggccgtccgagatcaccggggtcagctcggcatcctcgatgcccgggccgatcttcagcgccgaggcggcggcggccatgcgctccaccacctggtcatagaccggccgttccaccaccagcctggacgaggccgagcagacctggccggcattggtgaagatgccgccgcgggtcgaggtgatgacctgatcgatatcggcatccctgaacaccacgccggccgacttgccgcccagctccatcaccgccggcacgacccggtcggccagggcatggaggatccggctgccggtctggaccgagccggtgaagaccagatggtcgatatcgccatggccggcgagggcggcacccgcctcgtggccgaagccggtcaggatgttgacgacaccggccggcacgccggcatcgtggaccgcctgggcgagtgctgccagcgacagggccgacagctccggcgtcttcatcaccacggtgttgcaggtggcgagcgcacaggcgatggaccgggcgccgatctggagcgggaagttccagggcacgatctgggccgacacgccgaagggcgcatgcacggtgtagtcgatatagtcggggccgagcgggatcgacttgccttcaagcttgtcggccatgccggcataatactcgaaatagcgtgcggcggcggcgacgtcgccgcgggcggccgagatccgcttgccgttgtcgagcgtttcgaccagcgcgatctcctcggtccgctccagcaggatccgggcgatgcggtgcatcatccgcgaccgttccaccggcctcatgttctgcagcaggcgggcgttgaaggccttgcgcgcggcggccaccgccatgtcgacatcggcggctttggcgcaggcgatgtcggcgatgacctcgccggtcgccgggttgaccaccgggatgcgggtgccgtccaggctgtcgacgaagcggccgtcgatatagtgctgccagctccgcttgatctcgttcgcgccgctcatgggttccttagcctccctggtggtcgttgcgccatccgggccccgtggtcgtcacgatagcggtcgtctgcgggggccggcgcgccgggcagcatgccagccccggggcggccgcacaattcccgcaagccgtggtcctggcagatttccactgccgtccaccgggcggaaacccgcgtccatcaagggggaagcccgttcgtcaccgaaacgcgaacgagccgggccccgcctgcaattgcaggcggggcccggctcgtcggagggatgtctcagttcactcggcagcggcgcggccgtcgagcgtggggtagtcgacatagcccttcgcgccaccgccatagagcgtgtctcgatcgagcggtgccagcggcgcgtttcggcgcagccggtcgaccagatcggggttggagatgaacggccggccgaaggcgaccatatcggcccggccctcatcgatcgcagcgatcgcggccgcgcggtcatagccgttgttcacgatccagccatggcggccgaaggccttgcgcagggcggcatagtcgaagggctgattgtcgcgcgggccgccggtcgcgccttcgatcacatggatgaaggcgatgccgcgccggccgagttccgcggcgacatagccataaagcacggccgggtcggaatcctggcctgcatcattggccggcgtcaccggcgagagccgcacgcccacccggtcggcgccgaacaccgagatcgcggcgtcggtcgccgccagcagcagccgggcgcggttctcgatgctgccgccccagtcgtcggtgcgggtgttggtggcatcccgcaggaactgttccagcagatagccgttggcgccgtggatttcgacaccgtcgagcccggcggctttggcattctccgccgccttgcgataatcctcgatcagccgcggcatctcgtcggcggaaagggcgcgcggggtttcgaagggcacgaagcccgcttcggtgaaggcctggccttccgggcggatggccgacggcgccaccggcggcacgccccccggctgcaggctgggatgcgagatccggccggtgtgccagagctgcatgaagatccggccgccccgggcatggaccgcctgcgtgaccgccttccagccggccacctgctcgggcgtgaagatgcccggggtccaggcatagccgcggccttcggcactgatattggtcgcctcggtgatcagcaggccggccgcggcgcgctgggcgtaataggtggcggcaagcggcgagggcacaccgtcggcgccggcgcgcgagcgggtcagcggtgccatggcgatgcgattggcgagcgtcagcgagcccagcgtcaccggcaggaacaggcgggcatcggaaatctggtcggtcatcgggtcgggtatcctcggacgaaaaatgcggagcggcgggaccgccgccggccgaggcgccggggtgggcccgtcagatgccgcgggcatgcatccgtgcagatggggcggcctgttgcggtgcggaagtggccgctctcgtgaacaggccgtttccagagcgtgacaacagacgtcacatctcgcggtcggggatcaatccaccggcaaccgcgcgtcggtcttcacctcttccatcaccacataggtgtgggtggtgcgcacccccggcaggctgaccaggcagtcgcccaggaagcggcgataggcggccatatcggccagacgcgccttgaccagatagtcgaatccaccggcgaccatatggcattccagcacatccggctgctggcggatcgcggccttgaaggcttcgaacacggtctcgtcggtgcgatccaggctgacctcgatatagaccagcagcgcgcgatccagcttcgcggggtcgagttcggcgcgatagccgcggatatagccctcgcgctccagccgccggacccgttccagacagggggtgggggagagatgcacccggcgtgacagctcgacattggtcagccggccgtcgccctgaagctcggtcaggatacgccggtcgatgcggtcgagcgggcggggtgtggcgtcatcggtcatcggcggatctcatgctgccagatcggggttcaggcagagaatataacgctgcaacccgcagaacagccgcacattctgcctgctcgccggtaatctccggagattgcgcccgtcggcccggtctcttccggtctggccccggcgcccaaccgcgtgccgcccctccggagacgacacatcatgatccgcgataccgacgcccgtcccttcgctctcaccaccgatgccggccgccgccggatcgcggagctgaacctcgcccccgaggccgagatcaccgcccggctgatcgaggacgcccggctgcccgagggcatggccgcaaccgtccgcagccgtgccgaggcgctggtcgccaaggttcgcgccggggacgagccggcgcgcggcgtcgaagccttcctcaaggaatacgggctcggcacccgcgaaggtgtcgtgctgatgtgcctggccgaaagcctgctgcgtgtgcccgatgccgccaccgccgaccggctgatccgcgacaagctgggcgaggccgactgggatgcgcatctgggccgcgccgacagcctgttcgtgaatgcatcaacctgggggttgatgctgaccggccgggtgatccggctggcgcccgaggatgtggccggcggtgcctcttcggccatcggccgtctggtgtcgcggtcgggcgcgccggtgatccgccaggccctgcatgccgcgatgcgcatgatgggcaagcagttcgtccaggggcggaacatccaggaagcgctggatcgcgcccgcgccggctgggcgaagggctggcgccattccttcgacatgctgggcgaggcggcgcgcaccgaggccgatgccacccgctatcacgaggcctatctggcggcgatccgcgcggtcggcaaggtcgccccgcgggagctggacgagattacccgccccagcgtgtcggtgaagctgtcggcgctgcatccgcgctacgaggcggccaaggacggccgcatgctgaaggcgctgggcggccggctggccgaactggcgcgcgaggcgaaggcggtgggcatcgggctcaccatcgatgccgaagaggccgaccggctcgacatctcgctcgacctgctggaaggtgccgcggccgacccggcgcttgccggctggaacgggctgggactggcggtccaggcttatcagaagcgcgcccatgcggtgatcgatcatgtggtggagctggccgggcgcaccggccgcatcatccccacccggctggtcaagggcgcctattgggacaccgagatcaagcgggcgcaggaacgcggcctcagctccttcccggtcttcacccgcaaggaggcgaccgacgtttcctatctggcctgcgcccgccgcatgctggcggcccgcgaccggctctatccgatgttcgccacgcataacgcccataccgtggcggcgatcgacgtgatggccggccatgaccgccgcttcgaatatcagcgcctgcacggcatgggcgagccgctttacgaggccgcgctgggcgatgcgccgtcgaagggcggcgtcagctgccggatttatgcgccggtcggcgcacatgaggatcttctgccctatctggtccggcgtctgctcgagaacggggccaatacctcgttcgtgcatcgcctggccgatgagagcgtcgccatcggcgatctggtcgccgacccggtggcgaagcttgccggccgggcctcgcggcccaacccgtcgatcccgctgccgggtgcgatctatgcccccgaacggccgaacagccaggggctggatctggccgatccgctggtggtgatggagctggacgccgccgtcgccgctgccgccgccacacccgccgaggcctcggcgatcgtcgagggccgcgatcgcggcggcgcctttgcggagatccgcagccccgccgaccggtcggaggtcgtgggccgcgtggccgaggccgacgatgccgcggtcgaggcggcgattacggccgcccgcgctgcctggggccgctgggatgcgctgggcgggcctgcccgcgccaccgtgctggaggccattgccgaccgctattgggacgaccgccaccgcgccttcgcgatcctgatccgcgaggccggcaagacctggcccgatgccctggccgagatccgcgaggcgatcgatttcctgcgctactacgccgcccgggcccgcgccgatttcgccggccccgtcaccctgcccgggccggtgggcgagagcaacgagatccggctcgcggggcgcggtgttttcgcctgcatctcgccctggaacttcccgctcgcgatcttcacgggccaggtctcggcggcgctggccgccggcaacgcggttctggccaagcccgctgagcagacgcccctgatcgccgcctgggcggtgcgccacatgctggcggccggcgtgccggccggcgccatcgcgctgttgccgggcgacggcgcccgggtcggtgcgaagctggtcgccgacgaccggatcgccggcatcgccttcaccggctcgaccgagaccgcgaagctgatcaaccgcggccttgcggggcgtgacgggccgatcgtgccgctgatcgccgagaccggcgggctcaacgccatgatcgtcgacagttcggccctgcccgagcaggtggtggcggatgtgctgacctcggccttcggctctgccggacagcgctgttcggcgctgcgcctgctgtgtgtgcagaaggatgtcgccgaccggatcgagaccatgctcgccggcgccatggcggtaatggaggtgggcgacccgatgcggctcgcgaccgatgtcgggccggtgatcgatgccgaagcgctggacggcctgaaggcccatctggcggcgctgaaggcggccggccagacgaaaatcgccgaggcaccgctgccggccagggccgaagccggcacctttcttgccccgaccgcctggcggatcgacagccccgaccgcctgacccgcgaggtcttcgggccggtgctccatatctggcgctacgaggcgcgggatctggaggcggtggtgcagcggatcaacgcctatggttatggcctgaccatgggcgtgcacagccgcatcgaccggacggtgcgccgggtggcggagctggcccgggtgggcaatctctacgtcaaccgcagcatgatcggcgcggtggtcggcacccagcccttcggcggcgaggggctgtcgggcaccggtcccaaggccggtggcccgcgctatctgcaccgttttgcggtcgagcgcgtgctgtcggtcaacaccgccgcggccggcggcgacacccggctgatgaccaccatcgccgatggcggcgactgagcattccggcccgtcacctgctccgcagtgctgcgcgtggcggccattgcggagcgggtgcgaaggccttatgatccgcgccacatcaagagttggggcgacgcccaacgccaacctgccgcatccgggcaaggtggcactccctcgcgatccctgcgattgggaagatgtggccgagccggcaatcaaacggatcacgccaccgcgtccgcccctgaaagatcgagtggggacgcgccgatgccgatcaagattcctgacgatttgcccgcccgccgcacattggaagcggaaggggtgatggtgatgggcgagaccgacgcggtccgccaggacatccgtccgctgcgcatcggcctgctcaacctcatgcccaacaagatccggaccgagacccagttcgcccggctgctcggttccacgccgctgcaggtggagctgaccctggtcaagatcaccgaccatgtctcgcgccacaccgccaccgaccatatgtcggccttctaccggccctgggccgaggttgcgaccgaacgcttcgacgggttcgtgatcaccggcgcgccggtcgaacggctgcgcttcgaagaggtcacctactgggacgagctgcgccggatcctggactggacccagaccaatgttcatcgcaacctgacgatctgctggggcgcgcaggcggcggtgcatcacttccacggcatggccaaatacgacctgcccgccaaggccttcgggctttatgcccaccgggtgctggcgccggcctcgccctggctgcgcggatttccggacatcttcaccacgccggtctcgcgctggaccgaagtgcgggccgaggatgtgcccgcttcgagcggcatgaccgtgttggccgaaagcgatcagaccggtctctgtctgctcgacgacccggcccaccgggcactccatatgttcaaccatctggaatacgacacggtctcgctggcggaagaatatcaccgggacgttgcggccgaggtgccggtgaccctgccggtcggctatttccccggcgacgatcccggccgtctgcctcacaacctctggcgcggccatgcccatctgctgatcggcaactggatcaacgagatttaccagaccacccccttcgacctcgaccgggtggggatcgaggatcacgtgccctccggccggtgacggcggtcaggtcgcgggaagcttcgtgatctcgtcgcgcaccgcggccaggatctcgtccgacagcgcgcggtcactggcctcggtggcgcgggcgagcgccagaccgccgaccagggccgatatcaccaggatcgcgcggccgcggtcgccctcgctggcggcaagggcggggaagcgggctgccagcgtgtcgatgaaccggtcgatcccttcggcatagctcgcctgtatgccggcgtcctggcgcggcacctctgtcgcgagtgctgcgatcgggcagccgatgtcgcgccgggtgcgatgggcttcggacagatagttttcgacatagcggccgagatcgcggcccgcctgatcgcgtccggtttccagccgctcgatcgtgtcgccgaaggccttgccgcaggcctcggcggcgagtgcgtccttggacgcaaaatggccgtagaagccgccatgggtgagaccggcggccttcatgatctcggccacgccgacaccatcgaagccacgctcgcgaaacagccgacccgcagccttcacgatcgcagcccggttggccgccgcctgttccctggtcaccttcaccgcttcagccctctctcctgcgcacgtcgaccggccgcgcacgcatcgatctgctcttgacggcgggcatgacgttcatcatcaataaaacatgatgatcgtcatcataaaccgaacgccgttgggcggcaatgcggcgaatgtggcggcttcccgacgggagcggatgaatggcatcgacggtgatcgcggcggcactggcccgccggcaggtccattacggctgggtggttgccggaaccacctttctcaccatgctggtggcggcaggggcggtgggcgcacccggcgtgctgctgctgcctttgcagcgggatttcggctgggagacgtccgagatctccggcgccatggcgatccgcctgctgctgttcggcctgatggggccgtttgcagcggcgctgatcaaccgcttcggcgtcaggcgcatggtgctgacctcgctgtccaccgtgggcggcgggctggcgctctcgctggcgatgaccgaactctggcagttgatcctgctctggggcgtggtggtcggtatcggcaccggcatgatcgccatggtgctgggggcgacggtcgcgacccgctggttcgtgaagcggcgcggcatggtgatcggcctgctgaccgcctccaccgccaccggccagctggtgttcatgccactgatcgcctggatcgccgatggcatgggctggcgtccggcggtgatgctgctctgcgggctgatggcgctggcggcgatcctggccctgatcctgcttcgtgaccgcccgtccgatctggacctgcccgcctatggcgagacggaggtgagcccaccccccgccggcatgggcggtgcatcggtggccctggcggcgatcggtgcgctgaaggatgcggcgcgtacccgggtcttctgggtgctgttcctgaccttcttcatctgcggcgccagcaccaatggtctggtccagacccatctggtaccgctctgcgtcgatttcggcgtggcggaggtcagggccgccgggctgctggctctgatgggcgttttcgacttcatcggcacggtgctgtccggctggctgtcggatcgctacgacaaccgaaagctgttgttctggtattacggcctgcgcgggctgtcgctggtcttcctgccctattcggatttcaccctctacggcctgtcgctgttcgcgatgttctacggcctcgactgggtggcgacggtgccgccgaccatcaaactcaccgccgaccggttcggtcgcgagcgggcgccgatggtcttcggctggatcttcgccggccaccagatcggcgccgccaccgcggctttcggtgccgggttgtcgcggagcgaactcggcacctatctgccggccttcttcgccgccggcatcctgtgcttcctggcggccggcgccgtccgcacgctgcggccgccagtccggggctgaccggcagggggctgaccgtcagcgccggcgcagccagtccagcacatcgcccgcattccggtcgggcgggaagaccggatagaacacctgctgcaccacaccatcccgggtgatcagggtcagccggcggatcagcctgtgcccgcccacctccatcaccggcaggttcagggcccgggtcagatgcagaccggcatctgacagcagtgggaagggcagatgcagccgctcggccgcctcgcgctgccaggcggtgtcctgggtggagatgccatagagcgcggcgacgccggcctctgccagctcggcggcatggtcgcggaaggcgcaggactggggcgtgcagccgcgggcaccggggatcatgtcccagccctcgggcaggggctgatcggggcggccggtcatcggatagaaatagagcacgccccagccggcgagatcggccagacggacggtgccgcctgtggtcgagggcagggccagatccggcagccgggcgccggtcagatgtgcggcggcaccgtcatcgacgggggccgggatgctgctccagtcgacacgggtcaaagagggctggttggcgggggaggggccggtcacagggcactccatgcaagtgtggtggcaaagccgatcagcgcgccgccgaagacgaaatcgacccagccgttggaggcatcgatcgcccgggcgatcacgcccgatcgggcgaggatggcgaaacacgaccagaacagcgccgattgcaggatcagctggccgccgaagactgcaagggctgcacgtggcagatcgggggcggcgacctgcgagaagatgctgacatagaagatcgcgatcttggggttgagcaggttgaccagatagccgtcgcgaaacagcgccgccggagagcgacgctgcggcgggggcgggaccggggctgccgcagcgcgtgccgcgcggcgatgccgcatcttggtgaccgcggccatcagattgcggatgccgagccagaccagataggcggcgccgcccagcgccagggccaggccgagcgcgggggaggcggcgatcaccgccgccacccccgccatcatcagcgcgacattggtgaccgtcgccccgacgatgcccgagaccagcggcgccatcggccccatgcggggttcggcgccgtggcgcagcacgatcagtgcggtcggcccgggggagagcatggcggcaagatgcaccaccgccagcagcatcaccgatccgaacagctgtgcggtcaatgtcggaaggtcccgggacgagtggccaggatcagccgttcgcgatcgatctgcgcctgggtccagagcgcgggatccacaaagcgccgccgggtttccccgatcagcggtaccggcagcgcggtatcggtgtcgcggaagtcgcggacctcgaacacctcaagccccgcgccttccagccgccccagcatggcttcatagtcgtggccgccgaccagaagatgatgggcatgcatctcgatcagcacggcccgaaagtcgatgccgggcaggctgccggccaggcaggcggtcatgccggccagaaccaccccctcggcgccgtgcacgtcgatcttcaccaccagcggcccggcgggcaggtcgcgggcgagatcgtcgaagcgccggccgggcacgatgatcgcgtccggcgtgtcgggggcgacgatggtccggccacggaaatgcaggctgtcgccggtgtcgttgagcgccagacaatgggcgcggccgggttctctggtggcgtggacctccccggcgcggcggatattgccggccagcacttcgaaagcctgggggttgggctcgaaagcctccacccgccagccgggatagcgggcggcgacgaggcaggggtaatagccgtgcagcgcgccgacatcgcagaaggtggcggccggcagcctgttcgcgatccggtcgagcagatcgaccacggcgggttcatagccgagggccgagaaggtttcgcgcgccacggtgtcgcccggatcgtggagggcgaagctggtaccgcgcaccgcgaaacgggtcaggggcagggacatgtcggtcatttgatcgcgagccacccttcgaagcagagatatttctggaccgtgatgatgtcggtgaacccggcccggcgcatgaagtcgacattcgcctcggaggtgaagggctccatcttgcccttcaggctcaggcttttggccaggacctcgcggtggtcgtaaccgttggcgagcttgaattcgttgtagagcgtggtgaaggcatcctggaaacgggcgtcgttggcccgcaccttttcgaacaggatgaaggcgccgccccagtcgagggcgtcccagatccggtcgaacagggcctgacgatgtttgggcgggatgaactgcaccgtgtaatgggcggtgatcaggtcggaacgctcgaaggcgaagcgctccgcccgggcggtctggaagaacatgtttggcatgtcggcatggacctgccgggcgtgggcgatcatgtcgggttccacgtccagcccgatgaagcgggtctcggcgagatcgccatggcgcatggccagccggtgcagcagggtgccggtggaggtgccgatctcgtagacggtggatcctgcccggacgaaatagtccgaaagcctggccgtcagatcgtgcccgctgtcgtaaagcggcacggatcgggagacatggccgtcgaacttgccggcgacgtcgccggcaaagctccaacgggccggtgcaacggcaataccgtcaccggcggccagctccacgatccgggatgtctccggtgtcgcggtcatcagtggtctccgtgcggcgcggaccggtggcgtggccgcgcggcggatggaactgccccctgccttttcgccagcagaagattccacggagatgtttctttttcaatccgaaattctactgatgatttcttttcagaaaagaaaaacgcccggatggttcgtccgggcgttgtgacgcatgacgatcagacgcctatggcgcgcgggcgagtgccttccatggcccagagccaggccagggcacaggccgtcagcgcgaccggcggcagggccgagagggtgagcgtggcccagtcgaagcgttcgatgagctggcccgagaagaaggccgagagcgccaccagcccgaagaccaggaaatcattggcagcctgacccggcccccgttcggccggcagcagcgacagcgataccagggtggtggcaccgacgaacagggccgaccagccgaggccgagcagggtgaggctgatcctgaaatgccagacgctgatccccgaggcgccgacgccgatcgccatcgccatcagcaggcagccggccagcatcatcggcatcaggccgaaacgttcgatcagccggccgacgatcagcgccggggcgaacatgccgagcacatgccactggatgacctgggcggtggaggtgaaatccagcccgcaggcgaccatcgccagcggtgttgcggtcatcagcaggttcatcaccgtataggcggtgatgccggccaggatcgcgatcacgaaacgcggccgccggaaggcggcacccagcccgcccgagagcgatttgaccgtgccggccggcttgcgcaggtccagggccagggcggcgatcagcatcagaaccgcggcaccggcgatcaccagataggtgccgaggaagggatagggcgatattgcgtcgcgtgaggcgccggccagcgtggggccgaccagggcggcgagcagcccgcccgagatgacgaaggcgatcgcccgcgcctcgccgccgcgtggcgcggcctcgcccgccgcatggcgcaggaagacgctgaagccgttcgacatgccgaccagcaccatggcggcgcagagcagcaggaagctggccatggcgatggcgacggccgcgagtagcgccccggcgatgccgagacaggcaccgagcgcaaagcccgcccgccggccttgccgcgccatcagcatcgaggccgggatggttgtggcggtgttggcgatgaaggtcagcgcgaagggcagggtggccaggcttttgtcttcggccagcatatggccggcgagggccgacaccgtcaccagcagcatggtcatgatggtgtagaagccctgcgacagggacagcagggcaatggcgcggcggctgccgcccggcgcatgggccgggtcggtgacggtggcggtcatgggggtgggaactccgcatccttctggtccgggatgtgccccgcttcagccggcgggcccggggtgttttcaccatcctgacctgttgaaaccgccgcgtccatatggcgtggcgtccatatcatgtatcggacctcttcccccccgggtatcgggcatgtcactctgtcggccccgaacgtcatttgaaagccgtgcccatgaccgctgtcgccgtgccgcccaccatcatcgactgcgacccgggcgttgacgatgcccatgccctgttcgcggcgatcggtgcccggcacctcagcggcctcgaggcggtgacggtggtcgcgggcaatgtcgcgctccgtcacacccggcgcaatgcgctgcggatccgcgaggtggccgggctggatgccgcagcgcttccggtctatgccggctgccccgggccgatgatcggcgccctgaccgacgccgctgacgtccacggtgccgacggtctggacggtgccggcctgcccgagccgcagggagaggtggaaccgatccatgcggtggcctttctgatcgaccggctgcggcgggcggcgtcagagggccgccgggtcaggctggtgacgctgggaccgctgaccaatctggcgacggcgctgatcatggcgcccgacatcgcagacgggctgctggaggtgcgcgccatgatcggcagtgccgggcgcggcaacatcacgccggcggccgaattcaacgcctatgtcgatcccgaggcactggaacgggtggcgaccaccctggatgcggccggtgccgacggcgtgccgttctacgtttacgggctgacgctcacccataccgtcaccgccgatcgcaccgagatcgcccgatatgccaccctcgacagccgggtggggcgggccgtcgccggcatgctgggggcctatctcgaccggcaccgtgtggcgccgctgcccggcatgggcggcgcgcccgccgacgaggcgcctctgcacgacccttgcgtcatcgccgacctgctggcgccgggggccgtcagggcggtaccgggacgattgcgggtcgtcctccacgggccggcgcgggggcagacgctcgcctctttcgatgccggggatgaggtcggggccggatcgcgggtgatctggatggtggagggcgatgccggacgtctgcgcgccgctctcttctctgcggtgtccggtttctctgctgtgaccagtttctaagctgtggcgggcctcggtaacggctgatcatcgtctggcgttaacggaccgataagtttcatcctttaatgatgttgtcatcaaggtccatgcgacggccgggccgggggggctccgaccgctgcatgccgcgggcaggacgcggaaacgacaaagaagaacgatcaggggaggttgggacgacatgagcgagcatgaccagcaggccaccgatgcaggagccgatgtcatgaccacgccggcgccggaaaccggccgtcgccgacgtttccggcgccggcgggccgagaggcctcgcggccgcgacgcccggcgccccgggtggctgggccggatcggacttggtccgaagctgttcctggcctttgcggtggtgtcgatcctggccgtcgtggcgagcggtgtcgcctggatctcttacggtcgggtggagcgtggcttcgaggaggtgcaggaacagggcgtgcggccgctgaccgcggctctgcgtcttgcccgacaggcggaggtgctggcggcatcggccccggctgtcgccagtgccggctctgccgaggcgcttgacaaggaacgccaggcgatcacctctgcgatcggcggcatgcgcggcgatcttgccgccctgcaatcggccgggctggatgccggcctggtcggcatggtcggcgaggatgtcgacgccctgatcgcccggctcgatgaactgctcaaggcggttgaagagcgctatgcgctgaccgcccggcgcgaagccgccatccgcgacctggccggtgcacgcgatacctatctggcggccatctctccgggtgcgcagcggatctcccaggacttccgcaacaaggcggaggcgaccgccggcatgttcgagttcggcactctgcaggaggcggtctacgatctgaccagccggcagctgccggcccttcagctcagcatccagctgcggggcgatatcgcggccgcccagggcatcgttgccgagaccgcgaccatcaccaattccgcccatctggaacggctgcgccagcggcttcaggcggccgcctatgcgctggatcgcgacaccaaggcgttggacgatcgggtgaacaagggccccctgcttgaggctgtggcccgcttctcgcaggcggcgacggccggcgacaaaaacaacgtcttcgagatccgtgccgccgaagttaccgcgctgacccaggtcgaccagcgcctgcaggccgcccgcgaggccggccagctgctggcggaagatgtcgacgggctggtcttccagacatcgggcgccatcgccgaagtgcgcagccgcacgaccgaagatctgacccgcagccggacggtgttgatcgctctggccggcgcaagcgtcgcggtctcgctgctgatcgcgctcggctatgtcggccggcgggtcatcggccggttgcggcgtctggagcgggcgatgcgttcggtcgcggccggtgatctgaccgtcgatctgccgccggcgggcggcgacgagatcggccggatgaccgaggccctgcaggtcttccgagacaccaccgccgaggtcgaggcggccaaggcccgcgccgcggcagaggaagagcggcagcgggagatccgccgcagcgagatgctcaacctggcggccacgttcgaggccgaggtcaagggcgttgtcgatcagctggcggaagcggtttcggccctgggcgcaagctcgtccgaactgaccgcagctgcggcccggggcgacgagcgtgcccagaccgtcgcggcggccagcgaagaggcggaacgcaacgccgagacggtctccgatgccacccgccagctctcgggtgcggtcgccgagatcggcaatcaggtccaggaggcatcgaccatcgcccggggtgcggtcgcccaggtcgagcgcaccgacaccacggtcgaggagctgggcaaggccagcgaggagatcagcgaggtggtgcggctgatcggcgagatcgccggccagaccaatctgctggccttgaacgcgaccatcgaggcggcgcgcgccggcgaggccggcaagggctttgccgtggtggcgggcgaggtgaagacccttgcggccgaaaccgccaaggcgaccggccggatcagccagcgggtggaggcgatccagagccgcaccggagaggcggttcaggcgatccgagacgtgcgagacacgatcctgcgcctgaacgagatcgcgagtgcgatcgcggccgcggtcgagcagcagggcagctccacccaggagatcgcccgcagcgtggccgaactgagtgccgggtcccgcgaggtgtcgacctctatcgccgatgtcgccgatgccagcagccggacatctgaaggggcagaccaggtgcggcatgcagccgatgcgctgggcacggcctcccgcaatctcgaccggtcgatgagcggcttcctggatcgtctgcgcagcgcctgaggccggggccggcaggacggcgggggcggggcatgtcgaggcggggcatgtcggctgacgcggatatcctgccgtgtctttcacgccgatcatgcctttcccttacgcggccatcgtcccacctttatgtgaatggcccttccagatccggggccggcagatccaccggaatgggaggccccacatgaccgaggatggcgcgaagatcgttgaactcggccggcatcgcggcgagcgcgtgccgatgccgccgaaggatgcggtgcgtggggctgcaccggtggtggttgctttcgatcgccggcagcgcgcggtcgaccggctgtcgcgggcgctggcggcgatcgatgccgccggtgccgatcttgctgccgcgcggggggcgctcgatcatcagcaccggcgtctggacgatcagcgcggtcagctggcccggcatgtcgagcggctgggcgggattgccgatgacctcaaccgccgtgccgcgcgcctgcgcgaaattgaggcagagaccgaccgcgcgatcgccatggtcaacgagggccggtgggtcgatcccaatggatgagccagcgggatttccggtaaggcttcaggcagaagggccggcagtgaaaactgccggcccttcccttggtcaactctgtcggcgctcggatcagggttcctcgatctcgccggccgcggtctggagatagttctggatgccgagctgatcgaccaggcccagctgggtctccagccagtcgatatgctcttcctcgctcttcagaatctcgcgcagcagatcgcgcgtgacgaaatcggccttggtctcgcaatcggcaattgcgacgcgcaggtcgacgaccgccttcatctccagatccagatcggcctggagcatttcgggcacggtctcgccgatgtgcagcttgcccagatcctgaaggttaggcagaccttccaggaacaggatccgctcaatcaccttatcggcatgcttcatctcgtcgatcgactcgtggtactcgacgtgaccgagcttgcgatagccccagtccttcagcatccgggcatgaaggaaatactggttgatggcggtgagttcgttcttcagcaccgtgttgaggtgcttgatgatcttgggatcgcccttcatggccgtctcgtcctcgttctcgtgacccgatgccggctgcaggggaaggcgccggctttgaacgagactatagccacaactctgtcccgcggccagtgcggacaggctggaattcttcaaaaagtcgtggaattacttgagtttgcgtcgcagcttcgagcttttcttgagtttgcgtcgcaactgcgcgatttatgcctgagagtgactgtcaggcgcggatcgacgccggaaccgccgcatttgccgcctcggcaccggtgctgccgcagccgggcagcatggcccggacgcagtcgatgcatttgccgcattgcggccgggtcccgagggcgcggtagacgcccgagacacttcgcgcaccggccgcagcctcgcgcacacgccgttccgtcaatccgttgcagatgcagacatacatgctgagccgcactccgatccgggggctggtcgcagtggcgggaaaaggcccttcgccgcaactgcgaaccgttcgcatggatagagtggcaatgctgagaatgattgtcaatcgcctattgtcgcctcgcgttgcttcagaacgcgccgcatgatcttcccggttgcggtcatcggcagttccgtaacgaaggcgatctcgcgcgggtattcatgggccgccagacggtcgcgaacatgggcacccagcgcgcgggccagatcgtccgacggttcgacgcccggggccgtaaccacgaaggccttcacgatctcggtgcgtaccggatcgggcttgccgatcacggcggccatggccaccgccgggtgccggatcaggcagtcctcgatctcggccgggccgatgcggtagccgccgctggtgatcacgtcgtcggcccggcccatgaagtggaacagcccgtcggcatcgcgtcggcccatatcgccggtcagcagccggccattgcggaacttggcctcggtggcggcgggattgttccagtagcgcaggaacatcaccgggtcgggggcaccgaccgcgatttcgccggtctcgccatcgggcacggtctggcccgcctcgtcgacgatcagcacctcgtggccgggcacggcgcggcccatggcgcccgggggcgagggttcgatccgctggttgcaggacacggtcagattgcattcggtctggccgtagaattcgttgatcggcacgcccagcacctcgcgcccccagtcgagcaactcggaccccaaactttctccgccgctgccgacggagcggagcgtcagatcggcgggcacccggtcgcggggcacgccgcgcatcagcttcagcgcggtcggcggcaggaaggtgttgcgcacccgctccgtcgccatcagccggagggcggcttcggggtcgaatttgcgcatgcgctgcgaaacgacaccgatccccatcgcccaggccggcagcagcacgtcgaacagcccgccgatccaggcccagtcggccggtgtccagaacaggtcgtccggccggggtgggaagtcgtgcggcatctgcacacccggcagatggcccggcagcacccggtgagcatgcagcgcacccttgggattgccggtggtgccggaggtatagatgatcacggcgggatcatcggccgcggtgtcgaggatcgcgggcggggtgccggtggcatcgcggatcagccggtcgaaggcgatggtgccggccggcaccggctcggggccggtcacgatcacccgggcaagatccggacagtcggcctgcaccgacatcagggcgtccagccggccgggatcgacgatcaccgcgcgggtgccgctgtcggccaggcgataggcgagcgcttcggggccgaagagggtgaagagcggcagggcgatggcgccgatccggtagatcgccatatgggccagcgccgcttcggggctctgcgacaggcagatccccacccggtcgccgcgcccgatccccagatgcagaagcccggccgccagtcgccccgccagccggtcgatctcggcaaagctgaagactttccggctgccgtcttcctcgacatggatcagggcggtgcgatccggcgcctgatgcgcccagagccccgcagtctgggcggcgatgttcagccgcgccgggatctgccagcggaagcgggcgcgccattcggcaatggcctcgtcggggcggggggcgtcgagcatcgggcgggtcctccggttggccccgaggctctttccatggcctgccggggcctgccgatcctgccgcgtctgcccgggtccggcaaggcttccgcccgcgggggcatgacctcagggcttctgcacccagccgctgccttcgggcatcacccaggttcccgagggcgcgcgctcgatcacctgcgcgccagcgatgcgttcgacggccgagagcgaagcgccgcgcttggcggcgatggcccggtagcggtccttgcgctgcaggttgatccggtcgatcacctgctgcgtggcggcatcggtctgggactttacggcacccacatagccgtcgaagcgctcgcccaccagcccctgcgccttcagcgcatcaaggccggcttcctgggccatggcggcgcggggcagggccaatggcgggacggcggcggcgggcagggcggcggccagcagaacggcgaggaaccgggcggcggtgcggcgacgggcgggcagggtcggcatcagaacagctccggctcttcggcgagcagatcctcgatgtccttttcgacccggacccggacctcgtgctcgatcttgacgttgacgttgatgacgatcggcttctcgggcgcctcgaccctcacggtcggctggcaggccgccagcagcaccagaatgccggccagcggcagcaaacgtatcggtccggccattcctgtcctccccggcctgcggtatcgggtcgctattcgggcgaccggctcttcatccgcgactgctctttcacgagggactggccgaaaccctccgcaccggaatcgaacagccgcccttcgacggagagcagctgggcgagtggcccgcggacgtcgaggttgatctccatcggatacccgtcatacaccgccgggctcgatcccgcgagcgacaatcccgcggtcagttcgccctccagcgggccgtcgagggtgaggcgcagatgccgcatgcggaagtcttccagcgcacgcgccagcaggtctgccccttcgctcgcgctgccggccgcggcctcggccgtatccgatgcccagctcagccggccggcctggccggtgaattcggcatggtcgatccggatgccctcttcccccagcaccaccggcacgaagccggaaatgcgtccgtcggcattcagcgccggttcgtcggcaaaggcggcgagcaggccgagttccaggttctcggctcgcaggatcacccgccggtcgcccgcactcagcggcacccgtaccggttccaccgacaagcggccgccggcgaagggccattccgcgttgacgacgtcgaaggtggtgggggtcaggatcgcggtcatccggccgtcggtcaggggcagccccgcctcgatccgcccgatttcgagcgtctgcggcccgtcggtgacccagggatcggggcccgtcaacaccatctggccggtcaggcccgagacggtcgccgcctcggcggtgaagcccgcattggcgaggctggccaccagccgcagccgcagcggcccgccgccccaacggatcgtggcggtggcggccgtctggccggtgacaccggtgacgatgccgccagccgccggcaccagatcggccggttgcagccgctcgcgcgcccaggtgatggcgggcagtctgaccagggccgtgccgcgcccggcggccgggtcgtgggagagggtgatatcggcccggacccgtcgctgcggatcacggacgtcgcccgccagttcgatgccctgggcggcagcccggcccgagagcgcgatgtcgaggggcgcgaaacgcagcgggctggcgatgtcggtcaggcgggcggacagccggccgatggtgaccaccggttccggcgcatccggcgcttcgatgccggcttcgaccgccagccccgaaatcgcgagatcggcggacggcagccggagatccccgtccgacgcggtcatctgcagggggccgttcagcgggtcgccggccagcgtgacggtcggcagccggccggtcaccgcgtccccgtcgatccgggccccggcgagcaccccctgcaccgatctggcgccatcggtcagatcgagcagcggctggccctctacggggcagagccgtccctcggtcaggcgaagcgttgtctcttctgcgtccagggtcagggtcgggaggttgagacaatcggcaaggtcgatccgcacgccgccgtcgatcaggctgcgggtcagggtgaaggcgaccggaacgggccggtcgcgatcgacatgccagccggggccgccgccggccggcgccacatcgccgcccagttcgatgcgttcgcggccgtctgcgcgcgacagccgggcggacagggccagatcggcggcggcgtcggtagcaccgtcggccgtcgaccaggcgagccggccggtgagggtgatgtccggatcggaggagaggcgatcggcgccggcgctgccctggaagcggagcaggggcgtgccgtcggctgcgagccaggctgcgtcgacatcgtcgatcgtggccccgtcgaccggcagggtcagcggggcgggcgcggtctcttccgcggcggaggccggctgaagaagcggcgcaaacggcccgggctgcccgtcgaccaaccgcagcgtcaggccgtcgatcctgagatccgccagccgaccgtcgagaagcgcatcgagcgtgaaggcgaaggtcatctgccgggcatgggcgcccgaggccggagatgcgccgtcggcaggctggccgagcgttacatcgctcaggaccagggcaccgtccgcgaagtggcgcgcgcccaccgccaccgggccgagcccacgccgggtgagcgcgtctgcggcgaggtcgactgccaggcccggcccgtagcgccagaccccaaggcccagggcggtgaccgcagcgatggacgctgccaggatgatcgtgcgccgccggccggccatcccgtctcccctgcgtgaagcttcctggcggtcagtctagccgataccaatcgcgacatccatccggcgcgctcgtaccaggatcagaggatgaagtccgatgcgctgagagcactggctacgtcggcgagggtgatctgcatgtcggccacgcggtcgccatcgagatcggccagaatcagggtttgtccgttttggatgatggcgcgcacttcgccgcctgcaccggtgaacgcactggctccgaggaaggtgaaagcctggtctccggtcgttccggggagggcatcgataccggaaagatcgatgcggtcgccttcggaccgggaaaaatcctggatgatatccgccgctgttctggtgctatcggtggagtcggtatagacaaaccgatcggctccgctgccaccaatcaaagtatctgcacccgcacgaccttcgaggcgatcgtttccggcctgaccagacaggctgtcgtccccgatgctgccgcgcagcagatcggccccggctccccctacgacggcctcgatagagatcaactgatcgttttccgccgttccgccttgtccaaggcccgacagcaggtcgatagtgagattgcttgtctcagccgaatagtcggcagtgtcaaacccatcaccgccgtcgaggtagtcggccccctcattgcccgagagaatatcgtctccggcatcgccgatcagagcattgtctccggtatcgccggtcaggcggtcgttgaaagcgctgccaccgacactttcaatgttgatcagtgtgtcgcccgtggcatcaccaccagtgatcacaccgccgctccgcagatcgacagtcacggcagaggccgatgccgtgtacagaacaaggtcgacaccgatgccgccatcaatccgatcggccccggtaccgcctgagagaatgtcatcaccgccattgcctgcaatgatgtcgtcgcccccattcccagagagggtgttggctccggcatcaccggtcaggcgatctgcaaacgcgcttccttccaggctctcgatgctgatcagcaggtcacctgtcgcatgtccccccgccgcggcgcctgtcgccaggttgatggtgaccgcagcgttggacgttgcatagatcgcccgatctgttcctgcgcctccggtcaaccgatcggctccagcccctccgattacggcatcatcgccggcgccgccatcaaggacatcgtctccgtcgccaccgctcaggacattcgccagcacatcgccggtcagctgatcggcgaacaggctgccactcagattttccacgtcggtcaggacatcgcccgtggcatgcccacccgtcgcaatgccggtcgcaagattgatggtcactccggcgttcgaggcatcgtagaatgcggtgtcatttccattgccgccgatcatctgatcggcccccgcagcgccgatgagggcgtcgtcgccgtcgctaccgttcaggacgtcgtcgccttcggcaccgttgaggatgtcgtcgccgatcgtgccggtcagccggtctgcgaaggtgcttccttccacgctttcgatgtcaataagaacatcgccttcggcatcgccgcccatgccggtgccgttggacagattgacagtaatgccggctgaggaggcagcataactcgtccggtcgtgacctgcgccgccatcgatccgatccgcgcctgctccgccaatcaggacatcgttcccacccccacccaggagcctgtcgttcccggcgccaccgctcaacagattggcatctccattgcctgtcaggcgatcggcaaaatcactgccgatgatgttttcgacgcctgagaaggtatcgccactggcatgccctcccgatgcggtaccggcagcaagatcaatgacaaccgctgcagtcgaattgccataaagcgctatatccgtcccattgccgcccacgagctgatctgcaccggccccaccgatgagcgtgtcatccccatctccgccagacagcacgtcatctcccatgcctccatccagctgattggcggcaccatcaccggtaagggtgtcggcgaagtcgcttccgatcaggttctcgatgccgtcgaaatgatccccctgagcatcgccaccttttgccgtgtcgagaccgagattgatcatgaccgccgatgccgatgcctggtagaccgcagtatcgattccagcaccccggtaagctgatcggcaccggctccaccgatgaggacatcgttgccggccccaccagagagcacatcgtctccctcgccaccggagagggtgttcgcagccgcatctcccgtcagcctgtcatcgaaacgactgccgtcgacggattcgatactgctcagcacgtcgccttcggcgtcgcctcccgatgcggagccgcttgaaaggtctacggtcacagcatgcgcagacgtcccgtagccggcgcgatccatacccgcgccaccgatcaggcgatcggcacccgcgccaccgatgaggctgtcattgccgccacctccgtcgaggacatcgtcaccctctccgccaatcaggacatttacaccaccatttccggtcaggcggtcatcaaagctgctccccatcaggttttcgatggagatcagcaggtcccccgaggcagagccgccagaagccgtgccggcggcaagatcgatggtaacggctgccgcagacgtatcgtagagcgcaaaatctgtgccggcaccgccgtcgagacggtcggcgcctgctcctcccgaaagagtgtcatctcctgcggctccggcgagaatgtcatcgccatcattgccagacagagtgttgttgtcggcatcgccggtcaaacggtcgttaaagctgctaccgcttacgacttcgatcgcgaccaggacgtcaccttccgcgtcgccacccctgcccatcccggtggtgagactgatcgtcacggcacctgtggacgtatcgtaaacggcgctgtcctgcccttcgccgccattcagcgaatctgcaccttccccaccgatcagaacatcgtcgccaccacctccgacgagcgtgtcatcgccgtcgtcgccggtcagcatgttggggccggcatctccgacgaggcgatctgcatgcgctgagcccgtcagattctcgataccgatcagcacgtcgcccgcggcatggccgccggcggccgtggcattgtccagatcaacctgaacgccctgggatgagccgcggtagctggccgtatctcgcccgtcgcctccgatcaatcggtctgctccggcccctccgatcaggacatcgtctccctcgcgcccgtcaaggcgatcgtcaccggcgcggccgtcgaagacattcgcgcccgcatcgcccgacagctgatcgttggcagccgtgccgatgacattctcgatgcccgtcagtacatcgccttcagcatcgccgttgtgacctgtgccagcagcaagatccaccatcacagccgccccggcgtagatggcggtgtcgatgcctcctccaccggtcagccggtcagcgccgccaccgcccgtcaacagattgtcgtggctgtttccgatcagaatgtcgctggcagcggttccgatgacttgctcgatggagaaatatgtatggcctgttgcggcaccatccagacccttcccctgggccagatccactgtcacacctgcagttccggagtgtccggtggcataatcgatcgtatcgaggccgcccccaccgtcatagcgtgcgttgccggcccgcccaatgaggtagtcgtcccctccgccaccccatatggcgtcggctccaccaccaccatcgatctgatttgcaccgtccgtgccgataatggtgtcgtctgtggtgcgatacgtgacggtcgtcacgccaccttcgatcgaagttatgcgccgggcggtgatgatgacattctcgatcccgacatagctatctccctgggcgatgtcacccgcccccagacctgagtccaggttgattgtcagcgcgccgccagccgatatgtattggatccagtcattcccatcacccccgttgaagagcgtggaatggtcttcaatggtatcgaccgcatcatccacgccatccatgaggaagtcatcaccggtaccaccatgaatctcatgaagtacctgattcttgccgtcaaatccaacgttccagatcagatcatcgaatgctgttccaataactatttcaatcgaggaaagaaagtcgagttgctcggtgatgcgatcggagatgcccgtgcgcccaccgatcactgcgtggttataggcggagtagtctgcgatgtcgatgccatcgccgccgtcgagctggtcagcaccaccttgggcgatcaggcgatcgtttccaccgcctcccgttagtacattggcggtatcgttgcccgtcaagacgtcgtcaaaatgactgccggtgaggttttctatgtcaacgaggacgtcacccgctgcatccgagccgagatgcaggccggtcgtcagattgacggtcacgccgcttggggcatcggcatacgaagctgtgtcattgccattcccaccctctatccgatctgcgccgccacggccctgcagagtgtcgtcgccatcccacccccgcagtgtgtcgtcattggcagaaccatagagcgcatcgccatggctgctgccatggacgatctcgatcgaagtgaggcggtcgccttcggcgtctcccccctttccggtgccggccgcaagatcgatggtgacggctgcggcgcttcccgcatagctggcgagatcggtgccggccccgccttcgagcagatcggcgccgccgcggccgcggaggatgtcgtcgccatcccatccccgcagtgtgtcgccattggcagaaccatagagcgtatcgccatggctgctgccatggacgatctcgatcgaagtgaggcggtcgccttcggcgtctcctccccgtccggtgccggccgcgaggtcgatggtgacggccgcggcgcttccggcatagctggcgagatcggtgccggccccgccttcgagcagatcggcgccaccgcggccgcggagaatatcgtcaccatcctcgcctgaaagtgtgttgctgccggaatcaccgaggagggtgtcgtcgtacgaagatccggtaaggctctccaccgatataaaacgatctccgccggcgataccgccagcggagatgtcgacgaccacgcttccgttggcgtccgcataggtcacggtgtcgtgtccgtcgccgccatcaagcagatcggccccggggccgccgttcagaagatcgtcgccggcaagcccccgcaggatatcggccgtggtcgtgccgatcaggatatcgttgcccgtggtccccatgatcgtggccatgtctgctccatatgccggcgtgctgataggcagcatttgagatgaaacccgcggagcctaccatcgcgtatcgcctgcggcaatgtcgatgcacggtattcacgtggagcgattattcgatcaccgggtcggcgagtagattttccagccgcgcccggccttccggccgacatggccggcggcgaccttctgcttgagcaacgaggccgggcggaaccgctcgccataggcgtcgtgcatgatctcctgcgcctgcaggctgaggctgttggtcaccacatccatcagctcgaacggccccatcgggtgccccaggcccagccggcaggccttgtcgatgtcctccggggtggcgacaccttcctcgaccagcttcaccgcttcgatcaggaaggcgtgaagcacgcggttgaccgcgaagccgggtacgtccttgacccggatcggctccttgccggcctcccggcagaggtccatcacctgcgtgatcacctcgtcggtggtgtcgaagccggggatcacctcgaccagcttcatgcggtgcacgggcgagaagaaatgcgtgcccaggaaccgggtctgccgcccggccgagaccgccgaggcgagcgtcgagatcgggatggtcgaggtgttgctggcgatgatcgcctccgctcccagaatgccgtcgaggcggcggaacaccgcctgcttgatctcctgatcctcgaacaccgcctccacgaccagctcgcgatcggcgaaggcctcaaggctttccgccgcgcgaagatggccgagggcgcggcccttgtcggcctccgagaacagcccgcggccgatgccgcggtcgagcacgccctcgagccggccgatcgcggcccgggccgcctccacattctgatcggtcagcagcacgtcattgccggccagcgcgaagatcagggcgatctccgagcccatcatgccggcgccgacgacgccgatgcgggtggtcatggtggtgtttccttccgtggagcgtctttttatcggtcggttttctgcgccgccggcgcctcagaacgaggcgtcggcggtggcgagcagggtgtcgtccttcgattccaggatcccggcccagaccgcggttttgggcagttcccagacatagaagtaccgggcggccgcaaacttgccgtcgaggaaggcgcgttccgcgtcatggggggaagcggcggcaagccgggcggcggtggtcgcctggcgcagccagatccaggccagcacggtatggccgaactggtgcaggtaggccgtggcattggcgaggaacagctcgaccttgccttcggcccccatcggcaccagggtctcggtggtcttccgcaggcgtgcaaccgcctcctcgaaccggtcggccagccacagcacccgatcgtcacccgaggcgcgggcgtcggtgatcgcctgggcgtagcgcttgcccagggcctgcagggccgcaccgttcatcatcgtcaccttgcggcccagaaggtcgatcgcctggatgccgttggtgccttcatggatcgggttcagccgattgtcgcggtaatactgctcgacctggtactcccgggtgaagccatagccgccatggatctggatggcatggacattggcttccaggcagtaatccgacggccaggccttggcgatcggggtcaggatgtcgagcagcagctgcgcctcggcgcgggcggcctcggtctcgccggtttcctgttcgtcgaccagccgggcgcagctgagggtgagcgccagcccgccttcgacggcggccttctgggccagcagcatgcgcttcacatcggcatggttgacgatcggcacctgcgggctggcgggatccttgtcggtgggcagtcgtccctgcgggcggttgcgggcataatccagcgagtggagatagccggcatagcccagcatcaccgcgcagcggccgactccgatccgggcctcgttcatcatctggaacatgtagctgaggcccttgtggggctcgcccaccagatagccgaccgcaccgccgttctcgccgaaattcagcatggtggaggtggtgccgcgccagcccatcttgtggatcagcccgcccagcgccacgtcgttgcgcgcacccaggctgccgtcttcgttgaccagcaccttgggcacgatgaacagcgagatgcccttcacacccgccggcgcgccctcgatccgggccagcaccatgtggatgatgttctcggacagctcgtgatcaccggccgagatgaagatcttgttgccggtgatcctgtaggtgccgtcgtcctggggaacggcccgggtgcggacgtcggccaggcccgatccggcctggggctctgtcagcgccatggtaccgaagaagcgcccggccagcatcggccgcagatagcgttcgcgctgtacgtcggaaccgaagctcttgatcaggttcgaggcgccgatggtcaggaaggtgtaggaagcggtggcgacattggcgccgtcgaacagggcatagcaggcatgggcgacggtggtgggcagctgcatgccgccccattcctcttcctgtcctgccgccagcaacccggcctcgatgaactgatcgaccgcggccttcacctcggggatcatcaccacccggccgttctcgaagcgcggctcgttggtgtcgttcttgcgcagatgcggcaggtagtgatcggtcgcgatcttcatcgacaggtcgatcgccgcatcgaaggtgtcgcggctatggtcggcaaaacgcggccgggtggtcaggctttcgacgtcgagcatgtcgtagagcatgaagtcgaggtcgcgccggttgatgatcttcgagtccatgagcctcgatcctccctggagatcttggaaattcaggcccgcagtcgaggcgagggacatgcagaccaaatgttcggtcggtgcggatggccacgaaaaaggggacggcgccgcaagcggccgccgcccccttttgaggtccggttcctggggaatccggtcaggcggcgcgacggatcatcgccaccatgcggtcgagatggtgatcgtgatcgccgaactcgccctcgatcatggtcagccgcttgaagtagtggccggcggcatattcctcggtcatgccgatgccgccatgcagctggatcgcggcctggccgaccagacggcccgagcgcgaggtatgcgccttgcaggctgcggccgcacgggcgcgggcagtggcatcatcctcttcggccagggccatggcggcggcgtaggccagagaacggctctgctccatgtggttcatcatgtcgaccgcggcgtgctgcagcacctggaagttcgcgatcgccacaccgaactgctcgcgggtcttcagatagtcgaccgtcagcatgtgcagcgccttcatggcgccgaccgcctcggccgaaaccgccaccgcgccatggtcgagcaggtcggagagcagggcggccccgccgtcgacctcgcccagaaccgtctcggggccgacctggacgccttcgaaagtgacgtcggccgcccggccgccatcgacggtcatgtaggatttgagcgacacgcccgcggccccggcatcgaccaggaacagggtgatgccctgggcatcacgctcgccacccgcggtgcgggcgctgacgatcagcttgtcggcatgctgggcgttgcgcaccaccgccttgacgcccgagagggtgaagccctcgcccgaacgctcggcgcgggtggtgacccgggtgcgggcatagcggccacgcggctcgtaatgggcgaagccgaatttgagcgcgccttccgcgacctggccgagcaaggcatcgcgcacgtcgcccttggcgccggccgtcagggcgcgcacgcccaacaccgccgtcggcatgaagggctcgagcaccaggcccgcgcccagcttttccaggatgagggccgcatcgaccatgctgccgccgatgccgccctggtcttcaggcaccatcaccgccagcaggcccatttcggcgagcgtgccccagttcttcgccgagatgccgtcctcgctctcggccagcttgcggcgcgcgtcgaaggggtattcattgcgcacgaagcgctcgacgctctcgaccaggagctgctgttcgtcgctgagtgagaagtccatgaaactcggatccttgtcccggtcgtgcgtcagaggcccaggaaggccttggcgatgatgttcttctggatctcgttcgagccgccgtagatcgagctcttgcgccagttgaggtagtagggcgcggccagattggcctcgaggctcgagatcggctcgccgttccagccgggatgctggctctcgggcagatagggctgcgcgtaggggccgacggcttcgagcagcagctcggtgatcgcctgctggatctcggtgcccttgatcttgagcagcgaggattcagggcccggacggccgctcttcgaggtggtgatcatgcgcatgacggtcgcatccagcgccatcagctcgatctcgaccgcggccagccgctccatgaagcgggcattctcgatcagcgggcggccttcgtcgtccacttccttcgcggccagcgccttcagcttgcgcagctggtggcgcgagcggccgacgccggcaatgccggtgcgctcgtggctcagcaggaatttggcataggtccagcccttgccttcctcgccgaccaggttctcgaccgggacgcggacgtcttcgaagaagacctggttgacctcgtggccgccatcgatggtgatgatcggggtgaccgagatgcccggggtcttcatgtcgatcagcaggaaggagatgccctcctgcttcttgaccgagctgtcggtgcgcaccaggcagaagatccagtcggcatactggccgagcgtggtccagatcttcgagccgttgacgacatattcgtcgccgtcacgcaccgcgcgggtcttgagcgaggcgaggtcggagcccgagcccggctccgagaagccctggcaccagaaatcttccgacgacaggatgcgcggcaggaaatggtccttctgggcctggttggcgaaggtgtagagcaccgggccgaccatgctgaaggcgaaggcgatcggcggcggcgcgccggcggcgttcatctcctgatcgaagatgtagcgcttgatcgggtcccagccggttccgccatattccttcggccaggccggggcgatccaacccttgttgtagaggatcttctgccagcggacgaaatcttccttcggcagatggatgctgcgctcgaagcgcgccttgatgtcctccggcaacgacgtccgcatgaactcgcggacctcctcgcggaacgcctgatcttcggcgctgagggtaagcttcatcgcgcccctgctccctgaaatctgcggggtccccggacccctggttcaggaccgtccccccctcaaggtcgatccgtctttgaaacatacgactgttttacgccgaggccagtgaaaaccgcgagatcgggacatttcgtcgatacgtcccattgcggcagaggggaaggcgtcacggcccggctgcagatcatggacgaccggccgccccgtaaaacgtggcggccggcctgccggatcaccggctgcgatcgtagtcggcgaaggacttgccttcggcgacgagcgtctcgatcagcttcgccggcttccagcgatcgtcgagatcggcatggaactgcttgatgtcagcgagaaccttgtccagaccgataagatcggcctggaacatcgggccgccgcgccaggccgggaagccatagccgaagcagtagatcacgtcgatatcgctcgcccggatcgccatgccctcttcaaggcatttggcgccttcattgatcagggcatagagcgagcgcttcaggatctcgtcttccgaaatctcgcggcgctcgacaccggcggccttcgaggcctcgacgatcagctgttcgatcttgggatcggtcaccggcgtgcggctgccgccctcatagaggtagtagccggccttggtcttctggccgaagcggcccatctcgcagatctggtccgacacggtcggccagaacaggtcgttgcggcgggtggccgcgcggcgcttgcggatccgccagctgacgtcgaggccggccatgtcgcccatggtgaacggccccatcgccaggccccagcgctgcagcacgccatcgacctgggcgggcagggcgccttcgaccagcatcagttcaccctgctggacatagggctccagcatgcggttgccgacgaagccgtcgcaattgccgaccagcaccggcaccttgccgatggtcttggccagcttcatcgaggtcgagatgacctgataggaggtcttggccccgcgcaccagctccagcagcggcatgacattggccgggctgaagaaatgggtgccgatgacgaattccggccgcgacgtggtggccgcgatctcgtcgatgtcgagcgtcgaggtgttcgaggcgagcaccgcccccggcttggccaccgcgtcgagggtcgagaagaccttcttcttgatgtccatctcctcgaagaccgcctcgatgatgatgtcggcgtccttgagagcgtcgtagtcgagcaccccttcgatcaggcccatgcgcttgtccatggcgtcctgggtcaggcggcccttggagacggtcgcggcatagttcgcgcggatgatgccgagcccgcgctccagcgcatcggcgctcatctccagcactttcaccgggatgccggcattggcgaagttcatcgcgatgccgccgcccatggtgccggcgccgatgatggcggcctggcggatcggcagggtcggggtgtcgcccggcacgtccgggatcttcagcgcctcgcgctcggcgaagaagatatggcgcagcgccttcgactggtcagacgccatcagcccgccgaagatctcgcgctcgttcttcagcccctcgtcgaagggcagggtgacggcgccggcgacggcgtcgaaacagcccaccggcgacatctggccgcgggcggccttgaccacctgcttgcggatctcgggcagtttcgcggcatcgaaggccttcaccttctcgtccatgtcgcgcacccggcgcagcggtgcgccgtcttcgaccagcttgcgggcgaaggcgacggcgcccgggatcagctcgtcgaccacggcgtcgatgatgccgagctggagcgccttgccggccggcacgaacttgccggtggtgatcatgtcgatggcggcttccacacccgccacgcgcggcaggcgctgggtgccgccggcaccgggcaggatgccgagcttcacctcgggcaggcccaccttgccctgggcgacggcgacgcgatagtggcagccgagcgccacttccaggccgccgccgagggcggtgccgtggatcgcggccacgaccggcttggtcgcattctcgtaggtcgagatcacgccattgagatcgggctcggccaggggcttgccgaattcgcggatgtcggcaccggcgatgaaggtgcggcccgcgccgaccagaaccagcgccttcgcctcgtcatcggccaggccttcggcgaggcagtcgagcagcccctgccggacatgctggctgagggcgttgaccggcggattgtcgaccgtgatgacgccgacatcgccctggcgttcgtagcggacactcgtgctcatgaaactggtcacctcgactgtcggatccggcatctgcccggggagggagcgctttgcgcggccggatgcgggttttggaccggacgacgcggccgccaccggaaggccggtgccggccgcgtcgtgaatgtgccgggccggtggcccgggcgtgtgtatcagacgacgcctcgcctcagacctccagccattccttgcgcacggcctcgtcttttgccagggcatccggcgtgccctcgtagacgatatggccatggcccatgacatagaggcgctgggagatgcgcagcgcgatcgtgagcttctgttcgaccagcagcacgctgacgccgcgccgggcgatttccgacagcagatcacccacctgttcggtgatcttgggcgcaagcccctcggtcggctcgtcgaccatgatcaggtcgggatcgccgagcagagtgcggcacatggtcagcatctgctgttcaccgcccgagagcacgccggccagcgtgtcggcacgttcctcaagtcttgggaacagcttgtacatgtcgtcgaccgaccagcggccctgcttgcgggtgctcttctggccgagcagcaggttctggcgcacggtcagggtgggaaagatcgaccggtcttccggcacataacccaacccctgatgggcgatctcgtgcggggtcatcccggcgatgttgcggccgcgatagttcaccgtgccctgcggcggcaccagccccatgatcgccttgatggtggtcgaccggccgacgccgttccggccgagaaggctgacgatctcgccctccttcacgtcgaagctcaccccttgcaggatgtggctcttgccgtaataggcgtgcaggtcgcggacgtcgagcatcgtggtcatgcggcttcctcgccgagataggcctgctgcacggcgcggttcttgcggatgtcctggggcgtgtcggtcgcgatcacctcgccatagaccagcaccgagatgcggtcggccaggccgaagaccacgcccatgtcgtgctccaccatgaccagggtcttgcccacggtcacctcgcggatcagctccaccgcctgttcggtctcggtattgctcatgccggcggtcggttcgtcgagcaggatgacatcggggtcgcccgcgatggtgagcccgatctccagcgcccgctgttcggcataagagaggaagccggcaagcacgttgcggcgggactggagatggatgcgctccaggatccgctcggcatcctcgttcagcttccgctgtttcgagaccatctgccagaacgagtatttgtagccgcgcgaccagagcagcgagcaacggatgttctcgaacacgctcatcttgggaaagatgttcgtgacctggaagctgcggctgagcccgcggcgattgatctgctgggcgggcaggccgctgatctcttcgccgttgagcttgatcgagcccgaggtgagcgggaagcggccgctgatcagatgaaacagggtcgacttgccggcgccgttggggccgatgacggcgtgacgatgaccctgctgcacctgcaggttcaggccgcggatgatctcggtcgggccgaagctcttgcggagatcggtgagttcgagtgcaagcttggacatcaggcccccccctgcttgatctcggcgaccacggcatcccaggcccggatgatccgccggatggccagacggaagagatagccgccgatcaccgttgcggccactgccagcgcccagggcaatgtctcgtgaaccgagacctcctgaccgaacagcaccatcgggatcgaggcgtcgtaggtggtcgacatgtagtagttcatctcgatcagggcgacgagacccgcccccatgatcaggaaggtgacgaggccgatggcatagggcaccaccagccgccccatccggcccgcctgccagaccggctgatgagccatgatcacaccggcgaagcccatgggtgcgaacatcaccatcaccacgaacagcagcccgaaatagagctgccaggtctcggtgaccgacgacaggctgagctgcaggatggtcaccagaatggcgccgatgatggggccggcgaaattgccgacaccaccgatgaaggtcatcagcagcaccgagcccgaggtgaccgcgctgacattctcggccgtcacgatttcgtagttgatcgcggtcaggccaccggcgatgccggcgaagaagctggcgagcacgtactgcacgaagcgcacgatgcgcgggtcgtagccgacgaagcgcacccgctcttcgttgtcgcgcacggcattcgccatgcggcccagaggtgtgcgggtcagcaggtacatgaccacggtggaaatcaggcaccagacggcaatcaggtagtagacctcgacctgggggccatagccgaagaacaggctggtgtcggtcacccggttgcccgagatgccgctctcgccgccgaactggtcagggaacatcgaggtgccggcatagaccagttcaccgatgccgagcgagatcatcgcgaaggtggtgccggcacgggcggtggaaatccagccgaagatcaccccgaagaccatggcgccaatgccgcccgccagcggcagcagctcaagcggcaggggaaagccgtcgggcgagatctcgttcagcacatgaatggcggcgaagccacccaggccgtagaacaccgcgtggccgaaggacagcatgcccccctggcccagcagcatgttgtaggagagcgcgaagatgatcgcgatgccgatctggctcagcatcgagcgcgagaagcccgaggtcatgaactggggggccgcgatcatcacgatgatggcgaagatccacagcccgtagcgggccaggaagccggggcccccggggcgggcgccgccgcgcatcgccgcggcggtggtcttgccggtgggaagggtgcggtcggtcatgattcgcgcgtccccatcaggcccttcgggcggaagatcagcatcagcaccagcatcagatagggcaggatcggtgcggtctgcgacacggtgatccgcgacagcgtgccgatgaagccatcgaccggcagggggatgccgatcgcggcgagcgtgccgcccagcgaccagtcgagtgccacggccagcgtctggatcacgccgatcagcagcgaggccacgaaggcaccaccaagcgagcccatgccgccgaacaccaccacgacgaagatgatggggccgagcaggaaggccatgccgggttcggtgaccagaatcgggccgccgatcacgccggcgagcgctgccagcgcggtgccgccgccgaacaccatcatgaacacccgcggcacgttgtggccaagcgctgccaccatgtccgggtgggtcagcgccgcctgaatgatcaggccgatgcgggtgcgggtgatggtgaggaacagggccacgaacatcatcaccgcgatcagcaggatgaaggcgcgataggccgggaaattcgagccgaagagcgtgaagaaggtgaagttcagatcggtcggcaccccgtaatcgaccgggatgcggccccagatcatcaccaccacctcttcgatcaggaaggcgagaccgaaggtgaacagcagctccgcgacatggccatatttgtggacgcgccgtaggccgtagcgttcgatcagcatgccgatgccaccgaccagcagcggggccaggatcagggcgatccagaagccggtgaccgtgctgatctgataggcgaaatacgcgcccagcatgaagaagctggcatgcgcgaaattgaggacacccatcatgctgaagatgagcgtgagcccgctcgacagcatgaacaacagcatgccgaacagcacgccgttgaggagggagaagacgaggatttccagcatctcgcccttcgtctttgcgaggtgtggcgcggccggcgtcggcctgcgcgtcgatggcgcgcggtcgggggccggtccgaggccgctgcgggatcgtgttgcggtcccgggagtcgcggtcccgggaaggggcatcccggcgtccggtgtcgggctgtttcccccggtcggctgtcaatccgccgggcggaggccggacggatggacagcggatgagggcgtcggcgggccggtggcatcaccaccggcccgccgggcgtcgtcagctcgggcgctgcatcttgcaggtggtcggcgtctcggtcgccggaccgtcgatcttcgcgtcagtcttccagccgaggccggtgtgctcggtgtcgtacttcacgcccttcgagaaggtcgagatgaagagcggctgggcgagctgatggtcatcggcgcgcatggtgacggggcccatggcggtctgataggtcatgccttccagcgccttggcgacggcgaccggctgatcgctcttggcctcgttcatggcttcctggagcatgccgagcatggtccggatgcggccatagtagaagtcgaggtcatacttctgcaggaagccgacataggcgtcctcaagaaccttgccctgttccgacggggtctccaccggcaggttcgcgtgccactcggtgacctgcttcaccttgccttcgccggccgggccgatcgcggtcggtgcacccaggccgccaccgtaataggtgtagtactggacgtcgagacccgccgcagcgctggccttgaccagcagcgccagatcggcgccccagttgccggtgatgacggtatcggcacccgaggccttgatcttcgagatgtagggcgagaagtccttcaccttgccgaccggatgcaggtcgtcaccaacgacctcgatgtccggccgcttctcgttcagcagcttgcgcgcaatcttcgacacggactggccgtgcgaataatccatattgatcaggtagacctttttgatctccggctgatccttgatgtagttcgtgatggcttccagcttcatgtcgctgttcgcgtcgaagcggaaatgccagaaattgcaggcgtcgttggtcagtgccggatcgacggccgcgtagttcagataaagcacccggttgtcggggttccgctcgttgtgcttggccacggcctcgctcagcgccgcgccgacatggctgccattaccctgggtgatgaaatgggcgccctggtcgatcgcgctcttcagcgccaccaggctgtccttcgggctcgacttgttgtcgatggcgatcagctcaagcttcttgccgttgaagccgccatgctcgttgaaatagtcgatgaagtacgagaagtgcttcgcaccggcgtcaccgacattcgcgaacggacccgagagcgggtcgatatacgcgatcttgatcgtgtcgtcggcgtaagcagcaccagccatgccgaatgcggccacagcaagcgcaatcgcgctggtcatggcggtcagagtggtcttgggcgtcaacgcagcctcccttggcatcctacgtcgttgcgtagcggcacatctgccggcgcggacacgggcgccctcccgggggcgcgcgccgccatcggcggtgcctgttcctgacggatgcccgtccctggcggaccggcatccggaccggcctttacccggccggtatgttgttggtggtgcggcctctcggagccttgcaccacagttgtttataacctaatcgatcccgggcttcaaaaacagcgaaatatcatttcgcagtgcagaattcagagcaaactctttgaaaatccatgagggtggtcatataattccaggtggatgaacagtatttaaaatccaccaaaaggcgcaaccaaagaggagaccttaaactcatgcgcgttatcagcggagcggaagagctgaagtctgccgtcggatccgagttgggggtcagcgactggattcttgtcgatcaggatcggatcaacaagtttgccgaggcgaccggtgatttccagtggattcatctggatgtcgagcgtgccgcccgtgaaaccccgtggaaatccaccatcgcccatggctatctgaccctgtctctggttccgatgatcatggccggtatctggaagatcgaaggcgttgcctcctcgatcaattacggctccaacaaggtccgcttcacggcgccggttccggcaggcagccgcgtgcgcggccggggcgtcctgaaggcggtggacgagcaggggcccggctcgctgcgcctgacggtcgagatcacggtggagcgggaaggccaggagcggccggtctgcgtcgccgagaccctgtcgatcgtgaacttcgcctgatccgccacccccggtccgcaaaggcgggccgggggtgtttcatgccggtcaggccgtgggcagtgcgtagtcgcggaaggcctggcgaagctgtgccttcagcaccttaccggtgccgctatggggcagttcgtcgaccagcaccatgtcgtcgggcagccagagcttcgccacgcggctcgacaaccaggacaggatttcgtccttggtgggggtctcacccggcttcggcaccacgatcagcagcggccgttcgtcccatttcggatgggtgacgccgatcaccgcggcctccgcaaccttgggatggcccatcaccgcattttcgaggtcgatggagctgatccactcgccacccgatttgatcacgtccttcgcccggtcgacgatgcgcatatagccgtcggggtcgatggtggccacatcgccggtgcggaaccagccgtcatcgtcgaaggccgcggcattggcctcggcattctcgtaatagccgctggtgatccagggcccggcgaccagcagctcgccgaaagccttgccgtcatggggcaggcggttgcccatcggatcgacgatcttcatgtcgaccatgcagatcatccggccctgcgaggtcttgagcagccagcgttcgtcggccggcttcccttcgtccgccagtttcagcgtgccgaccgtgccgatcgggctcatctcggtcatgccccaggcatgggccaccggcacgccgaactcttcctcgaaggtccggatcatggcgagcggtgcggccgagccgccgatgatcagctgcttcagcatgtcgagccgcttgcccgactggcggagataattgatcaggttcagccagaccgtcggcacgcctgcggtgatcgtgaccttctcggcctcgaacatctcgtgcaggccttcgccgtccagccgcggcccgggcatcaccagtttggcgccgaacatggcgcaggcataggggatgccccaggcgttcacatggaacagcggcaccaccggcagcacgcattcgcggcccgagatgccgacgccttcggccgcacccgctgccatggcatggagcacggtggagcgatggctgtacatcacgcccttgggcttgccggtcgtgcccgaggtgtagcagagcgacgacgccgtgcgctcgtccagctccggccagtcatagctttggggctggccctcgatcagctcttcatagcagagcgtctcgaagccggccggcgcctcgggcatatgcgcccggtcggtcatcaccaccacggcctgcagcctgggcaactggccggcaagccgggccaccagcggcacgaaggtcgggtcgacgaacaggaccttgtcctcggcatggttgaggatataggccatctggtcggcggcgaggcgcgggttgatggtgtggcagaccgcccccatccccgaaatcgcgaaatacagctcgaaatgccggtggttgttccaggccagcgtcgcgacgcggtcgccgggtgtcacccccagcgaaaccagggcgtgggccagcttctgcacccgggcataggcgtcgccatagccgtagcggtggatggtgccttcgcagttgcgcgacacgatctcggtcgtggcgtggcaacgggctgcgtattgcagcaacgcaatgatggacagcggcctgtccatcatctgccccagaagcggcagaggacgggacatgatacggatattcctccctagcagcagcacggccggcaccgcttcgcacacccccggcgtgcggtaccgtttatcgttgagtgccggctcttgagcggccggtcgccgttatcgtggctggtcttgcgcgacaggtcaaacgtttgtctcacccctttttgcccgtttcgcacaaatgccaccaaacggtgcgatcgcgtgccggcacgccaccgacggcagcaggttcagcgatcgatcagcccctgggcgagtgtggcgagcggcgcgcgatccccggcccagctgcgatccacgccgagcggggttaccgacacatggcgatcgcgcagcgcctggatgtcgcagtcttccgtccggtccaggccggcccggtcgaagcgcagccagagatcggtgtcgccatggtggtcgacggtggactcgatccggatgccgccgatcatgccgcggccctgacgggtcagccgggcgccgcgaacctcgtcggcggcgcagtcggggaagttgaggctgagcgtgacatccccgggccacccggcctcgatcaggcggcggagcatggcgggcgcaagcgtccgcggcgtgtcccagggaatgaaggccgggtcgcggaaggtctggctgagggcgatggccggaatgcccatcagctgtgccgtggtcgccgcccccaccgttcccgaataaatcacctcttccgccagattggcgccgcgattgatgcccgagagcaccagatcgggcttcgcctcgggcatcagataggacagggccaccgccacacaatcggccggggtgccgtcgaccttgtagcgtcggggtcccagctcgtgcacccgcagcggccgtcggatggtgagcgccgtggacccgccgctgctgtcgcggctgggagccacgacccacacctcgggcgccagctcgcgcgcgatctgctcaagcaccgccaggccctcgccgtcgatgccgtcgtcattggtcagcaggatgcgggcaggcatccggcgcggggcggcggtcgcagaggtcatcggtggcggcatcctcgggtagatcgagacgtgtggagatgatgtctcgttcaaacgaacgtttgacgtaggcgatgaaaccggaaacactgcccgagatcaagcgggaaggggccgcggcgagaccggtcccacccgtcatgtctttcagtggaggaggccccggacatgggcggacggcttgcggagaaggtggttctgatcacgggggccgctggcggcctgggccgggcgatggcccatctgttcgcggccgaaggggcccggctgatcctgaccgatatgggggccgaccggcttgacgcgctgaaggcggatctggcgcgcgatggccacgaccgggtgatggtgatggagcaggacgtcaccgacgaagcccgctgggaagaagtggtcgatgccggtgtcgccgaattcggccggctggacgtgctgatcaacaatgccggcatcggctatatggccgatctggaagagaccacgcttgccgagtggaagcgcgtccatgcggtgaattcggaaggccccttcctcggcacccgcaaggcgatcaaggtgatgaagggcacgggtggcggctcgatcgtcaacatctcgtcgatcgccggcctgatcggtgcggtgaacctggccgcctattgctccagcaagggggcggtgcgcctgttcaccaaggcggcggcattgcattgtgcccggcgcggctacaacatccgggtgaactccgtccacccgtccttcaccgagaccccgatggtgcgcgacatgatcaccgccgcgcgcaacccggacaagatggaggcggcgctctccaccgcggcaccgatggggcgcatgggccggccggaagaggtcgcctatgccgcactctatctcgccagcgacgagagcagcttcgtgaccggcaccgagcttgcggtcgacggcggcaacaccgccgcctgatcgcggtctttcgcagccaatccagccggcccgcccgagaggccggaccatgacagtccccgagggaggttcctgacccatgaccaatccgatgttcgacctgaccggcaaggtcgcggtcatcaccggctccacccgcggcatcggcaagtcgatcgccgagcagatggcggccgccggtgcgaaggttgtgatttccagccgcaagcccgagccctgcgccgaggtgcgtgcggaactcgtggccaagggcgccgaggcgatcgacgttccctgcaacatcagcagcaaggatgattgcgagaacctgatcgccgagacccgcaaggcgttcggtcgggtcgacatcctggtcggcaacgccgccagcaacccctattacggcccggcggcggagatgcctgacgaagccttcgtcaagatcatgtcgaacaacgtgctctccaatctctggctctgcaatcaggtggtgcccgagatgaaggagcgtcgcgacggcgccatcgtgctgatctcgtcgatcgccgccatccgcggcacgccggtgctgggcgcctatgccgcgtcgaaggccgccgaggcgcagatggtgcgcaacctcgcgatcgaatacgggccgcacaacatccgcatcaacgccatagccccgggcctgatcaagaccgatttcgcccgcgcgctctgggagaaccccaagatgcgcgagaaggtcgagaagtcggccccgctgcaccggatcggcgaacccgaggatatcggcggtgccgccgtgttcctggcatcgaacgccgcccgcttcatcaccggccagctgctggtgatcgacggcggtgtcaccgtcggcgacacgctctgagcgggcggacccatccgggaccggcccatccgatacgagcccggccgatacgagcccggccggaacattgaagcggaggggcgggcggtgacgccggcccttccgtttcgtcatgtccggccgcggctgtctgcatccaccactgaacctccggagatcctgcgccacatgtccggccccaatctcgttccggtccgcgaggctcatcgcctcgacgaggcggcgctttcggcctatctggccgaccgtctgcccgatttcgaccccgccgacctcgagatcctgcagttcgagggcgggcagtcgaacccgacctatatgctgaagagcgcggggcgccgctatgtgctgcgcaagaagcccccgggcaagctgctgccctcggcgcatatggtggagcgggaataccgcttcatcgccgggctcgccgacaccgatgtcccggtcgcgccggcgcggctgctctgcgaggatgcagacatcatcggcacggccttctatgtcatggactatgtcgaaggccgggtgctgaccgatccgaccctgcccgggcttggctccgacgaacgtcgtgccacctatgacgaactcaaccgggtgatggcggcgctgcacagcgtagacttcacggcggcgggtctggccgatatgggcaaggccaccgactacatggcccgtcagatcggccgctggtcgaagcagtacgaggccaccaagacccacgagatcccggcgatggatcagctgatcgcctggctgcccgccaatattccggccgatgacagcgtgtcgatcgcccatggcgactatcgcatcgccaatgtgatctaccacccgaccgagccgaagatcctggcggtgctggactgggaactggcgacgatcggccatccgctggccgattttgcctacaacgccatgttctacagcctgccggccggcgacgagggcttcccgggccttggtgggatcgatctcggctcgatcggcgtgccgaccgaagacgagtatgtcgccgcctattgccgccgcaccggccgtgacggcatcgacaactggccgttctacaaggctttcgccatgttccgcctggccgccattcttcagggcgtctaccaccgcggcatcaccggcaatgccagttccgagcgtgccaaggtcgtgggtgcccgcgcctcgctgctcgccgaactgggctggcagcaggtgtcgtaaccgaaccggctgtcgctgacggcaaaacggccgcccggaagctccgggcggccgtttttcgtgaggtgaccggcttgtcgcgacgtgctcaggccggcttgggcatgccggcgatgtagccgacgccgccggcacggcggttgcggtagttggcgtcgatcagcggggcgacctcggccttcaccttgtcgtgcagccccttgccccagtcgcccgggtgctggaagttgctcatgatgtaggcgaagccgttgacgtcgtcgaccgcctgcaggccggtcgactcggcgccggccgggcaggacagcagccgcgacaggcggccggtatcgacctcataggcccagaggaagttgttgacgtggttgccgctgtcctcgccgatgaacagcgtgcgcagccgctccgagaacttcacgttgtcgggattggcgaccaggtcgacatcggcggtattgccggtggcgtcgggttccgccagatcgcggccgaccagggccgggacggccgagaaatgcaccggcacccagtcgctgtcgatggcgttgccggcggcatccttgcggccgccttccatcggcagctgatagaccgcaccggcatcgatcttgtcgaccttgatgccgctcttgccgtcgctcatcgacttgtagatgtaggacacggccatataggcggtcttgtccttggcgttgacggtcacgccttccagcttgctcagcgccagcgtggccccctgcagcggcgcccagcgatgggtttcgaggaaggccgccgccttctccatgcccggcttgaagcgcacccactgggccttgccgttgaagccgatctgggtgaacgaggcgtctttcggatcctctttcaccacctcgacgatgtcggcggcggtcagcgtgtcggcgagcttgcggatctcgtcgctggtcgcatggccgagcttcacccaggtcagatcgaacgaaccgcccttgtcgatgtcgacgcccgcgcgctgcgccagcttcgccgcataaagcgtgccggccgacagatcggcgggcttgtcggcgatgaacatgaacaggccgccattggtggcgtcgtcacccatcagcacggtgcgctggtcaggcatcacctgcaccagctcgtgcgagatgcggcccatgcaatagtgcttggtgatggtgccggtgccgtcggcattcaccttcacctcgggcagatggccgtagtgataggggttggccttatccggatcgccgaacaggttctggctgaaggcgcggaactgctcgtcggtcctggcgaagggcgcgtcgggctcgtactcttcgctcgacagatgggtgttccagggcgacaggctggcgccgcaggtgatccacaggccgtgcacccggctggtgtcgacattgtggtactgcaccagcttcagcgcgccggtcgccggatcctggtccagcgtcagcaccgcgatgggcgagggcaggcggccatacatgtccttatcggcggcatcgcgggtggtgtattcgaactgcaccaccgcgaacacggtgttgcccttcacgcccgcgaccttcgcgtccatcggcatcagcatgttgcagccgtccgggcagtcggagaagaactgcaccggcttctcgcccgaggcgtccatgatcggcttgccgttgatgtcgacatagccgccggccagcaccttgccgcccttgccgtcgggcaggtcgtcgccggtgatgaacagcggctcgtagcccagcgcgaaattctgcgtcttgccgtcggcataggtcaccaccatcgacgagccgaccgtggtggtggcctgtgccgccgcggtggcaggcgccgacatggcgacgaactccaccgacctgggcgccgcggcggcgccaccggtcgcggcgaaagcggtgcggccgaaggcggtcgccgtcgagccggcggcaagccccgccacgggcagaagcggcatgcccgccagcaggcggagaaccgtgcggcgcgaagcctcgggcagagtggacatggaacagatctccgaacatccaggacagggtcggtcgtgcggccggccgggcgcagatgctagtcctggtatgttacggttctggtgctatgcgtgaggtggatggatgacggcggtcgatgcaggtcacgccgcccggctctgccacccgccacgctcttccatcaccacatccatccggcctccgccggccgtctctgccgcgaaggccgacagccgctcggtcaggcgtggtgtgttctccgcaccggcatgttcggtgaagatcagcttcaggacccgttcggcgagcggatcgatgttgctctcaccccgttcccatcgaccgacggtctgcttgtcgcggccaagcagccgggccagctcttcctgtgaccagccgagctcgaccctcagaaacctgagctcggcaccgctcagcccgcctggcctgcgaaccagggcaagaccgatcgcccgatgcaggcggtcgatgtcgtggatggcgagcgtctcgccatagggtgtctcgcgcagggtgtagccgttggcgagatagacgttatccagcccgcattcggtgtaggggtagagggtgtcggtcacggctgcctccatcgtgattgagatatcattatgatacttttcacaagaggcaagagcgagggggcagtggggccgcgacacacgaaaaccccccgtccgcagccggacggggggttccgaaggcagtccggcctcgctcgcggtgcaggcggggccggtggtctgatcaaggatcagccgagcgcgtgcttggccagctcgagcttggcgatggtctcctgatggacctcgtccgggccgtcggccaggcgcagcgtgcgggcgccggcataggccttcgccaggaagaagtcctggcagacgccgccgccgccatggacctggatcgcgcggtcgatcacgcgggtcgccatgttcggcgccacgaccttgatggccgcgatttcggacttggcgttcttgttgccgaccgtgtccatcatccaggccgccttcagggtcagcaggcgggcctgatcgatttccatgcgcgactgggcgatgtagtggcgggtcatgccatgctcggccagcgtcttaccgaaggcggtgcgctgctgggcgcgcttgcacatcgactcgagcgcacgctcggcaaggccgatcaggcgcatgcagtgatggatgcggcccggcccaaggcggccctgagcgatctcgaagccgcggccctcacccagaaggatgttttcgaccggtacacggacattctcgaacagaacctcggcatggccgtggggcgcgtcgtcatagccgaacaccttcagcggacgcagaaccgtcacgcccggggtgtccatcggcaccaggaccatcgactgctggctgtggcgcggcccgtcgaagcgggtcttgcccatgaagatcaggatcttgcagcgcggatccggcgcgccgctggtccaccacttgcggccgttgatgacgtagtcgtcaccgtcgcgctcgatccggctctcgatattggtcgcgtccgacgaggcgaccatcggctcggtcatggcgaaggccgagcggatcttgccgtccagcagcggctccagccactggcgcttgtgctcttcggtgccgtagcgctccagcacttccatgttgccggtgtcgggggcgttgcagttgaacacctccggcgcgatctcggaacggcccatcacctcgcacagcggcgcgtagtcgaggttgttgaggccggcaccgcgctcgctgtgcggcaggaacaggttccagaggccggcagcgcgggccttggccttcagttcctcgatgatcgggggcgtgacccagcggtcgggcgacgcccggtgctgttcttcaaagacggcctccgccggatagacgtaggcgtccatgaactcgatcagccgttcgcggatttcctgcgcccgcggactgatgccgaactccatgggggcttcctcctgatctggccggaccttcggggcccggctggcttgccaacacttgtatcaaacaaacgttttatctaggctgtgatagcacagggcttggggcgttgtcgatggagaaaccgcaagagaggtgagggccggggaggcgacgcaggcagcgggcggtgatggcgggctggatcgccccgctgtccggacatgcatgttttacattgtcgcgccgtcacgcctgtgtcatcgatattcgaacgaacgttgatttaaaacgtcgcctgaaacgaatggccatggagcgcccgcatgtgatgcccccgcattgcatcgctggtccggccgccgcaacgggcgaacagcatcggatgggaacgcatcgatggcgggcaccgacaccaaggagaggattctggacgcggccgagcgtctgttcgccgagcacacctatgccggtgtgtcgctccgcaccatcacggccgaagcgaacgtcaatctggcggcggtgaactatcatttcggatcgaaggatgcgctgctgcaggcggtgtttcaccgtcgggcgcgcgacctcaaccgcgagcgcgtggcgctgctggccgagatcgaggccaagtccggcgaccggccgctgccgctggaagaggtgctctacgcccttctggcgccgccgatgcgctggatgtcggatcccgggcgcgggctgtcggttttcgtgcagtttctggcccgctgccgcgccgacggcacgcccgaaatgaaggcgctgctggaccgcgacgtgcgccacctgcaccgcttcgtgccggccctgcagcgggcgctgccggacctggcggccgaggagatctattggcggctgcatttctcgctgggcatgatgcactacaccatcaccgatctcagccgcctggaggcgatttcgcagggcgtctgcgatctggaggattacgacgcgctgatccggcggatggtggcctttgccgcggcgggcttccgcaatgcgccgccgctgcaccagatacccgtcttcacccttggccagaacgccccggcggcgtcgccgcgcgcgcaggcggaagaggatgaggcggtagaggcggcgtcctgacgggcgctcaagactgaaacggatacggatcgaaaccggtcgaacggaggaaagacgtgatcaaggcggttctgtgcacgaagctgggtggccctgaggatcttgagatcaaggagattcaggcgcccgagatgaagcccggccatgtgcgggtgcgggtgcgggcggcgggtgtgaacttcgccgacacgctgatcatccagggcaagtaccaggtgcggcccgaactgcccttctcgcccggcatcgaactggcgggcgaggtgatggaagtggcggccgacgtgacccatctgaagcccgggcagcgggtgatgggcatggcgcagagcggtgcctacacccaggaagtcgtgctgccggcgaccgccgtcgtgccgatcccggacatgatggatttcgcaagcgccgccgccttcccggtcgcctatggcacctcgcatgtggcgcttgaccatcgggcgcatctgaaggcgggtgagaagcttctggtgctgggggctgccggtggcgtcggcctgacggcggtggagatcggcgccgccatgggtgccgaggtggtcgcggtggcgagcagccccgagaagctggaagtcgcccgcgcccatggcgccacccatctgatcgactattcgaaggatgatctgcgcgaaaaggtgaaggagctggtcggcggcgtcgacgtggtctacgacccggtcggtggtgccgccttcgatgcttcgctccgctgcatcaactgggaaggccgtatcctggtcatcggcttcgccagcggcaccatcccgcagatccccgccaacctgctgctggtcaagaacgtgtcggtcgtcggcaccttctggggcgcctatatgcacaaggatcccaaggtgctgggcgacagcctgaagaccctgctcggctggtatgccgaaggcaagctcaagccgcatgtctccgagaccttcccgatggtcgaagcgcccaaggcgctcagggccctgatggagcggcgctcgaccggcaaggtcgtcatcgacctcaactgatccgggaaccctcgccagagctgcatccggaagcatggccggtcgtggattatggtctgcggccggtttcatttagctaaaatacgatgcatatgcgaattgcgacgcattttcgtgcccgtcgtggcgatttgcctgccgatcctaacaaatgattaacttctcccctgcgataacttccgaccggggggagtttcgggatattgaacagtgggcatggcgggtccgggctggcagtgagagacccgctcacgggacatcttgggaagagggacaccgatatggcggctgcggcgcgtgggctgcgcatcgttcataaaattcccggtgccatcgtggctgcggtcgcgatcacatccatcgtactcggcgtcgtcgcctatctggtgtcgtcgcgcgagctggtggaggcatcggaaaccaagctggaagcgatcaccgagggccgcaaggcccgtctgaacgactatctggaacgggtgcggtccgatgtggcggtgctggccgacaattcggtgctgcgccagaccctgatcgacttcacctacgccttcgagctgatctcgcttatggacgataagcccgatcagatccttcagaagtcgtatatcaccgacaatcccgaaaccgaccgggcggtgctgaacaaggccggtgacggcaccttcttcagcgacagtcacgagcgctatcatccctggctgcgggcagcctcacgatccaagggctatgccgatctctatctcgtcgacaagaacggctgggtggtctactcggtcgagaagaacacggattttgcggtcaagctcgacgagagcgatgtcggccagaccggtctcggccgcgccgtcgccgccgcgcaggcggccaccgaaccgggccaggtgtcgctgatcgacttcacctatcacccccaggccaacaacgaagtcagcgccttcctggcggtgccggtcttcggtgacggcggctatgtcggtgccgtggtcgtgcgtctgtcggtcaacggcgtcgacaacgtcatgcagagcgcccagggtctgggcgagaccggcgagacctatctggtcggctccgacggctatatgcggtccaactcgcggctgtcggccgatacaaccgtgctggagcggcaggtcaataccgacgccgttgcggcggctcttgccggaaagagtggctcggtacgggatgtcgggcccggtggctatgccgtgctgagcgcctatcagccgctcgaattcctggggcagcgctgggcggtgatcgccgacgtcgccgaggacgagatcctggcgccggtcgtcgacatgcgtaacatgatcgctgcggtggccgtcggcctgatcgtgatcgtcggctccatcggcatgttggtcgcccgcggcgttacccgcccgctcggccggatgaccggagcgatgaaggaactctcgaacggcaacctctcgatcgacattcccgatcgcgaccgcagcgacgagatcggcgaaatggccgcctcggtgcaggtcttcaaggacgccatggtcgaaagccagcgccttgccgaggctcagcggcttgatcaggaagagaagtcgaagcgcgccgaggaactggtgcgcctcacccgcggtttcgacgaccgggtcagcggcgtgctgcgcggggtgacggcggccgcgaccgagctggatgccaccgcccgctcgatgtcgtctaccgccgatggcgcccgccatcagtcggacgaggtggcccatgccaccgcccaggcgaccgagaacgtgcagacggtggcagctgccgctgaagagctgtcgcattcgatctccgagatcggccggcaggtccacaagtcctcgaccatcgccggccgcgcggtcgacgaggccgagcgcaccaaccagaccgtctatggcctggcggccgcggccgagaagatcggcgacgtggtgcggctgatcaccgacattgccgagcagaccaaccttctggcgctcaacgccaccatcgaggcggcccgggcgggcgaagccggcaagggcttcgcggtcgtggcctccgaggtcaagagcctcgccaaccagacggcgcgggcgaccgaggaaatctcgacccagatcgcggcggtgcgcggcgagaccaaccaggcgatcggcgcgatcgagggtatccgcaagatcatcgtcgagatcaacgacatcgccacctcgatcgccagcgcggtcgaacagcagagtgccgcgactcaggagatcgcctcgaacgttcaggcggccgcccgcggtaccgagcaggtcagccgcagcgtcgacgacatgcgcgatgccgcccaggccaccggcagcgcctcgcagcagatcctgtcctcggccggcgaactcgcccgccaggccaccgatctggacagcgaagtccgcagcttccttgaagcggtgcgcgccggctgagccggtttaccgcacgcctgacggcgaagacgccccggacgggaaaccgtccggggcgtcttcatgcggagatggtgttctcgccgccctgaattggggatgccggggggcatggccggtgctagtctccaggcttcgccgacccatcccgaaaggtcccgatgctccgccgcctctacgaccggaccatggcgcttgccggccatcgtcacgccgaacgtgccctcggtgtcgtcagcttcgccgaaagctcgttcttcccgatcccgccggacgtgatcctcgcccccatggtgctggcccagcgctccaaggcctggcggttcgcgctcatctgcaccctcacctcggtggcgggggcggtgctgggctatctgatcggctatctgctgtttgaaagcgtcggccaggcgatcctcgatatctatggtctgcgcgaggacttcgccgccgccgccgcacgctataacgagctgggctgggtgatggtcctgctggccggcatcacgccgatcccgttcaaggtgatcaccatcaccagcggcgtcacggccatgaatgtcgtcagcttcattctgtcggcgatcgtggcgcgcggtatccggttctatgcggtgaccgcgatcatctactggttcgggcccaagacccttgccatcgtcgagaagcggctcggcctgttcacggttctgttctgcgtcctgctggtcggtggtttcgtgctgatgcgctacatcctctgaccgaccgatccatccgtatcccgacatgacacgggccccgcgggaaaccgcagggcccgtttccgttcatggaggcatctgatcaggctgcggcagtgctgcgtgcagcacccagtgccgcccagacgcgggccggggttgccggcatgtcgatctcgcccgcgccctcggcgatcagggcgtcgttgatcgcgttcatgatcgccgggcaggcgccgatggtgccggcctcgccgcatcccttggagccgaggccgctcgacgccgtcggcagatcctcgtagagccggatgtcgaggaagatcatgtcctcggcgcggggcatgccgtaatccatgaagctgccggtgagcagctgtccgctgtcctcgtcatagacggcatgttccatcagcgcctggcccagcccctgggcgacgccgccctgcacctggcccatcacgatcatcgggttgaccaccttgccgaaatcgtcggcgaccacatagcgcaccggttccacccggccggtctcggggtcgatttcgacctcggcgacatggcagccattggggaaggtgggggcggggcggtcgaaggtccggctttcgtcgagcggcgcgccggcatccagcgcgatctgcgccaccgcctccatatccatcccgagatcggtgcccgcaaccgtgaagcggccgtcttcgaacaccagatcctccgccgcggcctcgagcttttcggccgcgatcgaccgtgcccgttccaccaccgcctcggacgccagacggatcgccgagcccgccatctgcagcgagcgggagccgccggtgccgccgccggtcttcacccgggcggtatcgcccatcaccacctgcaccttttcgaagggcatgcccagcagttcggccgccacctgggcgaaagatgtctcgtggccctggccgttggactgggtcccgaccagcacggtggcgctgccatcggcttcgaagcggatccgcacctcttccttggggttgccctgggtccattcgatatagctggccatgccgatgccgcgcaggcggcctttggccgccgactgccggcggcgctcggcgaagccggccatgtcggccgcttccagcgcgcgggattgcatcagggcaaagtcgccgcagtcataggtggtgcccatggcgttggtatagggcatcgcggtcgcagggatatagttgatccggcgcagttccgccggactgcggccggtggcacgggcggcggtgtcgatcagccgctcgatcaggtaattcgcctcgggccggccggcgccgcgataggcatcgaccggggcggtgttggtgaagacgcccttcacatgcagggccgccacggggatcgcatagaccgtggtggcaaggccggctgcggccgaggtcgggatcatcgcgccgaactgcgaagcataggcacccagattggcgacggtcgagacctcgaaggcggtgaagcggccatcggcatccagccccagtcgggcatgggtgcgcagatcgcggccgtgggcgtcggtcagcaggctttccgagcggtcgccggtccacttcaccggccggcgcagcttgcgggcggcatagatcacggcgacatgttcggggtagaggaagatcttcatgccgaagccgccgccgacatccggcatcaccacccggaattcgtctgccggcaccttgaacacggcatcggccaggatgccgcgcagcccatgcacgccctggccattggtatagaccacggtctggccggtttcggcatcgatggtcgcgttcaccgcccgcggttccagcggattggccgatacccggttgttgacgatgtcgatctcgaccacctggtgcgcggccgccatcgccgtctccacctcggccgccttgccctggcgccagtcgaaacagaggttcgagggggtgccgtcatgcacgaccaccgcatcctcttccactgccttcagcggatcgaccacggccgggcgctcgtcataatccaccaccaccagctcggcggcatcgcgggcggcgaccggatcggtcgcgaccaccatcgccaccgcttcgcctgcaaaatgcacggcatcggcggcaagcgccggacgcttcggcgcctgcatgccgctgccgtcggcattcttcacccgcgcgaccgccggcacgccgccgacgccgtcggcatccagatcggcgccggtgaagacggcgaccacgccctcggcggccgccgcatcggcggtatcgaccgccaggatgcgggccgcggcatgggggctgcgcacgaaggccacatgcagctggccttcgaaggaaatgtcgtcggtatagcggccatggccggtcagaaagcgccggtcctcgacgcgacgcacggcctggccgattccgaatttcagcatggggcgatcttccctgacgtatctgtccggcgggtcacttcggaacggtagccgatcccggcgcggcggcgcaatgctgccggtggcagggtccacgccgcggaaccagaggcggggttttcaggcatcggcgggcgattcaggcatcagcgggagatcatgatgatttcatgacgcccgcggcccggattgccagggcgccaggtcgaacgatatcgtccccgcgaaagatagcggcgcgggggcgaggcatgggcacaggcagcgacggcagtgcgggcgaggtcttccgggccttcctgaagctgggcctgacggcttttggcggccccgtggcgcatctggggtttttccgcaccgaattcgtcgcccgccgcggctggctggacgacgaggcctatgcgcggatcgtggcgctctgccagttcctgccggggcctgcaagcagccaggtcggcatcgctctcggcttcggccgtgccggctgggcgggggccgccgccgcctgggccggctttaccctgccctccgccttgctgatgatcctggccgggcttgccatcggtgccggtgccgaggcgggccggctgcccgagggactgaccaccgggcttaagatcgcggcgctggccgtggtggttcaggcggtggccggcatggcgggcagtctggcgcccgatcgcgcccggcgaagcgtggccgccgtcgcggccgtggtcgccctgaccctgcccgggctggccgggcagctcggcgccatcctgatcgggcttctggccgttccgcttctggatccgccggcgacacccgccgccgcggctcccgccggccggcgccccctgaagcgggccggggcagcagccctgctcatcttcctggccgggctgatcctgctgccgctctgggcggccacgggcgatgccaccggccggctggtcgacggcatgtatcgggccggcagtctggtcttcggcggtggccatgtggttctgccgctgctggccgcggaaaccggcggccatgtcgatggccaggccttcctggccggctatggtctggcccaggcggtgccggggccgctgttcaccttctcggcctttctgggggccgccggcatctggggcgggctgccgggatggctggcggggatcatcgccctgatcgcgatcttcgtgccggcggcgctgctgttggtggcggcgcttcccttctgggaccgcatcgccggccatccgggggcgcggcgggctgtggctggggtcaatgccgcggtgctggggctgcttgccgcggcgctctacgatccggtcttcgtcacagctgtctccggcccacgggacgccgcgctcgccattctggtcctgctggcgctgctggtctggcggctgccggtctgggtgctggtgccgctggccgccgccgccggtatggcggtggctgccctcggttgacgggtgcaggtcaatcggctgcgttcccggcccggcgctcccggcgccgatagatggtggagctgctgatgcccagcagctgggcggcccgggtgacattgccctggcagagcaggatcgcgcgttcgatcgtctcgtcgatcacgtcgtccagcggccggatcagctgtgccggatcgtcctcgggcagggcgagggagccggcccgccaggtcatggccatggtgaccgcatgggcgatgcggcttggagaggcgtcctgcggcaccacgtcgatggcgccggcgcgcatggcaccgaccaccacctcgtcgtcgtcttcgggcagccgcacgaaaatcggccggatgtccgggacgatggcgatcagccgctggatcagcccggcgcgcggcatgtcgtcgaagcgccccacgatcaccaccggcgggtgggagacgcggatggcggcaagcgcgcgctgggcgtcgggcacggctgtgcgcggcatccgcatcagcgaccccgaggcctgatcgaacaccggaaagctgtcgccacggccgacgagcagcagggcggggcggcgatcggtgacaggtgtcatacggttcatcagcatctcgtctttcaagggcaaagccccggactgtggacaggcggatggcggcgggcgctgtgtcttcgtcaccgagacgcaacttgcaacgatcactgcgatacgcgtcgcattccgcgaggcggggcgcagaaatccggccctgccggccatgtccggcattgattgagggcaaaagcgcaagtcctgtgccacccggtcccccgtgaacaggggggcgagcggaggcgcatgagcggtcggggcgcccgcggcaaagcaccgcatggtttcgcccccgggcggcgcgcatgctcaacctccctacgccgtcgatgagccggatggatgcagctttgccgagggtcttttccgggcccggcacagacatgcaacggtcacggggggatcccttgcccttgcgtccgcgacaccccattttgacgtgatacatgccgtccggatgccgaccgccgggtccggccgcatcttcggtctcgacgacgaaaggagaaggtcttggtcgctcaacttcccgccatatcgggcggcagtaatctgtcgacctatctgaacgagattcagaagtacccgatcctgaccgccgacgaggagtttatgctcgcctgccggtggcgggaccatgccgatgccgacgccgcgcgccggttgatcaccagccatctgcgcctggtcgccaagatcgccctgggctatcgcggctatggtctgccgctggaagacgtcatcgccgagggcaatgtcggcctgatgcaggcggtcaagcggttcgatcccgaccgtggtttccgcctgtcgacctatgccatgtggtgggtccgtgcctcgatccaggagttcatcctgcgctcgtggtcgctggtcaagatgggcaccaccgccgcccagaagaagctgttcttcaacctgcgccggctgaagaaccagatgaatgccattgaggccggcgacctgccgcccgaggtggtgaagaagatcgcgaccgagctggatgtgggcgagcacgaggtggtggagatgaaccgccgcttcgccggtcccgaccagtcgctgaacgcaccggtctcggccgagggtgatgccgaatggcaggactggttgaccgacagccggcccagccaggaaaccatggtggccgaggacgaggagcagtcaaagcgcctgggcctgatgcagtcggcgctggaagacctgaacgagcgcgagcgccacatcttcaccgagcgctgcctgaaagagccggcggcgacgctggaggatctggcccaggtctacggcatcagccgcgagcgggtgcgccagatcgaggtgagggccttcgagaaggtgcagaagaagacgctggaactggccattgccgacggcgtggtcaacgaggatcagatgattgccgcccgtgcggcgggtggccatcgtcagctgcgcggcagcacccagccgaactgatccgccagtctctgccggccggatgtgcccgcacccgccttttggcgggtgcgggtttttcgtggcggaacgttagttcagcccgatcgccccgttggggcgcatcatgcgcagaacctgaccgctgggtgcacgatagaccccgcgggtcgaactggtgacggggccgagcgtggcgccgcgggcgggagagggcatatgcacccgcggggcggcggggcggggggcgatggcgcccggtgcgtcgtcagcgccggcagtctcgggcgccatgtcggcggcggcaagctgggtctcgtcagccgccggtgcctggcgctgtgcggcatcctcggcggcggtcgtgatcgccggcgtgcgcttgcccgaagccgagccggccggggcatggccgttgcgctccagccagaaatccagcacccggttgcggtagggcttggagttggaaggcgtgcggctgtgatagaagccgaccgcttcggtccaggtcgcggtctcgccctggagatctttcagaaagcgggcggcgtagtcggcattgtaggcaggatcgatcatctggttgatgtcgtcgaactgttcgccatggaagtggaagttcacctgcatgcagccgatatcgatgttccggacccctttggcgcgcaggccgcggatctccgccagggcagccgctttgctcggcaggtagcggcctcggccctcggcatagatggtccagggccaggcagttcttgccgagcgctccttgctccagcggcccgattccgccagggcgatcgccgccagaagcccgtcgggcaggccgtggcgacgctccgccgccgagatggcctggtcgcagagcatccagtcccgggcctttccgtcggggtcgccaccggcccgggcgggggcggagcccaggaaagctgccaatccggccacgaggatggcggtcagcaccgcgccgcggcgtgcggcatggcgggggcgttccgggctggtcgggcggggggtctcggacatgatcggcggatccgggtggcgttggaggggctgcagcggggctgccggtgcagctccgttctttcaaatcccgtgccaaccgtcgggagaggcggttgcagagctgctgctcaatatcgaggcacgaaatcttcttgcctcattcgcgggcaggctctatatgttgcagcgcggcaggtgaacgctcaggcgttcgcggccgctgcccagatccttgggcgtttcctccctagacttagggccgtgtcagtctgctggcgcggccttttttttgcgccggacgtctgacgcgtatcaggtcggaagatgttcgtgctgcacctgcacagatgcccggttggcatgcagggcatgcggcaccggcataaccccccggaattcctggacctccccggcgttttttgtccattccacccgagaaggcccttgaccgtttgtgcgccgcaacgtatcttcatgcctgtaacgggcgcttggcggcgccgctgttgcagcccagtttttgggcgtttcctccctagactttgggccgtaccgattgctggtacggccttttttttgtctcgatggtgcgtcgcgaagggccggcgggtctgtgatttcgcaaatgcgaaggcccgtttcgcgcgtgtgaaaccgattacaattccctcttgaccgctgctgcgtcgcagcgtatatattgcagtgcgtcataagacgcttcgcgtctggtgatgctgcccatcttcttgggcgtttcctccctagacttgggccgtatcagattgctggtacggccttttttttgtccggacctctggctggggcgaggtggtcagacttgtgttgcacttgcgaaatgtgcctatgcaaaaccccgtcatccgggggatgacggggtgcaaagctgccgatggcccggtggtcaggcggcttcggcgcccggtgggttgggctggtacagccggtcctcgggcaggacgtcgccggggccatagtcgccggcgctggccatctcgtcatagatcggctggaagtcctgcgcggtctcttcgaacagctcttcgaaggaccggatgacgaaataggtctcctggaaatcgtcgatgcgatagcgggtgcgcatcacccgccgcaggtcgaagcccagccggttggggcgccgatcctccagcgcatagatcgattcccccttcgacgaggcgatgcccgatccgtagatgcgcaggccgtcatccgtggcgatcaggccgaactccaccgtgtaccagtagagccgggccagattgtgcaggcagtgacgggcatcggccctgagcccggcctggccataggcctgcatgtaatcggcaaaaaccgggttcatcagcagcggcacatggccgtagatgtcgtggaaaacgtcgggttcctgcagatagtccagctgctcgcgggtgcggatgaagctggtggaggggaagcggcgttccgacaggtggcggaagaacacgtcgtccggtaccagccccggcacgcagacgatccgccagccggtggtcttttccagaacgtcggagaggcgctcgaattccggcacgccgtctgcggcaatgcccaggcctgaaagcccgtcgatgaaggccggaacggcccggtcgcgcagaatccgggcctggcgttcgaacagaaagcgccagatcgcgtgctcctcctgggtcagcttctcccaatgctgatccctggtgaagtcgtcccggatctctgccgcgtggtcgcgataaccctgggtcatggtcgtcaagtcctcgtcgcaccgttgaagggggcgtttgaggacgagtctgcgtgcgtcccgcggctttttcaagccgagaaagtttcaaatgaaacgaatttcgggttgagagtccgggctcaatcttccggcgcggtggaagagccttcgcccaggctgcgctgaagcatgatcgcgtcgatccagcggccgaacttgtagccgatcgccttgaattcgcccgcatgggtgaagcccagcccctggtgcagcgccagagaggccggattgcccggatggccgatcaccgccaccatctgccggaaacccgccgccgtgcagcgccggaccagttcggccagcaccgcccgccccagcccccgcccggtctggccccggccgacatagaccgagttctcgaccgtgaaacgataggcggcacgcatccggaagggtgaggcataggcgaaggccttcacctcgcccgcttcgaccgcgaccagaaagggcaggccgcgatccagcgccgccagccgccgggcccgcatctcgttcagatccggtgccgccagttcgaagctgaccgtggtgttggagacgtaatagctgtagatcgcatgcacctgggccatatcggcctcggtggcgtcgcggacgacgaccccgggttggggaagcggatgacgatcgggtttgggcatggtgagcacggccatctgatcggggcgcccttcgaaatgcgtcgaggctggcagcggagccgaccgcgggcgacggtcggacccatgagcgggcatccgcaagggatgccggggtgccgggacggcggcagagggccggcgaaccgcggcggtcagcctcgtcgttccacgccgagggcggcgagcagggcgctgtcgcgacccaatgtctcgatcagcagggtgaggtcggcggcgacccgcgccaactccggcagcggctccaccacgctctcatccatatagagggcgcggttgatctcgacctgcagggcgtgcacgcccgtgaccgggcggccgtaatgttcggtcacatggccgccggcatagggccggttgcgggcgacgttatagcccatcccctccagcacctgctgggcggcatcgatcacccggggggcgcaggcggcgccgaaacggtcgcccagcacgaaatccacccgccggtcgcccggatcgtgatccatcggcccgcccaccgaaggcatggagtggcaatcgaccagcagcacgccaccgaaccggctgcgcacctcttcgatggtcgccttcagcgccgcatgataggggaagtagtagcgggcgatgcgcagctccgcctcagcccagaacagcttgcgaccatagatctccaggccgttggttacgacgcgcgcgatggtgccgagccctcccatcacccgccgggacgtggcgttgacgaaagacggtaccgcatcggcaaacatctgcgggtcgatttcccagggctcgcggttgacgtcgacataggccctggggaagcgcgcgcggatcagcggcgcccccagcgccggggcggcggcccacagccggtcgacgaacgcgtcttcggaattgcgcagcgtcagcggatcgagcttcgacgaggcctgaaagcctgcgggatagcagttcccggaatggggcgaggcgaagacgaagggcagccggagctcggccgggcgcagcacctcgaccgccggatcgacccagtcgtcgaacccggtcccggtcgtcgctgcccccgccatctccaggcggtcttccgtatcgaagcccaaatcggccatcggtcggtcttgtcccccgatctgccgccgatgcccgctgcccggtcccatccgggtgccgcatcgatccaggcccacatgaatacggcattccgccccccatgtcatgccattcggtccccgcgaccggctcgcgcggcacagggcggtcatgtccgcgtcgcatgggcaacaccttgcggcgccggcgcattcccggggcggcgacacggaaccgtcacggggctgcatttccgggcttgcacggcctttcgggctgcgttatatgaacgcccacaccgacaccgggtgcagacaagccccatgcggtgcggacatggacgcgtagctcagcggtagagcaccacgttgacatcgtgggggtcacaagttcaatccttgtcgcgtccaccatcgaaaccccttgggaaaccaaggggtttcgtcgttttcaggctgtgggaaaggccacagcccgttcatgccgatgctgggcgccacaggccgcgtcaaccacatcccgggcagtgcaccgcgtcacgacagcttgtgccgctcaatcggggagacgtttcatgcgcatcgcaactgcggccgccttccttgcgctcgccattcccgccgtcgcctatgctcaccatggctggagcagctacgatgcctccaggcccatggtcgtcaccgggccggtggtctcatcaacctatggcaacccccatggctctctcgaaatccggcacgagggcgcgctctggagcgtggttctggcgcccccgtcgcgcatgaccgcccgtgggctttcggccgacatgattgccgaaggccgtgaagtgacggtggagggctatccgcgcaaggatgggaccccggaaatccgggccgagcgcatcacggctgaaggcaaaaccatcgaactgcgctgatggcgggggtgctgacggagctcaccgcggcggctgtcgaggcctcggcagcaggcacgttcatgcgcggatccattctcgcctacccgctcgcaaatctggttcatctggcggggctggtcctgctgatcggctgtatcggcctgctcgatctccgtctgttgggagcggtgcgtgccctgccggtagcggcgatgatacgctatatggtgccggctgcgggcttgggactggtcctgctgatcgcctcgggcattgccatgtttgccgccgatgcgacggcactggcgaagcatgacggcttccggctgaagcttctgctgatcctggccggggtgatgaatgccggcctggtgcatgccatctggctgcgtcgatccgcctggcaggagcccggccggcaaatgccgccggggctccgcattcaggcggcggtgtcgcttgccctctggtgctgggtcgcggtcgagggacggatgattgcctatggctgaaggtcgagtccaagcgcatcgagccgcgcggcggacattcccgccgccagcccggccgcacgcagctggccgaaggtagtgtcgtcgatcgggatgcccccggcccgccgggcggcgcgggcggcgatctcgggctcgcccgggatcagcaccggttgccgcggggccgagcgggaggatcgcatgtggtcgagcagggcgcgggtctcggccgcgagccaggcggtgtcgaccagccggccgggttcgatcacgatcgcgaacatgctgttcaggatggcgtcggagcggggattgccgggctgggaggttccggcaccggtgagcgcgccggccagaagttcacagaacagggccagcccgtaacccttgtggccggccatgggcagcagcgcgccctggggctcggcgaacatcacccccggatcggtggtcggccggccctcggcatcgatcagcagcccctccgccatcggctcgcccttgttcatcgccacccggcatttgccgagcgcgacgccgctggtggccgcgtcgaagatcaccggcggcgcaccatcggcgccggggaaggacaggcagatcgggttggtggaaaagcgcgggtcgaaccccgcatgcggcgccaccagcgacggcgagccggtgacgttcacgaacatcagccccacctggccggcggccgccacctgctcaccatagctgccgatccggcccatatggtgacagttgcgcagcgccagcacggcggccccggtctcgcgggcgcgggcgatcgccgtctcggtggcggctttcgcgatcacctggccatatccctgttcgccgtcgatcacgatcatgacgccggcatcggccacgacccgccccgtgcggcccgggtggagaacgccggcggcggcattctgcagatagcgcgggatcatgcccacaccatggctgtcatggccggcgaggttcgcctcgaccaggtggcgggcgacgacgcctgcctcttcgggcgagctgccgcccgcctcgatcagcgccgctgccgcggcacgcaagacctcgtgatcgatgatccgcatctcgttctgctcctctgcgcgggcaagggatcgccggtcctccggcgaattcccttgcgcgaccggcagatggtataccactctctgagcaacgcccccagcgaacccggaccccgatgaccgcgacacgcgaccgcagccccagcctgacccagacccaatccgtctaccagtcgctgcgcgatgcgatcctgggcgtggaattgcggccgggtgaggcgatctcggaacgctggctggaagggcggctggcggcgtcgcgcacgccggtgcgctcggctctggtccggctggagggcgaggggctggtgcagcgccagggccgcggctatgtggtgacgccgatcgatatcggtgaaatcgagcaggcctatgtcttccgcgagaccatcgagaccacggtcgtgcggcttgccgccgcgcgcgccgatgcgctcgacctgtcgggtatcgaaccgctgatcctgcccgaggtccgggacacctccagcgacgagtggttcgacatcggcatcgctttccatgtcgagctggcgcggcttgccggcaacgcctttttcgtacgcgcgatcgacgatgtgatgacccgcatcgcccgcggccgttggctggagatctggtcgaccggcgggcgggagcgtgccttcatcgaacatgaacggatcgtggagctggtcaaggccggggatggagaggcggcggccgctgccatccagtcccatgtccgccatggtcgcgaccggctgctcgatgccctgaagacacagcgccgcggcttcgcggtacgcggttttgccgtcctcgatgggaccgaggcggattgacgacggggcggcggtaaccggcccgcatgaggccggacccgtgaccggccctcatttcagacgatcaacgagacgatccaaggggagacgaaacgtcatgaccacgcctgccgacacccggctgtctgccgcaaagcggccgctgcgcaagcatctcgcggggcttctttctgcggcggccttcgccgtggcactggtcgccggccagggcgccgatgccgccgatccggtggtgatgcggatcagccaccagctgccgcccgcgcatcacatcgcgcagctgatcgaccagttcgcggccgatgtcgaagcgaagagcaacggcgccatcgacgtccagatcttcggggccgagcaggcctacaaggccaatcagaatcacccggccgtggcccgcggccaggtcgaggcggcagtgtcgacgaatttccagtggggcaacaccatccccgagatgaacgtcgtcacgctgccctatttcttcacgaagctggagcggatcgagaagttcccgggctcgcccgccgaagagctgcttgatcagaagctgctcgaaaagggcgtgcgcaacatcgcctggttctacaccacccgccagtcgatctttacctcggccgcaaagccgctggtcgcggtcgacgacttcaagggcatcaagatccgcggcctgaacaagctggtcgacgaagggctgatcgctgccggtgctgcaccggcggccatgccgggctcggaagtctatcaggcgttgcagaccggcgtgatcgatgccggcctgaccgacgtgtcggccgcgtatagccgccggttctacgaagtgcagaaatacggcacggtttcgcccttcttcagcgtctatttccatctctacgtcaacccgtcctggtatgacggcctggcgccggagctgcgcaaggtggtcgacgatgccgcgcagtcggccgaggcggcgtcgatcccgctgaccgagaagaccgctgaagatgcgatccgtcagcttcaggagaagggcatgaccatccatgtccagacccccgaagaggcggccgctttcgaagcggtgatgcagccgccggtcatggaggccttcaaggcgtccagccccgatgcggcgaagctcgtcgacctcgtcaacgcgctctgagcggggaagacaaggggacgctcccggccgatgtcgcatgaaccgaccggtcaccgcccgccgccaccatccccggtggtcgcgggcggtctcgcccgcctgctgctcggtttcgaccgggtggtgcgcctgatctcgcttctggccgccgggatcgcggcggtgatgctgctcacggccttcgtgctgatctgctggtcgatcgtgcagcgctatttcgccggccggccggtggtctggaccgatgaactggtcggctacggcctggttgcgatcgtgatgctgggggcgctggatgcgctgcgccgcggtgagcacatctcggtcgacgtgctgacccagcggctgggccgccgggccggggccgcggtcgccgcggcggggctggtcgccgtcggcatcgtcggcgtgatcctgatcatcgaggcctgggaaatggtctccttcacccggatgatcggcatcgtctcgaccggttatctggccatgccgatggaatatccccaggccttcgtcgggatcggcggcatcctgctggtgctgggcgccctcggcggccttgcccgcatggcggccgggctgtccccgatcgacgagccgggcacgcccgcggcaccgggagaggggggcctgcgtccatgaccttcctgctcatcctggtcggtgtggtgctggtgctgctgaccggcctgccggtcttcaccggcctcggcctgttcgccggcgggttgctgcttgtaacccagggggatctgggggcactcggcgaggtggtgttcggccagctggacagctatctgctggtcgcgatcccgcttttcaccctgatggcccatatcatgatccgcggccgggtggtggacgatctctatggcaccgcccataccctgctgcggcacctgcccggcggtatcggcatcgccacggtcttcgcctgcaccatcttcgcggccatctcgggctccagcatcgccacggcgctgaccgtgggggccgtggccatcccgcagatgatccattacggctacaagccgcgcgtcgcctatggggtggtggcggccggcggcacgctcggcattctgatcccgccctcggggccgatggtgctctatggcgtgatcagcgacacctcgatcggcggcctgttcatggcgggcattctgcccgggctgatgatcgcggtgctcttcgccgtctggtgtgcggtcaacgatcgcgggacgctccgtcagccgcgggcctctctgtgggagatgggccgggcgctgcgcaaatccggctgggccctgtcgctgccggtcttcgtgctgggcggcatgtatgcgggcgtcttcaccgccaccgaggcggcggcggccggtgcgctggcggcgctggtcgtctcggccgtcatctatcgcaatttcggcctgcgcgatctctgggcgtcggcgatggattcggtccgcacctcggccatgctgttcatgatcctggcggcggcgggcgtcttcggccatgtgctgaccaagatgcgcgtgccgcagcagatcgtcgagctggtggtccattgggatgtgggcgttgccggcttcctgatcgcgatgatggtgctgatcgcgctgctcggcatgttcctcgagacgatctcgatcatcctgatcaccacgccggtggtgctgccggtgatggcccatctgggcatcaacccgatctggtacggcatcctgctgaccatcaacctggaactggcgctgatcacgccgccggtgggcatgaacctgttcaccatcaaggcggtcgcgaaggcgccgatgggcgaggtgatccgcggcgtcgcgccttatgtgttcctgatggtgatcggcctggtcctggtcatgatctggcccgacatcgcgctctggctgccgtcgaccatgcggtgacggcagccggtgtgcgggccgggtccccgcagatggtcatttctcgcggcccatgattttcaaagcccaggccgcgagagaaggccgtgtcttcacgaaggccttgagctgcatcacatggcgttcagtctcggcgcgcatggaaaaccggccgataccaaggatggctacggacgcgccgtacatctcggcctgcttctcgaatgaggtcgggaaggccgcggtcaggacgccgcgccaggtctccgaccattccggggcgcagaggaagaccttgcccggggtgatggcgaaggggcgcagtggcgactggtcgacgaagatgtgccgaccgaggccggcggcgacatccggccaataggggttgaagtggtcgtcgaggaccacaatcccgccttcggcaagcgagtcggccgccagtttgaggtcgttcgccgtgagcgcctcggtatggccgccatcgacactgaacaggcgcacaggaccgactgtcgcccggatctcgctggccgcgacatcggtggagctgcaggcgcggaccaccaccccatcctccgaaccacaatgcttgcgaaggttttcgagaaaccgggaccggtctccacgcccggaccgatcgatgttcagctcctgctgctcgaaaagatcgatcgccagcccttgttcatcggcccgggtggtgagctgcagcaccagaaacagtttgccgcgatggacgccgatctcggccaccgcaccggcgacgccgtgatcggcctgcgcttcaccaagccttgcgattgccctggcgctgaagccgtcgagccagccgtggactgcgttgatcccattgtccaggtagcgggagagagcggcctccggatagcggcgcggacttggcatgcatgtcacctcgaggcacatatggatcatctgtctgccggacgacgatgcaggtcttctcgcggccctgcaagagttgaagcggccactgccgcgggatgcgattaaccgcgattgatcggcgacacgggatctctggccgcaccccataatacactgccatggtcacatgtcggtgcggggggcgcccttccggccgatgcctcattcttcgcctgcctctgtattcgccatcaccgcccgcgccggggtgccacatgaccgtcccgccactcgtcctgccggatccggatgtgctgcgcgccgccctggcgcgtgcggtgaccgatgacggctatcacgacctctttctttcggacccggccacggcgcttgctaccatggggatcctgctgcctgaaggcgcgcagctcagggtccacaggccgcggcgcggccggctgctgctgaccctgccgcccttcaccgatgcgcccgtaccggcggggctcgggccgcttgaggccgcgatgtggcgggcggcgacggatccggtcttccgggccgatctgcgggtggcacccgttgcgaccctcagggcgcagggggtcgagatggcggccgggctggtcgtcgacgtgatcgatgccgaacccgggctgatcgatatcattctgccggaacgggtgccggcgatggccgggcggcgggcgggtgccgacgatctcgaattcgacgacgaggatctggatctggtggcgggcggtgtcgctccgcccgatccgggcagcctggtcgatgcctccacctggctgacgctcggcggcattatggcctatggcatcgggaccgcatcctgacggaacctcggtccggatgtgtgatgcacgagccgtcacagactggttaccgcggtgccggccggtttctgctatgatccggcggcgttcgggcggctgacgggggagagcgacgggtgacgacgggcggaattacgggactggtactgacgctcgccgttctgctggtcatcattgcagggatacaaccgctggcccgccgcctcggcgtggcatccaacgtgctgctggcggccgtgggcgtggccatcggagcgctggcggcctttctgctcttcacctccttcaccgacgtcttcaacgaagccgcccgtgccgtcgtctatctcaggatcgagagccagacggtcatcaccattttcctgccgctgctgctgttccagacggcgctcaccatcgatgtgcggcggctggtggaagacatcgcccccatcctgctgctcgccgtggtggcggtggtgctgaccaccgcctcgatcggcctcgggctctcggcggtgttcggcgtgccgatcctgggctgcctgctactcggcgcgatcgtggccaccaccgatccggcggcggtggtcgcgatcttccgcgatatcggcgcccccggccgcctgacccggctggtcgaaggcgagagcattctcaacgatgccaccgccatcgccttgttcaccgtgctgatgggggcgctggttaccgcgcgtgctaccggtatcgaagagcccaatgccgacatggcctggcaggccttgagcgatctgggcatcggcctgatcggtggtgccctgttcggcgccctgacggggcggctggtcgtgatgctgctgccgctcctggacgatatcaagccggccgaggcgacgctgaccgtggcggcggcctatatcatcttcgtcaccggcgaatacggcatcggtgtgtcgggtgtggtggcggccgtggtggcggggctggtggtctcggcccagggccgggcgcatatctcgcccgaaaactggcgccatctgctggcggtctgggatcagatcgccttctgggccgggtcgatgatcttcgtgctcgccgccctggtggtgccgcggctgatggcggatgtcgatctctacgacgtgctgaccatcctggcgctggcgcttttcgcgctgatcggccgggcgatcaccctctggctgctgctgccggtgctcagcatgttgaagctgtccacccgggtgacccatcgctatcgggcggtgatcctctggggcgggctgcgcggcgcgctgaccctggttctggccctcggcgtcgtcgaggcgccgggcctctccgacggcctcaagcgtttcgtggctgtgaccgccacaggctatgtgctcttcaccctgttcgtgaacggcaccacgctccggccgctgatctcgtggctggggctcgaccggctgtcgccggtgggcgaggtgctgcgccgtcaggttctggccctgtcgctgaccgatgtccgcggcgcggtcgaagaggccggccggcgctatgacgtcagccccagcgtggtgcgcgagatcgcccagtcctatgcccgccgcgccgatcaggtgaccagcgacaccgatgtcgaggccgaaatcgccgatcgcgagcgtctgggcgtggggctggtggcgctggcggtgcgcgagcgcggcctgatcctggaccttcacgaccggcggaccttgtccaccgccaccgtcgaccgactgctgcggctgaccgaagcgctgctcgaaggcgggcgcaatgaaggccgtctcggctatatgcgcgtggtgcgcaccgcgctcgatttcgaacgcggcttccgcttcgcctactggctgcaccgccggctgcgcatggaccggccgctcgcccgccggctcgccaaccgtttcgagatgctgctcgccttccgcctcgcgatccaggaattgcggccctatgtcgacgagcggatccggccgatgctgggccggcgcatcgccgagttgatcgccgatatgctcgacggccgcgcccgacaggtggcgggcgcgctcgacgccatgcgcctgcagtatcccgattacgccgaggcgctggagcggcgtttcctggcccggatggccgaacggcacgagcttgcccgctatgacacgctcgcccaggaaggcctgctcgatgccgagctctacgacgatctctatcggggcgtcacccgggcgcagtcgcgccgggacgacctgccccggctggatctgggcctcgacaccgacgaactgatgcgccgcctgccgcttttcgccgatctcggcgacgagctgcgggcccgagtgcgtcagctgttgcggccggtcttcgtgctgccgcgcacggtgatcttccggcagggggacaagggcgacggcgtctatttcatctcgtcgggcgccgtcgaggtccggatcgaggatcgccgcatccggctcggccgcggcgacttcttcggcgagatggccctgctcgacaaccgcccgcgcagcgccgagatcgccgccctcggctattgccagctgctcttcctggatgccgatgatttccgccggctgatgcgccgcgaccccgacctgctcgaaaccttcgaaagcatcgcccgcgcccgcgcggcgcagaaccggagtgcggcgacctgagacgtcacctgaggagcgtgatcgtcagcccgagtgcgtcagaaaatcgctgccaagcccgatcggcggtcagcacctcggccgcctgcagttttgcgagggcaagacaggaccggtcgccgagcgacagcccgctcttgcgggtgatgtccgccagctgcccggtcagcacggcctgcgcgtgatcgaaggcgacgacgttgatcccggtttccgtgaaaaatgcgtcgattgcgccgacgggaagacgattgaccgtcgcataggtatagacctcggcgacattgaccgaactgaccagcgcatcgtcgaggtgatcgaaaacacgatcgccacccgtctcgccgaggatggcggccaggattgcggaggcgtcgacgacgatcacgcgtcgtccgcctcgcccgtttcctgctgacgctccttctctcgccagttcaggaaatcggcaacgctggccttgtcgctcaggccgctgtcgcgtgccagggcccggatgtgctccttcacgtccttcatggtctggatcctgatcgaaccatcgacgatttcaagccgcacgggcccgccccgttcgaggccgacggcacgacgtaattctgcgggaagctggagccgccccgtctcgctcacatggccgcgcaggccggttgtctcggacggcggagccgaactctgcttgcgggatgcgaccatgagaccctgagactccctgtctgtcgccctcatcttacgaatatagagcggtccccctgtgcgtgccacgccgccggtgaagacgacatgggaagggcgctgatcaggccgacagtgtcagccccgccccagccggcaccgtgtggtccgggtctcgtcgcccagcatcagcgtggtctcggcgggggccgtgcgggcgatgacgcggccggcccggatcacagagaggcgggtggcgctgaggcgcagcgcctccaccgggtcgcccgcatccaggatcaccatgtcggcgcggcagccggcggccaggccatagccttccagacccagcagtcgggccgggttggtggtgacggcgtcgaagcagctccgcatctggtcgagcccggtcatctgggcgacatgcagacccatggcggcgacgctcagcatgtcgcccgagcccagcggataccaggggtccatggcgcagtcctggccgaaggcgacggtcagcccggccgccatcaattccggcacccgggtcatgccccggcgcttgggataggtatcgtgacggccctggagggtgatgttgatcagcgggttggcgatggcgcccagatccgcctcggccatcagcgcgatcagcttcgagacgtagtaattgtccatggaatgcatggaggtgaggtgcgagccggtcacccggccgtgcagccccagccgctgggtttcataagcgagcgtctcgacgtggcgcgagagcgggtcgtcgctttcgtcgcaatgcatgtcgaccctgaggccgcgctcggccgcgatctcgcacagccggcggacgcttgccgcaccatcggccatgctgcgctcgaaatgcgggatgccgccgaccacgtccacaccccggttcagcgcctcgatcagcaggtcttccgatcccggccggcgataaagcccgtcctgggggaaggcgaccagctgcaggtcaatatagggggcgaccttcgccttcacctcaagcagcgcatcgaccgccagcaggcgcggatcgcaaacatcgacatggctgcggatggcgagcaggccccgggcgaccgcccagtcgcaatagaggagcgcccgctccaccagagcctcatgggtcagctcgggcttgagttcgttccagagcgcgatgccctcgagcagcgtgcccgagcggttgatccgcggcatgccgtaggagagggtcgaatccatgtggaaatgggcatcgacgaagggcggcgagaccaggttgccggcagcgtcgatggtctcggcagccggggtgccgcgggccgcgatgccgggcgccacctcgacgatccgcccgtccctgactgcgatgtcgacgggcgtgccgccctcgggcaggcgggcattcaggatcaacaggtcgagggacatggctcaacgttctcccttgcggaagggcaccatcagtgcctggggataggcggcacggcgcgacatcaccaccagcgccaggatgctgagcagatagggcagcatcaggaacagctgatagggcagggcgccgccggtcatctgctgcaggcgggtctgcacggcatcgaaaaaggcgaagagcagcgcgccgagcagggccttgccgggccgccacgaggcgaagaccaccagcgcgatgcagatccagccgcgtccgcccatcatgttgaagaagaaggcgttgaaggcggacagcgtcaggaaggcgccgcccaccgccatcagcgccgagccggccatcacggctgccagccgcacgccggtgaccgaaatgccctgggcatcggctgcggccgggttctcgcccaccatccgcaccgcgaggccggcgggggtgcggtagagcacccaggcgaccagcgcgaccagggccagggccagcagggtgggcgcggtctgctggccgatcacctcgcccagccagggcaccgcctgccaccagccgtcgcccagcggtgcgaagggggtgatcgagggcggggtggtggtctcgggcagcagcaggcgataggcgaaataggacaggctggtcgcgagcatggtgatgccaaggccggtgacatgctgcgacaggccgagcggcacggtcagcaggccgtgaagcaggccgaccagcaggccggccgcagccgcgaccgcgaggccggtccagagatcggcgccctggaaaaccgccatccagccgaccatggcgcccatggtcatgatgccttcgatgccgagattgagcacgccggcccgttcacagatcagctcgcccagcgtgccgaagatcaggggggtcgcgatgcggagcaccgtggcccagagaccggcggagatcaggaggtcgatgaattccatgggatcgggacctccggatcagccgcgacgcaggcgatagcgggcgaagagcatggcggtcagcatgcagagcagcgacacggcgaccagcacatcggcgatataggtgggcacccccaccgcgcggctcatcgcatcggcgccgacgaaaatgctggcgaccatcagcgctcccagtaccacgcccagagggtgcaactgggcgagcatggcgaccaccacaccgccggtgccatagcccggcgacatgtcgagggtgagatagccggtgcggccggccacctcgctcacgccggcgagaccggcgagaccgcccgagatcagcgccaccagcagcatcacccggccgacccccatgccggcgaagcgcgccgcccgcgggctggcgcccaccgcccgcatctcgaagcccagcacggtgcgggtcatcatcacatagatcagcccggccgcgaccagcgccatgatcagcccggcatgcaggcgggtgcgcgggatcagccggggtagttccgccgccatcggcagggtctcgctctgtggccagcccatggccatggggtccttcatcggcccttcgatcatcatcgagacgaagagcagcacgatgaaattgagcagcagggtcgtcaccacctcgtcgacgccgaaacgggttttgagcaccgcggggccgagcagcagcagaccgcccgcgacggcgccggccaggatcaccgccggcagcagcagggtatcgggaatgccgagcggcgccgtgccgatccagacggccgccagcgcgccgccatagagctggccctcggcgccgatattccacagccgggcgcggaaggcgaccgcggcggcaagcccggtcagcatcagcggtgcggcgcgggtcagggtttcggtcagcgcgaaccggctgccgaaggcgccctcggccatcgcggcataggcggcgggcaccgaggcgcccgagatcatgatcagcagggtgccgatgatgaaggcggcgagcagtgccagcaccggcaccgccaccgacagaagcggcggggtttcggcgcggcgttcaagacgcatgggcggcctctggcgtggtcgggtggggatcgccggcatcgggatcaccggcgccggccatcagcaggccgaggcccgagacggtgacctcggccctggggcgggcgggggtcagatggccggcatggatcaccgccacccggtccgaaagggccaggatctcgtccagatcctcggaaatcagcaggatcgcggcgccgccgtcgcgggcttcgagcaggcgctgatggacataggcgaccgcgccgatatccaggccgcgggtcggctgattggccaggatcagccccggatgcagggcgagcgcgcgaccaaggatcagcttctgcatgttgccgcccgacagctggcgcacggtcgcatcgaccgacgggcagcgcacctcgaaatcacgcaccaactcggcggcatgggcgcgggcggtggcgcggcgcagaaagccccagcgcgagaattccgggcggttgcgccgctcggcgatcacgttctcccagacattcatgtcgccgaccagcccctcggcatggcggtcttccgggatgcggcccacgcccagccggaccatcgccgccggatcgggtctgcgggtctcgtggtccaggatggtcagccggccggcctcgacccgggccatgccggccgccaggtcggccaacagcgactgaccattgcccgagacgccggcgatgccgacgatctcgcccgcatgcacggtcagcgacacctcgtgcagtttcggcttgccgccggcgccggtggccgagacccggtcgaagaccagagccggggcccccgggtttgccgcggtatggcggggccttgagaccttgcggccgaccatcagctcggccagcgtggcccggtcgaggccggcggccgggcgctgatcgatcatccggccggcgcgcagcaccgcgacccggtcgctcaccgccatcacctcgggcagtttgtggctgatgaagatgatcgacagcccgtcggcgaccatggcacgcagcgtgacgaacaggcgttcgctttcctgcggggtcagcacggcggtgggctcgtccaggatcaggatccgggcatcgcgatagagcgccttcaggatctcgaccttctgccgctcgcccaccgacagcgcgcccacccgggcatcgggatcgacggccaggccgaagcgctgccccagctctgcgatccgtcggcgggcgccggcgcggtcgcgcccgggtttccacagcggctcggtgccgatggtgacgttgtcgagcaccgacaggttctcggccagggtgaaatgctggtggaccatgccgagcccggccgcgatcgcagccttgggcgagcctgcgggcagagggtcgccgaagacctcgatccggccctcgtcggccacgtaatggccgaacaggatgctcatcagcgtggtcttgccggcgccgttctcgcccaacagggccagaatctcgccgcggcgcagatcgaggtcgatcgcgtcattggcggtcagcgcgccgaaccgcttggtgatgcccgagagccggagcacggtttccggtgccctttccgctccggatggctcagtgacggacgggtcggcagatctggtcatgaggcccttcgcgtttctggaccgtcgcgtttctggcctgccgcatgtgtgacacgccgccggcgggatcccggatggcgagaggggcggtcgcccgcccctcccaaggtcgttcatggccgggcctgaaagctcacatcgtgggcttcggttcggcgtcgttcacctcgaccgtgaagctgccgtccaggatcgccgccttcttcgcctcgaccttcgccttcagctccgccgggatcttgtcctcgaaggtgccatagggggcaagcgaggcgccgcccggcttcatgttggaatagtggccgtaatcctcggccttgaagctcttggccttcaccgccgcgatcgccgcgtcgatggtgggttccatatgccagagcgccgaggccacgacggtgtcgggatactgggcctgggtgtcgatcacgttgccgatcgccagaacgccgcgctccttggcggcatccgacacgccgaagcgttcggcatagagcacgtcggccttgcgctcgatcatggcaaaagcggcttccttggccttcggcggatcgaaccacgagccgatgaagctgaccatgaacttgacgtccggattgacctccagcgcgccggccatgaaggcgttcatcagccggttgacctcggggatcgggaagccgccgaccacgccgatcacgttcgacttcgtcatgccgcccgcgatcatgccggtcagataggccggctcctggatgtagttgtcgaagaccgagaagttcggcgcctgcggcttgaaggacgagcccatcaggaaggcggtctcaggatagtcgcgggcgacgcggcgggcagcctgttccacggcgaaggcctcgccgaccaccatgtcgacgcccttttcggcatattcacgcatcacgcgctcatagtcggcattcgagaccgattctgaccattcatagtcgatgtcgccgcgcttggccgcggcatcgagggcgatgtggatgcggctcacccactgctgctcgatcggcacggtgtagacgctggcgaccttgatcttgtcggcggccgatgcctcggcggcggtcagtgccgccagggcgaccgaagcggcaacggccgcggccttgagctttgcgagcaacatggacgagcgatctccgaagggtgtcgcggaacttgcatgataacgcaaggaccgggccagtaccgccaaaaccgcaggccgccgcgtgggaatccggtggcccggcgcatgaccggcggtaattgcctgcggcatgggcagcggctgcgccggatcgctcgaattttgaccaaatggtctctaattggaagggcgaaatgtcccgggccggccccggcggttcagcggccgccgcccatgccgagcacatcgccgtcatcggccgcctgttccgcatcccggaccggccatcggccatgttccgtggcggcgaagaagtcggcgagcaggcgattgaccagctccggctcttccagattggcggcatggccggtcatcggcagcacggccagcccggccgagggcagggtttctttcaggaacagattggcgcggatcgccggggtgtcggtatcgccgacgatcagcagcaccggaacggtcatggtccggaaccggtcttccagcgcgaaaagcgacggccggcgtgcctggtagcggcgcagcgtcagtgccgcgcccagcggcgaatggtccaggaacacccggaaggcctcgttggcgccgcgcggatccttggtcgcgaagggccggcggccgggggaattcatgtagctccgccccgcggcttccagcccgtcggccagaatccggtcggccgtggcctcgcaattggcggcaaagctctcgcgcagctcgggctcggcgccatagcctgccccgatcgcggtgatcgacagggcgcgcgccggatgggtcaggccgaaatgcagcaccgcgaacccgcccatgctgcatcccaccagatgggcccgatcgatgccgaggccatccatcaccgcccggatgtcgtcgacggccatctcctggccataggcgtcgggctcttcgggcacgtccgagggcggatagccgcgggcgtcataggcgatgacgcggtggctgcgggcgaagcgccgcatctgcggctcccagctccgccggtcgccggcgaattcatgcacgaagatcaccggctcgccctggcccgcctcgatcacatgcagcctgaccggtccgttggcgatgaagcgcccctcgatcccatccattcgggcatcctcctcatgcggctgcgtggacgccgtgcagcagacccgcgcctgttctggtggaggtgcaggatagatcgggcaggtgaccgcgtcacccccggtgggtcaccacgcgatagacatagaccagcaccagtgccgcgacgatgaccttcgaggccggatccatataggcggcgaccagttcgtactggctttccaacgcatagcccgcgccggccagcagggcggtccagatggcggagcccgccgtggaccaggccagatagcgcggcagcggcatgcgggcgatgccggccggtaccgagatcagggtgcggatcgccgggatcagccggccgaagaacaccgcgctgccgccatgacgctcgaaccagccattggccttgtcgacctcgtcgggcgataccgtcgcccaccggccccaccgttcggccaggcggcggatgcgggccaggccgaaggcgcggcccagccagtaccagggcagggtgcccgccaccgatcccgccgtgccggcggcgatcacgcccaggatgtccagctcgccgcgcgccgccacgaaacctgccagaggcatgatcagttccgaggggatcggggggaagatgttctccgccgccatcagcagaaagacaccgatatagccggcggacgagaccgtcgacacgatccactcgaacatgaaggctccgtcgttgatgaggcgagcccgcgtcaggtgggcacaggtgacgggagggacaaggccggtcaccgaaaagccccggtcatcgacgaagctgggtgccacttcgccgcagccagcggccgcgcgggacgttatcgtagatcgataccgttgaaccgcctggaatgttcccgcagccatgaccgatttcgaaccccgccccgccatcgatgccgaacgcgaatacaatgcccgggccgccgtgcccgatcacgcccggatctttgcccgctgggccgcggaggcggcggcggcccggcaggatttcgaacgggctggcctgttgcggcgcgggctggtctacggccggcgggcggatcagctgctggacctgatcctgccgccgtcacgcaccggcgccggaccggtgccgctgatggtgttcttccacggcggctactggcaggccatggggcgggatgatttcacccatctggcccggccctatgttgtgcgcggcgcagcggtggcggtagtggactacaccctctgcccggcgaccacggtggccggcatcaccgcggaagcgcgtgaggcggtgctgttgctctggcgtctggcgccggtgctgggcatcgaccgcagccggatcgtggttaccggccattcggcgggcgggcagatcgtgggccagctggcagccacgccctggcaggcatatgcccctgagatcgagggcagcccgattgccggcggcgtcgcgatcagcggcgtgttcgatctggagccgctgatcgataccaccatcaacgcccgcctggggctgacccccgccacggcgcgtgccgccagcccgcattttgccgtgccgggcccggatacccggctggttttggcagtgggcggggatgaatcggccgagttccatcgccagagccgggatttcgcccgccgctggtcggctgcgggcgcacgcatcgccaccgtcgatctgcccggccgccatcacatgagcgcagtggaagcgctgggcgaagacggccatccactgaccggggcgacgcttgcgctgatggagatcggctgacgcgtcagtcgccgccggcagcgatgcgggcgacggtggccgtggtcgaatggccgggcaggatcggcacgatcatcacccggccgccgcgggcggtcaccacatcggcgccgaccacggtttcgggtgtgtagtcgccgcccttgaccagcagatcggggccgatcgccctgatcagcccggccggggtttcttcggcgaagatcagcaccagatcgacatcggctagcgccgccagcaccgcggcgcgggtctcctggtcctggaccggccgggtcgggcccttcagccgcctgaccgagacatccgcattgaccgccaccaccagccggtcgcaggcggcccgtgcccgggcgatgacgtccagatggccgcgatgcagcaggtcgaaacagccattggtgacaccgaccttcaggccttcggcctgccaggcggcggtaagccgggccgccgcggcggcatcggtgaagaccggcgcatggcgggcggcaccgccggctgcgaccgatttcgcctcggcatcgcccgccacggccgcccgcacctcggtgggggtgaccgtggcggtgccgagcttgccgaccaccacgccggcggcggcattggcgtactggaccgcatcgacgatcgatccgccggccgcaaggccgcaggccagggccgccaccagcgtatcgccggcgccggagacgtcgaacacttcgcgcgcccgggccggcagatgcaccgccgacccgtccgcgcccacgatgctgacgccatgggccccgcgggtggcgaccagatagggaaagccgttggcgcgcaccagccccagggccgcgcggctcacggcatgatcatcggccgggtcgaccggttcacccgctgcggctgcgagttcgaccgcgttcggggtcagcaccatggcgccccgatagcgactgagatcccgcgccttggggtcgaccacgaccggccgccctgcggcggcacagcgcgtcatgatcgcggtcacgatgtcgggggccagcacgcccttgccgtaatccgacagcagcacgatgccggcatcggcaatcgccgcgtcgaccgccgccagcagcccggcgcgggcggccggcgacaggcggccggtgccgtcttcgtccgagcgcagcagctgctggctttgcgccacatagcgggtcttgacgatggtgccgccctcggggtcgacggccagatcgccgctgatccgggcttcggcatcgaacaggccgcgcagctcgtcggctgcggcatcgggcccgaccaccgccaccagccgggcggtcgcaccaagcgaggcgacattgcgggcggcgttgccggccccgccgatcatggtggtgcggcggtcgacccgcagcaccgggatcggcgcctcgggcgagatccgctccaccttgccatagacgaaccgatcgagcatcacatcgccgatcaccgccacattgaccgcagcgaagccgcggtcgagatcgaggaagtcggcacgggcggggcggatcgtcatcgggtcggggtccggtctgaaaggtggggcaatgtgccggtcaggcgcgcggttcttgggccaccaggccgaggccgatttcgagcgcaccgcagagcatctggcccagcatgatgtgcatctcctggatgcgggcggtggtctcgctcggcaccaccagggccagatcggcgcggctcagcgtgtcgccgccgtcgcggccggtgagggcgacggtggtgatgccggcagtgcgggcggcatccaggccgatcagcacattggggctgcggcccgaggtggtgatgcccaccgccatgtcgcccgaccgacccagcgccaggatctggcgggcaaagagctgatcgaagcccatatcgttgccgatggcggtgagtgccgaggtatccgtggtcagcgcaaggccagcgatcggcgcgcggtcgcggcgatagcgcaccgccagttcggtcgccagatgctgggcgtccgaggccgagccgccattgccgaagaacatgatcttgccgccgccctggatcgtggccagcgccatctccacccagcggatgaagggctgcttcagggccgcgcgggtgcgggcggcgacctgtgcatgttcctccagttctgcatcgaagaaggcgtcggcatcgaaggcggcgtcgagatccatgagcccggtcctggctgatcggccggccatctgccggctgcggccacgatagggggcgggaccgcgggtgacaagacgcggccatcgctcgaacgctcgtttgacgccgtctccccggcagccgatgatcatgggcaagggaacatgccgccggacgaagcggccgccagggaggacagaaccgtcatgaccgtcgccaccgccacgaccacacccgcagatgcgccggcagatgcatcggaggcgggcccgcgggtcaccatcgcccgcgccgccgaggggcatttcgagggggacggcctcagggccttcttcacctatcgcgaccttgcgatcggcaccgccacccggggccgcttccacgcccatgtcatccgggcctcggaagccgtcaccggcggcaccggccgccatgctcataggctggactttcagatggtctacgtcctgaagggctgggtgcggttctggtacgaaggcaccggtcaggtgacgcttgccgccggcgactgtgtctatcagccgcctggcatcgcccatgaactggaggccggctccgacgatctcgaaatgctcgaaatcacttcgccggccgagttctcgaccaccgccgtctgatccacggccctcagacgtaagggtcggcgttcagaagataatcccggacataggaggcgatgccgtcctcaagctcggtcgtgggccgggtgaagccggcggcgcgcaggcggccgatctttgcctcggtgaagtactgatacttctcgcgcagatgttcgggcatgtcgacgaactcgatctcgggcttcaggttcatcgcggcatagacggcgcgggcgaggtcggcaaagctgcgggccttgcccgagccgacattgaacaggccgctggcttcgggtgtttccagcagccattcgaccacggccacgcagtcgcccacccagacgaaatcgcgcagctgtccgccatggggatagtcggggcggtggctgcggaacagccgggcatggccgccgtcgcggatccggcagaacacctgatgggcgacgctgcgctggccgcccttgtggtattcgttgggcccgtagacgttgaagaatttgagaccggcccattgcggcggcagggcggcgccccgggcgcggagcgcggtgatccgccggtcgaccatgtgcttcgaccagccataggcgttcagcggctgcaggccggccagcgcgcccgcctcgccatcatcgtcgaagccgagtgcgccatcgccataggtggctgccgaggaggcatagatcagccgtacgccatggcgcgcgcaccagtcgaccagatcgagcgtcagacggatattgttggcgacgatcacgtcggcgtcgcgctcttcggtcgaggaaatggcgcccatatggaccacggcctcgatctcgcctgcccgtgcattcaggaaatcgaagatccgctcagggcgcaccacatcggcaagtgcacgcttggcgatgttgcgccacttgtcgtcggtgcccagggtatcgaccaccaccaggtcgtcatggccgcgggcttcaagcccggccagaatgttggagccgatgaagccggcgccgccggtcacgacgatcatggcatttctcctgcgctgctgcgccttctgtcataccggccctgcgccggtcggcgtttctgcataacctgttgcatctctgcaatcaatcggcccgtgccgcggaaaactcacacctgcggccccgccccgggggtggactcagccctgctgtgcaatgcagcatgggtattgcgacacggtatcgggttgcccggcggcacgcgcgtgccgtataactgttaacgctagcacctaccccatggggaatatcggagatcatatcatgatcaagacctcgatccgcgctcttgcggttgcgctcgctctcgcgggctcggccggcatcgcgctggcgcagactccgccgccggcgaacaacaccgacgatgaggcgggctatctgttcgacgacgagctgaccggcctggccgtcggtggtggcgctgccgccgccgtggcgattgccatcattgcctcggacgacgacgatagcggcacttcgacctcgactgcgaccagcactgctcgctgatccgtcgatggtttgacgagacggaaggcggccctggaaacggggccgcctttcgtctgttcaagggagagctttcaggccgtcccgctcagggaatttgcgcagggcgtagcagtgtgatttccatggtgcccagttccggggagatgacctgccggctccgccagatccgcttgctttcagactcgtaccagtaccggttcgtgaaccgccagcgcatgctttcgaccgtgcagtcttcgtcatagacgctggtatcgaacgtgtacttgcccacggtcacctgctcctgtccggcctcttccaacttgcagtcggcacggatgtcgtacagcctccggcttggcatatcgaacagcctgatatacccgccagcaccggctgcatcgggaaccggcgtagtgagaccgccaggcagaccttcgaacctgacgactcgcagattgtccggcagtccgacggtacggaccaggatgccctgacgggtgtggacttccgcgcggtcgcgggcccgccagaccagcgtgccatcccgggtatcggccagtgcgacacgagccgagccacggccgaactccaccaggatggcagagaccggcagcttgtccacgtcgatctcttccgccgttggcgccgaattccgaaagaagactgcctggagggtatcgaagggcgcaggcaattcacctttgcccgtgcaggcggagagcagcagggccggcagcagcaggatcgaacggaaacgtcttgtggcagaatggctcatatcaggcggaccctctggtcgcatcgcatggaaagcgcgccaaagctacagcatccgcgcccgcgatgcagcatccgcccccggcatcaaaaaacaaatattaattgttaaataaatcaatatccgattagggcctggacaatctgtcgggaacatgatttctgtggggccggaaaccacatccaccgcccgcacccgaaccccgcccgcctgtccgccagcctcgttcgccgacgccagcctgggcatgaggagcgaaggattccatggatcatctcgaccgtcttgaggcgcagagcatctacatcctgcgcgaggcgttcaaccgcatcgacaagctcgcaatgctgtggtcgatcggcaaggacagcaatgtcatggtctggctggcccgcaaggccttcttcggccatgtgcctttccccgtgctccacgtcgacacctcgtacaagatccccgagatgatcgaatttcgcgaccggatggcgcgggaatgggggctgaacctgatcgtcggccagaaccgggcggcgctggatgcgggtatgaaccacacccgcggccgcgtggtctgctgctcggcgctgaagaccgaggggctgaagtcgctgctcgacactcacggcttcaccggcgtcatcgccggcatccgccgcgatgaagagggcacgcgcgcgaaggagcgtgtgttcagcccgcgcggccaggacaatgcctggaacgtcaaggatcagccgccggagttctgggaccagttcaagaccgaattcccggccggcacctcggtgcgcatccatccgctgctgcactggaccgaggtcgacatctggcgctacatccagcgcgaggagatcccggtggtgaccctctatttcgccaatcaggacgggctgcgctaccgctcgctcggctgcgcgccctgcaccctgccgatccgcagcacggcatcgaccgtggccgagatcgtggcggagcttgagaccacccgcacctccgagcgcgccggccgtgcccaggacaaggaatccgaagatgccttcgagcgcctgcgcgccgaaggctatatgtgatcgggacggagcccagcccatgactgccgataccctccagcccgtcctggcagaagacgacgatctgcgcgccgcgatcgaccgccggctgatgcgcatcgtgatcgtcggccatgtcgatcatggcaagtcgaccctggtcggccgcctgctcaacgacagcggctcgctgcccgaaggccgggtcgatgccatccgcgcgatgagcgagcgccggggcatgcctttcgaatggtctttcgtcatggatgcgctcaaggccgagcgcgaccagggcatcaccatcgattcggcccagatctggttcaaatccgcgcgccgcgactacgtcatcatcgatgcgccggggcacaaggaattcctgaagaacatgatcaccggcgccgccgcggccgaggccgcggtgctggtgatcgatgcggccgagggcgtgcgcgagcagtcgcgccgccatggctatctgctgcacctgctgggcttgcgccagatcgcggtggtcgtcaacaagatggatctggtcggctacgaccaggcccgttatgacgcggtggtcgccgaatataccgactatctggccgggatcggcgtcacggccacctatttcggccggtggcggcgcgcgagggcggcaatatcgtcgagcgggcgcgcgacaccatgccctggtacagcggcccgaccgtgttggacgcgctggacggtttcgtaccggccccggcgcttgacgaccggccgctgcgcctgccggtgcaggatgtctataaattcgacgagcgccggatcatcgtcggccggatcgaaagtggccggctggcggtcggcgatacgatcatggtgtcccccgccaacaagaccgtgcgggtgcagacgatcgagcattggggcaagggcgtgccgccggtcgtggccggcaccgggcgcagcgtcgggatcaccttcgacgagcagatcttcatcgaacgcggtgacgtgatcagccatgtcgaaatgccgccggtcgagaccgacgtgttccgcgcgcggctgttctggctggggcgtacgccgctcaccgtcggtgccggttacctgatgaaactcgccacccgtcaggtgcgggtgacggtcgaccggatcgagaaggtgatcgatgccggcagcctggccggggcggatcagggggatcagccgcaggtggtggaacgcaacgcggtcgccgaagtggtgctgcgctcgcgcggcctgctggcgctggatgaattccgcgacctgcccaataccggccgcttcgtgctgatcgaagactacgataccgtcggcggcggcatcatcgcgatggacggctatcccgatcagcgcagcgccgtgacccgtaaatcgaccaacatcaccgcggtcgaacaccgggtgaccgccgaggcgcgggcgcggcgcaacggccataccggcggggtgctctggctgaccggcctgtcgggggccggcaagtcgacgctggcgatcgagctggaacagcggctctttgccaagggctatcaggtcttcgtgctcgacggcgacaatgtccgccacggcctgaacgccaatctgggcttcagccccgaggaccgcaccgaaaacatccgccgggtgggcgaggtcgcggccctgttcgccgaagccggcttcctggtgctgaccgccttcatctcgccctacagggccgatcgcgagcgggcccgatccgctgccggggcgggctttcacgaggtccatgtccgcgccgatctggatgtctgcgagggccgcgacccgaaggggctctatgccaaggcgcggcgcggcgagatccgcgacttcaccggcatcgacgccccttacgagccgccggcggcgcccgaactggtggtggataccggccgtctgtcgatcgaagaggcggtgcagtcggtgatggactatatcgagcggcgcttcgcgatcgcccgctgatggcgcaacccttgaacgcagaacgccccggcctgcaatgcgggccggggcgttctgcgttcaggcggtcgccttcgcccaatagggcgcgcgcagttcccgcttcagcaccttgccgatctcgctgcgcggcaggctgtcgcgcagttctaccgccgacagccgctgggtcttgcccagctgcgcattcgcgtggtcgcacagcgcctggggcgtggcatcgtggcccggccgcagcaccaccaggccgagcggggtttccccccaggcatcgctcggcacgccgatcaccgccacatcggccacggccgggtggctgcgcagcgccgcttccaggtcggtcgcatagatgttgaagccgcccgagatgatcatgtccttcttgcggtcgagcagctgcaggaagccgtcggcgtcgaaacggcccatatcgcccgagcgtatgaaatccagcccctccgggctccgccagatgatctcggcggttttctctggctggttgtgatagcgctgcatcatcgcgccggagcggccgacgatctcgccgaacgcccccggcggcagctcgttgccgtcctcgtcgatgatccggatatcggcaccgggcgaggggcggccgacggtgtcgagcttgtcgggatgggccgcgcagtcgagcatcaccgacaccccgccttcggtcatgccgtagagctcgatcagattgccgggccagcgtgccatcacctgcgccttcatcgcggccggcagcggcgccgaggtggagaatttgcagacgaaagtggaaagattggccgcatcgaagcccggcgtgtccatcagccgcgtgtattgcaccggcaccagcacggcatgggtcacatgttcgacctgggcgacctccaggaagcgcgtcgtatcgaacctgctcatcgagatcagagtggccccgctcgcgagggtcggcagggccaggaacagcgtggtgttggaatagagcggcgtcgagatcagcgaccgcgcgcccggcctcacgccatactgcgcgacccgcccggcctggcgcgcccggaagcgctggtcgtgcacgatgcccttgggcgcaccggtcgtgcccgaggaatagatcatgttgatcagagcggtgggccgcacgtcgaccggctggatggggcgggcccagctgatccagttttccagcgcctcgaccatcaccagctcttcggcaccgagccggcgggccgtttcggcatgggcggccgaggcgaacaggatgcgggcgccgcaatccttgagcatcagttgcagcgccgcctcggtggcgctccagggcagcggcaccacgcaggcgccggcgtggatgatcgcgcaatagaccgcgatatgctcaaccgagttcgaggcgagggtcgccaccatgtcgccacggccgatgccgtgcatcgtcagtccgccggcaatacgggcgaccagttctgcgaaactgccccagtcgaggcggcggttttcgtcgatcaccgccggtgcgcccgggaagcgggcggcattgttcgccagacgacgggcaaagccgatgaaggcttcgcccggaatcgcgggcggaatcaactgtggctgaggcatgatggcgtttccctggtcttgtcagttgagttcagatcagatcagaccccgacgatgtcggcaagccggccgggcatcgggttcaggatcgacccgccatccaccgggatcactgcgccggtgatccacgaggcgcggtccgatgccaggaagccgcagaggttggcgacgtcctgcgtggtgcccatgcgccgaagcgggatggcgtccatttttgcgcgggcactcgccgcgtccggcatcagccggcgcacgccctcggtatcggcgatcggccccgggaccaccgaattcacccgcacccccgccgggccccattccagcgccagtgtccgggtgatcatgtcgaccccggccttggcggcgcagacatgggcctggccgatcatggcaacgctcgcctgtgcggccgagacgttgatgaccacggcccccggcttcctcagatacggccaggccgcccgcatcacgtgatgggtgccgagcaggtcgatctccagcaccgcacgaaagccgttggagctgatatcggcggcgcgggcgacgaaattgcccgcagcgcccgagaccagcacatcgatcggcccgaagcggtcggccgcggcggcgagcgccgcctcgaccgctgcggcgtcacggacatcggcggcaatgccgtcggccccggcgccggagcctgcaagttccgccaccgccgcacggaccttgtcggcgctgcgcgagaagacgaagacccgcgcaccttccgcggcgaaatgacgggcgatgcccagattgatgccgctggttccccctgagaccaccaccgtgcggccgtcgaaatccccgcgcgatctcagatcccggctcaccaccggtcctccgaggtcagcacggcggttgccgcggccgagaacatgccgcccacgccatggacgaccgagactttcacctcgccggcctgggcgggcgaggtaccgcgcacctggcgcacaccttcctgcagggcgaacatgccgtacatgcccgaatgggcgtagctcaacccgccgccattggtattcatcggcagcctgccgcccgggcgggtatggccctcggcgatgaaggctcccccctcgccgcggccgacgaagcccagatcttccagcccgtagatcggcagatgggcgaaggcgtcgtagatcatcagatggtcgacatcggcatgggtgatgccggcactttcgaacgccagccgcccggaggtgcggaaggcgcgcgaggaggtgaaatcctccatctgcgagaccatcggcccctcggcgctttcgcccccggtgccgcgcagatagaccggcttcgttggaaaatccccggcccgctcggccgaggtcagcaccagcgcgccgccgccatccgagaccaggcagcacatcagcagacggaagggccatgcgatcatccggctgccgagcacgtcgtcgacggtgatcgggtcgcggaagccggcacggggatgtttcgacgcccagtcccgctgggccaccgctaccgccgccagctgttcttccgtcagcccatccttcgccatcttgcgcgcgaccggcagggtgaagcgggtcgggggcagggtgacgccatagggggtttcgaattcctgctgctgcatggccgggaagatcggccggtggccgcgatggccgctgcggccgctttcaccatgggtgatcagcaccgtgcggcacagccccgcctcgatcgcggccgcggcatggcggacatgggcgatgaagctgcagccgccgaccgaggtcccgtcgagccaggtgggggtgaggcccagatactgagcgatttcggcggcatcatggccggcggtggcgatgccgtcgacatcgcggacggtgaggccgcaatcggccagcgcgttgagggcggcatcggcatgcagcccggtctggctgaggtcggggatcttgcccaggcgggtggtctcggcggcaccgacgatggcgatgcgggcgcgggtcatcgggcgtctccccgaacgggccggaactggggcacggtgatctcgtcggtgcgccgttcgaaggtcacctcaagcggcatgtcgatggcaagcgcggccgggtcggccgggcagtcgacgatgttggccatcatccgcggcccttcctccagctccaccgccgccacgatgaacggcccgtcatagccgggggcgggcaggtggttgatgatgaagctgtacagccggccgcggccgctggcgtcgaaggtcttcaccgcgcgggatccgcagtgcgggcagaagggccgcggggggaaataggcggtggtgcagtcctggcaggactggaggaccagccggccttcgcgggcgccctcccagtaatgccgggtttcgggcatgggtttgggcagggggcggtcggccaagctcatcgggcggatccttcggtcgggcgggcggagtcggaagagcgggcagaggcggcaaggcgcgcccggccgtggctgagcacggtcacgtcgcgggcgggaacgcgggtgcggaaggcgtaatcttccggtccttcgcgccagatctcggtgcggagcgtctcgcccgggaaaaccggggacgagaaccgggccgacagcgcggtcagccgggccggatcgccgccgccggtcgcctgcaggatcgaccagccggcgacgccatagctgcacagcccgtgcaggatcggccggtcgaacccggcctcccgcgccacagccgggtcggcatgcagcgggttgggatcgcccgacagccggtagatcagggccgattgcggcagggtggcgtgttcgtgcacggcatcgggtgcgcgctccggcgtgggctggggggtcttgaccgggccggccgggccgccgaagccgccatcggcacgggcgaagctggtgacctcgatggtggcgatcagccggcccgtggcagtatcggtcaggctgcgctcggagtagatcagcgcgccacgacccggccctttgtcgacgatgccggtgatccgggtgcggccggtcagccggccggccggcggcagggagccatgcagggtgatcgcctgttcgccatgcagcagctgctgccaggtgatgccggtgtcgggctccatcgcccagaacccggacgagcccagaaccacgaccatggtcggcagggcggcgaaatccggggcgcgttcataggtgacgcccagcgcggccgggttcagcgggtcgctgccgatgccgagaccgagggcatagagaatgctgtcgcgatggtcatagacctgctcgaccggcgggaacgtccgcgcgagcaggcggtcgtgatcgatcatcgtttcctcccggacggttgatccgtcttatcaggctcaatttgagcaagctcatcatgccggcgcaagcagccggtagcggagggggctcagccggttttggaaaagccgagctgcgccagcagggccggatccaggccccagtcggcaagggcggttgcggtatcggcccccggcaccggcggcggggcgggcaggggcgtgcgggcctcggcgaagcgcggggccggcgccggctggaccacgccgtcgcgggtgacgaagatgccgcggacacggttgtgggggtggtccggtgcttccatgggcgagagcaccggcgcgaagcagacatcggtgttctcaagcagcgcctgccaatgggcgcggggccggcctgcgaaggtctcggccaggatgctgcgcatccgcggccagtcctcgcgccggttccggtcgccgatcgccgcgggatcgagccccagcctgtccagcagcagggcccagaatttgggttccagcgcgccgatggtgatccagccgtcatcggcacagcgatagacgccgtaccagggcgccccgccatccagcttgttgtcggcgcgtcggtccgaccagaggccggcggcgcgcatcgaaaaggtcatcgccatcagtaccgcggtgccatcgcagatcgccgcatcgaccacgtcgccccggccggtgcgggcggctttcagcagggccgtgaccatgccgaaggccagcagcatgccgccgccgccgaaatcaccgacgatgttgagcggcaccggcggcggccggtcggcatcgcccatcgcccagagcgcacccgagagcgcgatgtaattgaggtcatgtcccgcggcggccgcagcggggccggtctggccccagccggtcatccggccatagaccagccggggattgcgggcccggcagatgtcggggccgaggcccagacgttccataacgcccgggcggtagccctccatcatcgcatccgcgcggtcgatgagggcaagggccgccgcgcggccggcatcggtcttgaggtcgagggcgacggagcggcggccgcgggcgagcacgtcggtggcggcccccggccgcatgtcgcccgcccgctcgaccctgagcacctcggcccccatgtcggcgagcatcatgcccgcgaaggggccgggcccgataccggcgaactcgaccacgcgcagccccgcaagagggggcgcgcccggatcagtctcggtcatgtgtgatacccgtgcggggggccggttcagccccggttgcacgccttcagcaggttctcgcggacgagatccagacggtcgcgcatgaaggcgacgtcctcgtcgctcatgcctgcgaaggcgatcttgtcgacctcgccgatgcagcgggtcaggaacttgaccgccggcttggcgaggtcggtggcgaagaccagcttcgcccggcgatcctcgggatgggggcggcgctccacgaagccgcgttcttccagccggtcgatcagcttgccggtggtgacggtcgcaatctccagccggttggcgagttccgactggctgagcccgttctcgcgcaacagatgcaccagaacccagccctgggacatggtcagatcatgcggcttcagcagccggtcgaagatcagcgcacgaaagcgtgcgatgtcctggaagacggggttgtccttgtctgctttggcgcgggccttcgacatgcgtgtcattccggcagagggctttcggagaggagcggtccccaatctatggcgcagcggcgggggcggcaagcgaccggcccccgatgttgcagaccgggttggatcgggtggggcggaggatcagacgggatcccacgagaagacgtcgcccgaacgttcgagcggggtgaaaccggcgcgcatggccggcagcgcgtgggagagcacggtctcggccgtccagccttccgagcgatgggccgagcgcaccggacgcggctggctcatcaggaagatctcgttgttgcgcacggtgaagatctggccggtgacgtcggccgactggtccgagagcagggccgcgaccaggggcgcgatcttgttcggcgtcatttctttgatccgttgcacccgtgccatctcggcctcgttggtcaccgggatggtgccgatcagccggctccaggcgaagggggcgatgcagttcgaggtgacgccgaagcgggccatgtcgagcgcgatcgaccgggacaggccgacgatgccgagcttggcggcggcgtagttcgcctggccgtaattgccgatcagccccgaggtcgaggtgaagtgcacgaaacggcccgagccttgctcgcggaaatggcgggcagcggcataggaggtgttgaacgatccgttcaaatgcaccgagatgaccgcctgccaggcttcgggggtcatcttgtggaagatcatgtcgcgcaggatgccggcattgttgaccacgccgtcgatccggccgaactggcggacggcggtctcgatcatcgcctcggcatcgtccagctgcgagacgtcgccgaaatcggcgaccgcttcgccgcccgcggcctcgatttcgcggaccacctcgcgcgccggcgcatcgtcggcaccgtcgcccttgtccgagccgccgaggtcgttgaccatcaccttagcacccttggcggcgagcagaagggctatgtcgcggccgatgccgcgcccggcgccggtgacgacgacggatttaccttcgagcatgcgtctcctccctgatcgtgtgttttctggcggaatacagccgttttccgtattcaattagcatgatcataatatgcttgattatgcttttcaagctgcctaacctcgatcttgcccggcaggcagacacgaccgccggagaaaaaatgccagggaggacgtctgggatgttcaccagacagattttcacggaggagcacgagcttttccgcgaacaggtgcgccgattcgtcgagcgggagatcacccccaaccacgccgcctgggagaaggccggtgccgtcgaccgcgacgcctggaggaaggcgggtgaggcggggctgctctgtgccgccatgcccgaggtctatggcggtgccggtgccgacttcctgttttcgatggtggtgatggaggaactggcgcgggcgggggcgatggggcccggtttctcgctgcattccgacatcgtcgccccctacatccttcattacggctcggaagagctgaagcggcactggctgccgcgcatggcacggggcgaggcgatcggcgccgtgggcatgaccgagcctgccgccggatccgaccttcagggcatccgcaccacggcggtccgcgacggcaacgactgggtgatcaacggccagaaggtgttcatcaccaatggcggcaattgcgacctgatcgtgctggcctgcaagaccgaccccgccgcgggcgcaaagggggtgagcctgatcctggtcgaggccgaccggccgggcttcaccaagggccggctgctcgacaaggtcggctggaaggcccaggacacggccgagctgttcttcgaggatgtgcgcgtgccggccggcaatctgctgggccgcgaaggccgcggcttcgtgcagctgatggagcagctgccgcaggaacgcctgcttcaggcggtccgggccgcggcggcgctggaggcggcgctcgactggacggtcgcccacaccaccgaccgcaaggccttcggtcggccgatcgcccagttccagaacacccgcttcaagctggccgaggtcaaagcccaggcggtggtgatgcgggtcttcgtcgaccgctgccttgagatgcatctgaagggtgagctggacgcggtcgatgccgcgctcgccaagatggtcagctccgaaaccctgttccaatgcctcgatgtctgcatgcagatgcatggcggctacggctatatgtgggaatatccgatcgcccgcgcctgggccgattcccgtgtcggccgcatcgccggcggtacgggtgagatcatgcgcgagatcatcggccgcgccctggtggggaggtcggaatgatccgcatccccgacctgttgcgcaaatacgcggccgcagcccccgatcgccgcgccctgcatttcgaaggccgcgatttcacctggagccagacgaatgatcgtgtgcaccgcatggcatcggtgctgcacggtttcggcgtcggccccggcgaccgggtcgcctttctgggctggaattcccactggctggtcgagacttatctctcgccctcggtgatcggcgccattccggtgccgctgaaccaccggctggggttccccgaactggtggggctgatcgccgactgcacgccgaagatcctgatcgtggaccgccatatggccgagaccggcgcccggctgatggcggcctgtccggcgctcgaccggctgatcttcgccgactgggacggcagccatccggccctgccgcccggcacgctctcttacgacgcgctgatcaccgccgggccgccggtcgccgaggatcgcttcgaccatctggcctcctgcgacggtgacacgctgatcctctattacacctcgggcaccaccggcgtgccgaagggggtgatgctgtcgcatctgaaccttttcgccaatgccgccggcaccgggccgctctacgagttctcggcggaggacgtgctgctgctctcggggccgctgttccatctgggcaccggatcgcgggtctttaccgccctggtcttcggcgccggcatggtcgtccagccgcgcttccgggtggaagagaccatgcagctgatccaggactgccgggtcacgaccgtcaccctggtgccgaccatgctgcggatgatcctggaccatcccgagttcgaccggttcgacttctcgtcgatccgctgcttcacctatggcgcggcgccgatgccggtgcgcctgatggagcgcgcgatcgagaaggtgccgggtgtcaccttctgccagggctatggcatgaccgaggcctcgccggtgctgtcggtgctgacctggaaggatcatgtgccgggcagccgcttcttcgacaagctgggctcggtgggccggccgatccattacggcgatctgcgcatcgtcgatgccgatggccggcagctgccggtgggggaggtgggcgagatcgtcatccgcggcccccaggtcatgaccggctactggaaccgccccgacgagaccgcgcgcgccatccggaacggtttctaccacaccggcgatgccggctatctggatgaagacggctatctgttccttgccggccgcaccaaggagatgatcatctcgggcggcgagaacgtctatccgatcgagaccgagaactgcctgtcgcgccatccggccgtggcccaatgcgccgtcttcggcctgccggacgagctgtggggcgaacgggtgcatgcggctgtggccctgcacgatggcgtcgaggccgatgcggccgagctgatcgcctggtgccgcagccagatcgccgacttcaaatcgccgcgcagcattgacatcttccgcgagccgctgccgctgtcgcccaccaacaagatcgacaagaccctgttgcgcgcccgggcgctggcgccgaaggaggaggcatgaccgaaccgctcccgatcgagcgcaggggggcggtcgcgatcctgcgcatgcaggatcaggccacccgcaacgccctgaccgatgccatgaagaccgcccttgccgatgcggtggccgggctggaggccgatccggaattgagggcggtggtgctgaccggcacgggggccgcgttcagctccggcggtgacctgaaaggcatgctcgcccgccatcgggcggccggtggtgcgggcgagagccccgagagcatcgccgggcggttcgaggtgctgcatggctggctgcgccggttgagggatctgccggtgccggtgatctcggcggtgaacggcgtcgcctatggggcggggttcggcctggcgctgaccgccgacatcgtgctcgcctcggaagaggcgcggttctgtgcctcgttctgcaagctgggtgccgtgcccgatttcaacctgttctgcaccctgccgcggatggcgggggtgcagcgtgcccggatgatgttcctgaccggtcgtgagatcgacgcgcgcgaggccgaagcctggggcatcgtcatggaggtgacggcaccggacgccctggaagagcgggcgatcgccatggccgaggccctggcgctcgcctcgccgcttgcggtgcgctggaccaagcaggtgacgggccgggccttcgatctggacggcgaggccctgcttgcggccgaggccgaggcccaggccgactgcctgaccagcgcctatcatctggaggcgctggagcgcttcacccgcaagctgccgccgctgtttccgggcatctgagaaacgatcgtctgcctgacaaaaaagggccgctccctgtcgccggggagcggcccttgttcttgtgtgtgccgtcagcgcatggtcagcggcacgatcagcgagatcgacgggatggcgatcagcagggccagaaccaccagatccatggccaggaagcgggtgatgccggcgaagatccgcccgatctgcaccttgtcctcgatcacggccgcgagcacgaagacgttgaggccgaccggcggcgtgatcaggccgatttccagcagcttcacgatcaccacgccgaaccagatcagatccatgccgtagctttcgaccatcgggatcatcagcggcagggtcagcaccatgatgcccacggggtcgagaaacatgccgagcaccagatagatcaccaccactgccgccagaaaggcccaggggccgaattcggcggcgcccaccgcggtgaccatctggttggacaggccggtcagcgagatgaaggcgacgaaggtcttggcgcaggcggcgatgaagaagatcgcggccgtggtcttcgcggtctcgcgcatggtgggcacgatgtcggccagccgcatccggccgcgccccagcccgaccagggtagcgaagagcagggtgagggcagcggcctcggtggccgtgaagatgccgccatagatgccgccgaccacgatcgcgaacatcaccaccgccggccaggaccgggcggcggcaaccagcttctcgcgaagcgggatggtctcggccggcaccggcgcgatcgacggatcccgccgcacccagatcatgatcgcggccgcatagcccgccatcgacagcagcccgggcaggatgcccgccaggaacagctgattgatcgaggtttcggtgaagatgccgtagatgatgaacagcaccgagggcgggatcagcgagcccagcgtgccgcccgccgccacgctggcggtggcgagccgcggatcatagttcaggcgcagcatttcgggcgtgcagatccgccccatggtcgaggcgcaggcgatcgacgagcccgagatggccgagaacccgccgcagccggcgaccgaggcgatggcgacaccgcccggcaggcgcaccagccagaccctggcggtttcgtagatttcggtggtgatcccggcccgatgggcgacgtgaccgagcgcgatgaacagcgggatcatcgacaggtcgtagctgtgcaccagatcgtaggtgctggcgaaaatcagcgacagggtggcgcggatcgcgcgttcgggcatgaagttgccggtccgccaggcgaacagcaggaagatcgcggtcaccgcgacgccgcccagcgcaaacgagatcggcacgcgcagggcaagcagagagagcatcacgccgaaggcgatgatgccatagatccaaagctccattggtcagttcccctgcggatcggtgcggggcgtgtcctggccgcgcagggcggcggccagatcgatcgccgccacgtgcatcaggcgcagcgcgaacatggtgagcgcgatcacgaacagcgcccgtcccggccattttggcaggcccagatcgccggtgaacagcgcgccgctgccgaaggcatcggtgaattcgcgccagcccgcccagagcagcggcagcacgatcaccagcccgatgagtgctgccagcaccgccatccagcgcgccagcgccggggggaagaactgggccaccacctcgatcgcgacatgggcgcgcgcggcggtggccgaggcgagggggaaaaggattgccggcaccatcagctcgcgcaccagcaccatggcgtcgggcacgccggcgccgaagaagatgcggccggcgacattggcggtgatcagcagacagagcgccacgaccgaaagcgtggcgatcgtgttcatcagggtttcgatgcgggtcatcatccgcggggcctccgggccggccggctgcccgccgccggggaagcgtgacacgcttccggcagcgggcgccggtctcagccgcgctcccagggatagccctgcgtgtcgcggatctttgcccatttgtcgagcagtcgcttgtactcggcaagcagcgcctcggcatcgaagcctttggcggtggcggaggccttccactgcgtgatcaccggctgggcggcctccaggatccgggcatcgtcttcggcgctgagatcgtagatgaccactggcttttcgcgggtggtcatctttttgatcgcatcggcatcggccttgctcagccgttctgcgaagtggtcgatcacctcggcacgcagcccctccagcaccttgcgatgctcgggcgacagatcctcgaacacatcgcggttcatgaaggtggcgacactgctcgccgggctgagcttgatcggggtcaggctgtcgagcatttcgtccagcttggtcgcgaccgcgaaataggcataggtgggggtacagtcgatcagcccggtctccatgccctggaaggtgtcgtagatcgacatctcgaccatgttgccgcccagcgccgagaagaccggcccgtagacgccgccatagcgcatcttcatgcccttgacgtcatcgaccgtggtcagcgcgtcgttgcggcagccgatctgcagcggcgaggtcgcatagatgccgagataggccaggttcttgtccgccagcgccgtctgaacggcgggataggacgacaggatctcgttcatcgcatgcatggtgacccagggatcgcgctccgacagcggcaggtcgcccatatacagctcggggaattcggattcgagataggacccgacgatcagcccgctatccgccacgccgtttgagatagaggtcagcgcggcattggcgccgaacagcgccccgccccaatggatgtcgaaggccagctcgccgccgctgcggcgcgcggcctcgccgatccaccattcggtggcctcggcacgcacgccgcggttcggcccgggttcggcatggatcagacgggtctcggctgcggcgggcagggctgccgcaagggtgcaggctgctgccagaaacggcccggcaagacgtttcatctgtttcctccctcatttttttaagccgtcgcgtcagatggttatccgcgcgtcggatcagaaaaagatattaagctaattatcatctagcaacataaattgtcgcgaatacgccagggaacgacgatccgggcgagcatgaaaaacccccgccggacgggccggcgggggcatggaatatcgggttgggaaggaccctatggtcagtgggcgccggtccggcgatggccgcgttccagcagggccttcaccaccagcgtgaccagcgccagcagggccagcagcgacgccacggcgaaggcgcccacatagtcgtactcgttgtagaggatctcgatatgcaggggcatggtgttggtcaggccgcggatatggcccgagaccaccgagaccgcgccgaattcacccatcgcccgggcattgcacagcaggatgccggccagcaggccgttgcggacattgggcagggtcacccggcgcatgatggtgaaccagccggcccccagggtcagcgccgcctcttcctcgtcgcgcccctgggccagcatcagcgggatcagctcgcgggcgacgaaggggaaggtgacgaagatcgtcgccagcaccagccccggcaccgcgaacacgatcttgagcccgtgcgccgcaagccagggcccgaaccagccatgggcgccgaacagcagaacccagaccaggcccgaaatcaccggtgagaccgaaaacggcaggtcgatcagcgagatcagcaggttgcggccgcggaagtcgaagcgggtgatcgcccaggccgcggcgatgccgaagatcagattggcgggcacggcgatcgccgcgaccagcagggtcagccggatcgccgccagggcatcgggttcccggatcgcctccaggaaggcgccggtgcctttcgcgagggcctgtgcaaagacgctgcccagcggcagcaccaggaaggccgccaggatgccgagggcggccaccaccgccaggacgcgaaccggtcggctttcggtcagcggcaccgagggcgtgggggtattggggatgtcggtcatcggttcacccctccatggcccggcggcggcgggcatccaggccgttgacgatcagcagcaggatgaacgaggcgatcagcatcacggctgcgattgccgaggcaccggcataatcgtactgctccaggctggtcacgatcagcagcggcgcgatttcgctgaccccgggcatgttgccggcgatgaagatgaccgaaccgtattcccccaccgcccgcgcgaaggcgagggcaaaaccggcggagaggcccggtgccagggcgggcaggatcacccgccacaggatctgcccgcggccggcgccgagcgaggcggcggcctcttcgacctctcgatccagatcctccagcaccggctgtacggtgcggaccacgaagggcaggccgatgaataccatggccaggatcacgccggccggcgtgaaggcgatccggatcccgatggtcgcgagcggtgcgccgatcagcccgttgggcgccgtcagcgcggtcagcgcgatgccggcgaccgccgtcggtagggcgaagggcaggtcgaccatcgcatcggccagccgtcgcccgggaaaactgtagcgcaccagcacccaggcgatcagcagtccggcgacgctggagagcgcggccgcgatcagcgcgccgccgaagctcagccgataggcggcaagggcgcggtcagagaaggccttggccaggatctcctccgcccccagacccgaggcgcggacgaacacggcaacaagcgggatcagcacgatcagcgacaaccaggtcagcgtcaggccgagcgccggcccgaaccccggcaggggcccggcaccggcgcggacgctgcggccagcaacggcacgcatgacgcctagttcttcgccacgatctggtcgaagatgccgccatcggcgaaatgttcggcctgggccttgcgccagccgccgaagacctcgtcgatggtgaacagcctcacctcggggaaagtggcggcatggcgggccgcgacctcggcgttgcgcggacggtagaagtgccgtgccgccagctcctgtccctcgggcgtatagaggaagttgagataggcctcggcgaccttgcgggtgccatgggcgtcgacgacgcggtcgaccaccgccaccggcggctccgccaggatcgagagcgagggcacgacgatgtcgaaggcatcggggcccagctcgttcaccgccagcagggcctcgttctcccaggccagcagaacgtcgccgatgccgcgctggacgaaggtggtggtggccccgcgggcaccgctgtccagcaccggcacattggcgaacagtgccttcacgaagtcgtgggcgccggtcgcgtcccggccctgatcgagcgcatagccccaggccgcgagatagttccagcgcgccccgcccgatgtcttggggttgggggtgatgacctggatccccggcttcaccagatcgtcccagtccttgatccccttgggattgcccttgcggaccaggagcacgatggtcgaggtgtagggggatgaattgtcgggcaaggccgtctgccagtcctggcggagggcgccgccattatcggcgatggcatcgatgtcataggccagcgccagggtcacgacatccgcctccagcccgtcgatcacgctgcgcgcctgtttgcccgatccgccatggctctggcggatggtgagggtatcgccggtctccgcctgccattttgcggcaaaggcccggttgacctctttgtacagctcccgggtgggatcgtaggagacgttgagcagctcgatatcggcggcgtctgccgggacgattgctgacgatgtagcgatggtcgcggcaatcagggccgcccttgcgatgtatcgcaaacctcgtgtgggacggatgtcatggttccgggtcatcgatcggggctccggtagaggcgggacaggtatcccggacttgatcgggggcgagggcgatggccggatccgaccgcggtgcggatgcctgccttgcgatgtccatgaggccgcagcgccaaaagggaatcaagtctatttttcatatagactatatgaaaattaaattttaacaaaaataatatgttatttatgagcagaacaatacccgccggagaccggcgggcatcggaggccgctggctgatgccggatcaggcgccgtgggtgatggcgcgcagatcgatgtcgatatcggcgctatggctttcgaaggtggtcatcagccggcggaagcggggggcgttgtcgcgataccagcgcacgatcatgggcagatcatccagcaggttacgcctgggcccccagccgagttcgcggatcttggtgctgttgatcgcgtagcgccggtcgttgaatggccggtccggcacgaaatcgaccacgtcgtccagcttgtagccgaaggtctcggcaatcatgcgcgcgacgacgatgttctcgaactcgtcttccgagccgatattgtagatctcgccgatctcgcccttgcgcatcagcagggcgatggcggcggcgaaatcctgcgcggccaggaagtggcggcggttgttgcccgtgccgtggatcgtcagcttcttgccgcattccagcagcagcgagaagcgcgggatgatcttctcggggtactgacggatgccatagatgttgttcccgcgcacggtgacgatcggcattttgtacgaatgcagatagcccgagatgatcatctcggcgccggccttcgatgccgaatagggattggtcgggttcagcaccgtgctttcgtcggcggccccgtccagcacctcgccatagacttcgtcggtggagacgtgaacgatgcgcttcacgcccatccgccggcaggcttccatcatcgcatgggtgccatagacattggtcatggtgaagagcagcgagttgccgaaggaattgtcgacgtggctttcggcggcggcatggatcacgtaatccgcaccgtcgaccacccggcaggccagatcgaaatcgcagatgtcgccgaccacaagctctatgcgctcgctggtcgccagctcctggatgttccggaaatctgccgcataggtcatcttgtcgaagacgaccacgtcatgatctgggaactgctcgcagatgtggtcggtgatatgcgacccgatgaagcctgcgccgccggtgatgacgatcttcggcattatccaagagcccttcccagattgtagcagtagctgatgatttcgtcggccgtctgtctgaggccggtttcacgaacgaggcgcgagacgtccaggcggaaggcgtcggcatggcgcggatcgatgatccgcagctgccccctgccatgtccgcggatcacggcaagggcaagctcgccacacatgatgccggttcccgaggacagattgtacgtgccggtcaggcccagttcgacgattctgccgagctgggccgcgaaatgctccaccgtcacgaagtcgcgcgagacgaacgggctcatgtcgaacacgatttcacccgtgtcggcaagcgtgttcagcatgaaccccatgaagctgcggcgtccggggatgcgctccggaccgatgacgttgccgatgcgcaacaccgtgagccgatccgcgggcagcaggtcgcgcagtgccgcttctgctgcaaccttgttgcaaccatagacgtcgaggccggacagcggagcgtcttcggccgcgtcctgctgtgcgtcggcggagtagaccttccgggaactcagcatcacatagcgcgcctgcgttccggccatgcgccgggccaggcgaagatctacgtcccgttccgggtcgtgtggcagtcgcatgtcgtcggggtggcgggcgaaattcaccacgacgtcgatcccgtccatcaggtcgggtgcgtcgatgtcgctatgccgcgcgatccggaatgatccgccggatatggctgtcccggtgaaggcactggcgagcagacttccgccgccgaagacgagaatgcgcatgcgaaatcgttgctccagcctctgaaaatgcaggtcgacggaccggctccatgattaacacccggggcggccgtctccaacgggaaatccgcagggtgggtggcggaatgcatggctgctatgtcgttaaccggtggttttttgcgtgatcctcgcgccgaggtcgtctaggcgtatggttaacaatctgctaccgtcgccgacgtgatggcctgagctgtcaatcgggactccgttaatcccccgttcaggggatttgtgcgctgcggaaaccgggttggctgtgagggacatgcgcggtataagttaaacaatcaatgcagtgcgggccgggcggtgcatccgacgatggatgatgcctccggaagtgaccgccccgaccaggatgatggaccgtcttcgcttcaagggcgacgtcgatgaaggcgttgtacggttcggcggtcgggtgggcataataacgtcaagcgggcaagcatcatgacggatgtcaacaccagccacgtgttcgaggcgagccttgatcgcggcgtggttccggcgaccacgaccggggctcgtatcttcaagcgcgcattcgatatcgtcggcgccgcgacgctgctgctgctgctgtcgcccatcttcctgatcctcgggctgtgcgtcgcgaccacgaaggggccgatcttctacggccacgagcggctcggttatcgcggtaaccgcttcaagtgctacaaattccgctcgatggtcccgaatgctgacaagctgctcaaggatctgctcgcccgcgacgccgaggcgcgtgccgagtgggagcagttcgaaaagctgcgtaaggatccgcgcatcactggcatcggtcgcatcctgcgcaagaccagcctggatgaactcccgcagctgtggaatgtgctctgtggtgatatgagtctggtcggtccgcgcccgatggcgctgcacgaaacctcccgatggggggcgagcctgattgagtacacctcgctgcgtccgggcattaccggtctctggcagatcaatggccggaccgacagcgagtacggttcgcgcattgccttcaatcgcacttaccttgagagctggacgccgcttctcgacttcaagttgctatttcagactgtgcgggtcgtgttctcccccaacagcggtgcttattgatctatccacggctttgacttcacgacaatccgtgacaagtttgtgagggcctgcttcgaagggtcggggcaggccttttcgacgtcttgaggcgcttcacatccgcggacgtcctcgctaccttcctgccgatgatctccacagacggggccgtatgatatgactgtcctcatcaccggcgtagctggtttcatcggctcgcatgtggcatctgtactccttgatcggggggaggaggttctcggcatcgatgacttgaatgactattatgccccatcgctcaaacaggcgcgactcgacaggctgctcggacgccgaagcttcatcttccggaagatggatgttgccgagcgggaggcgatccggagtttgacggaacatgcgccacaaattgaccgcatcgtccatctggcggcacaggcgggggtgcgatactccattgaggcaccgcacagctatacccgagcgaacgtcgaagggcatctttgccttcttgagcttgcccggcacctacccgaattgaggcatatggtctatgcgtcctcctcctcggtctatgggggaaacgcgcagctgcccttctccgaggcggatcgcgttgacaccccgctttcgctttatgcagcgaccaagcgggctggcgagttgatggcatatacctatgctcatctctacaaactgcccctgacgggccttcgcttcttcacggtttatggcccatgggggcgacccgacatgtcagcgtggttgttcaccgacgcgatactgagtggtcgtcctatccgggtcttcaatgaggggcggatgcggcgcgacttcacgtatatcgacgacatcgtcagcggcgtgatctccgcactcgacacgccgccggtacgaggggcgggggccgacgcggtcccgcatcgcatcttcaatctgggcaataatgcgccggttgcgctcaatgacttcatccgggccattgagacagccacggggcgtgaagccgtgaaggttctagagccgatgcagccgggcgatgtgccggccacatacgcggatatcgaatcggcgcgcgatctcctggggtttgagcctctgacgtcgattggcgatggcgttcgccactttgtcgactggttccgggcgtatcacggagtctgacccgagatgaacagccgcgtgcaggacatgtccgacccgtttctgtctccgatcttcgatgaagcagatcccagtcgagccgtcctcggggtcatcggcttgggttatgtcggcttgcctctggccgcagccttcgcgttgcgtggccggcgtgtcattggctacgatctgaacgcagaacgagtcgcccggatccgggctggcattgatgagaccggtgaagtggcacgtgttgacctgcagcgcgcccttgactgtggcctcgtgccgacggccgatcccgacaagctggctgaggcgcggatcatcatggtctgcgtgccgaccccgatcactcgggacaggcggccggatcttggtccgttgcttgccgcctgcgcgattctggggccgcgacttgcgcgcggaaaggtggtgattttcgaaagcacggtctatccgggggttaccgaggatgtgtgtgggcctgcccttgccgaggcatcaggcctggtggtggggcaggacatattgctcggctactcgcccgagcgagttaatcccggagataaagctcatcgggttgagacaatggtgaaggtcgtcgccggacagggggaggccgtcaccagagcgctcggacagctctacggtgagcttaatggcgaccagattcattatgcgccttcgattcaagtcgcagaagcggctaaagctatagaaaatgcgcaacgcgatatcaatattgccttcgttaacgaagttgcacttatttgtgagcggatcggtttatctgtgcatgatgtgcttgatgcggctcggacgaagtggaattttctcgatttcaagcccgggctcgtgggtgggcactgtattggggtggatccctactatcttagctatttgtcgcagtccatcgggcacgagcctgatgtaattctggccggccgacgcctcaacgaccacatggccgatgaggtggctgacagaattgcctttcggtttcgggaagtttcgcagcctgtccgtcggccttctgccctggtactgggggcagcatttaaagaagatgttcccgatctgcggaattcccggacccctcagctggtgcggcgtttgtgtcggcatggatttcaggtggaagtgcatgatccctggttcgatcccaaggacctggcccgggcacaggacctgacagccacagcctggcccggtaaagcgtttgacctggtggtaattgcagtggggcaccgagcctttctggagcgctcgccagaggcgcttcttgctcttgtttcgccaggaggaatgatcgccgaccctaaaggactctatcgtaacgtccgatggtcttcacccgtcaactattggacgttgtgaaggcgtcagccgcggatctcacagttcatatcgtcggtgtagtaacagttttttttaccgcattgccgttctgtcagcatgtgctagggtgtaactgcccatccaaggctggcgaggaatggcgtccgatgacgaggctcaggcggtctaaaggatgcgaccggcggctggggcgacgagatccagaacatacagcatcgaacctgccacgggacgcagcatgaccctcgactccgcttcgctccgcgaaattcttcgtgggagacctggtgccgccgttcggcacttcgcaattatgatgatggcggtggccgttggtgcactggtgctcgccgctcccggaaattcacgagcgcaaacgctttttgatctccaaagtcagattgaatccgcgacacaggcgcttcagagtggcggtggtctgacggataaccgtgacgggacggccgatacctctctcgatcctaatgcgacggatcgttcggaaggggccgatgaagaagacgacgatgccaacaagcgccgctctgctgcggacgaggcggatgagccccgtctgggacagtttggtgatccctcttcaatcgaacgcgattatgcgctgaggaccggtcgcgcgatcagccagtacgggtaccgtgttttccgtcaggctgcgcgcgcgccgatcacgtcaggtgaaatcagtcccgactatgtgctgggcatcggggacgagttgatcgtcacctaccgtggccagacctcgcgcacggtcagtgttcaggttaaccgcgacggcgatattgtgcttccggaaacgccgccgctgaaagcggtcggctctactcttgcggatctccgggagcgccttcagcagatcaccagcgagattatggtgggaagtcgcgtgttcgcgacggtcggtagcgtgcggttgatcagcgtgtctgtcctcggcgaggtcgtgcggccgggggccaggcctgtgaacagctttgcgacggtggttgatgccatcagcgcggctggtggcgtgattcgatccggctcgttgcgccggatcgagctggttcgcgcaagcggcgaacggatttccgttgacctgtatgactacctcagcggcgctggcggtgctgcgaccgagccgctgcaggatggtgatcgtatcgtggtgccgctgctgggaccgacggttgccgtggatggcgatgttgcacggccgggtatttttgagacggcgcctggtcgttcgagcatggctgtaacggaggctatgaaacttgccggggggcctttgcggccggcgggcaaccgtttcatgcgcatttctttcgacaaggagggcgttcagtccgtggcgtcgactgacgctcgctcggggacgctcaatcgaagcgaaatcttgcaggtgttcatcgatcgcaatgtcgtcggtggcacgatcacggttgaaggcagcgtttccacgccgggaccgcgtgccatcgacagtcgcggaagcctgaaggttctgctcgaaaatctcgatttgctgagcggttctccttacctgccctttgcagtgatccgtagccgcgacccgagtacgttgctgccgcttttcattccggtcgatcttgtgaacgtgcttagcggtaatcaagacgtcacgctctcgtcgggggaccgcttcatcgttcttggtgcacaggatatttcgttcctctccagtccgggggtggctggcgcgctgtcaaataccggaggcgcctgtccggcgctcgcgtcacttgccagcctcacgtccaggacgcgagccgacagcttcatcagcgcacgccagttcctggtacagggaggaacgtccacccggcctccgcagaacgtgaactgtccggcaatttatgatcagtatcccaatcttctcccgctgctgcttgaaaacatcactgccgtgaccggtgatgtcaggcggccgggtctctatcccatcgttcagccggttccgctgcgccttatgctcaatgcggcggggggcctcgggcgttcggcagacatttctcgggtagaggtcacccgctacgatgcggcggtgggagcgcagaccaccactgttcgacgcgaagtacttgatctgacgcaagtaagcctggacgcggtaatgatccggccaggcgataccgtgcgcgtctcgactaggatcacgactcgcgaacaggggctggtcacggtgcgtggcgaggtcctgcggccaggcgcctacgacatcactcgtggtgagcgtctgtccgatcttctgacgcgcgctggcggcctgacctcggaagcctatccattcggcgcgatttttacgcgggatcgtgttcgaaacctggaacggcaggcaaatcgccggactgcggacgagttgcagaagggcatcgtgtctttgctggcacggcaggcacagcgttcctctggcggcagcggcattgcagatgcaatgcgggtcgtgcgtgagctggtgagtgatctgacggcggttgagccctatggtcgggtcgtggttgaggctgatcccgcagtgctgacggcacgcccggagctcgacacggtcctcgaagggggggacgaagtcgtcattcccaagcgtccgaactatgtcctgatcgtcggagaggttctcaatcccggtgcacagcagttccgtagcgggctgagcgcagctgactatgtgaagctggccgggggatacaccatggattcggacgaggggcgtgcgttcgttgttctgccaaacggtgcagctcagccgacgaaccttggttcttgggcgacgcaggatgcgaatgttcctccgggctcgatgctcgtgatcccgcgtgacctggctccctttgacttccttgctgtaacctcagatgtgacgcgtatcgtcagcagcctggccctcactgccgcggcacttaatgcagttcaaaactgaggccataagacagtgaaggtgaagggcgcgtatctggtggtggtcaacgttctgttggccaccacctttgcggcaggaaacgcaacaacggcggctgcacagcaggtgcgggaagccgggaacatttgggagaagccacttctccctaatgtttccgactatgggggtattggagcccttcagacacccaccgcgcgcttcggacaggacggacagtttctggtcggtatctcccttgtatcgccctatcatcgttacttcattaatctgcaggcgttgccatggttggaaggaaccttccgttatacacggattactgatcgaccttacagttctctggacgggtttgcggacgggcaggattataaggaccggagtgtcgacattaaggttcgtctttctcaggagagtaaagattggccggaaatcgctgtgggctttcgcgacctggggggtaccggactcttcggtagcgaatacgtggttgcgtcaaaaaagttcggcgaatttgatgtggccggcggcctgggttttggcgcgatgggaacccgggcgcatttggacaatccgctgggcatcttttttgaccgctttgacaaccgcgtcggaggggcggattctccaggcggagttggtaccgcgttctttaccgggcctatcgcactctttggcagcataagctacctatggaaagatgttcctctactggaggatgatctccgctttacagtagaatatgacccgaataattacaaagatgatcctgccttctcggatctgacaccaaagtcgcccttgaatttcggcgttacctggcagccggcgagctggatacaggtggcagccggctttgagcggggtgatactgcgatggcacgggtctccttgtttgctgacttccacaatggctttaacccgctcatggataaaggcgtcccgccggagatcagcatgcgcggccgggagggcccgcaaggtgtgtcgccggagagggcaatcgatccggcgccgacggcggcggcttggcttcccgagcttgcggaagcgagcgtaagggctgcggcggccggctaccagatgaccgttctccgcttcgagatacacgacgacaaggctttgctggatcttgcgggggggattccggggcgggatctgggggacgcctttgatatggcagttgctgcagcgaaggccgtgccgtcagaggtggagacgatacacattcgccttatggcgtcgaacaaagcgccgttggtaacctggaccgcggcaaagagcgacctgctgaagggggaggcggcatcgtccatcggatccgcttccgctgataccggcggcggcgctccgaccctggtgcggcagcctgcggattccggcaagattgctgaacgcctgttcgctgtggcggaggagaatgacgtcgtcatcgatcggctggaactgaacggagatacggcgcggatttttgtcggcaacatgccgttccggaactttgtgacatcggcaggtcgcgtggctcgggtcgcaacacaggctatgccggctgaaatcgagcggctggctatcgtgcttggtgatgacgggctgccggtgcttgagttgacgattttgagaagccacatcgagcgccttgggaaagacgaggcgacgcctgaggaaatttggcacaaaagcctcattgcgcaggcagctccaccttcagatgatgctgtactgaacacgagtcagtttcccgcgttcgattggtcgatagcgccccgcacccggcagcagatcggagggccggacgccttcctgatctatcagttgtatatgcgggctcaggcatcgatccgccccacaccgggaacggagatcgatggttatgtgggtatgaacataaccaacaactatgacgatcttaccctcgaatcggatagccgattgccgcgggttcgcagtgatatcaagaactatctcaaagaaggggaaacctggatcggtcgcttgcagggtgcctattatacgtcacttgcacctggtctctatgccacggcgtatgcggggcttctcgaagagatgttcggcggtgtcggcggtgaggttctctacaagtcgatcggatcgccctgggcatacggagttgatgtgaattgggtgaagcagcgcgattatgatgggatgtttggcttccgtgactacagcaccgttaccgggcatgtcggcgtgtattatgatttgccgttctggaatctgaatagctcaatccgcgcgggccgctatcttgcaaaagactggggggcgacgtttgaactgtctcgcgagttcgacagcggaattcgggcgggtgtcttcgccacactcacagatgtttccgccgcggatttcggcgagggtagctttgacaagggctttttcctgagcatcccattggatatttatgcgacgcgtcccaccaaaacacgcttcggcataacttataggcccgtcacacgcgacggtggcgcccagctcaaccgctccagcgctttgatcggccgtgtcgccggatacgacgtcgagcatgccgcgaggtattggccggatttgatggactgacgccagcggccggcggcatcgctccgcattaaccatatcagcctcctttatcgcttcccattcggggcaaaagggggggtgacgactgttccgagggcgtaaacatctcgtaatatcaaaaggatcccgcaggtgcggtggtgtgcgtgtggcttgtggcgtcgccaccaacatggtatatggaacgggcacgatcggagcgaacaaccgcgaatgctcccggcgcttggtggtcgggtccgacagtcgcggcttcaagaggcgataagaccgctatcatgactcctcctcatccttcttccatccccgtttttatcctttgcggcgggctcggcacgcgcatcaaggaagagactgaattccggccaaagccgatggttccggtgggggataaaccgattatctggcacatcatgcgaatctattcgcattttggcttcagaaaattcgtcctctgcatggggtataaatcggaggtaattcgcaattacttcctgaatttttactcgatgaacagcgacgccacggttaacctcgtcgacaacagtgtcacctatcaccagatcaaccatgattgcgactgggaagtgacgcttgcctatacaggcgagaagaccatgaccggcgcccggatcgcgatggcgtttgatcgatacatcggggatgcgccgaccttcgccgtgacctatggcgatggcgtcactgatgcagatctcgctgccgagctggcttttcaccaggcacatggcaaggtcggaaccgtgctgggcgttaatcccccgtcacgtttcggcgaattccagatggatggtaatcagctgcaggcattcgccgagaagcccgagatcatccatgcgtggatcaacggcggtttcttcttctttaatcggggtttccgcgagtatctctcgactgacgcgtcgttggtgctggagcaaactcctttgtcgcgcctcgctgcggatggagagttgcatgtctacaagcatggtggcttctggcagtgcatggacacgcagcgtgatcgggagcatctgacggcaatgtgggagcagggcaaagcgccttgggctcataaggactgagatctcgtgagagatgagatccactgcctgcctgcagggcgatgtgcccgggaggtgtggctgccttgcgagcacctgactggcagatcaagaggctggcagaggcagccagcctctggcgcctcgcctgacaggcaatgtgctcaggcatgccgtacccggccgggccgtcaggggcgctggaacatgatcgtgtgatatggaggaggccgggcttttcggccctgccgtgacaataccgaaagggttcggccagccttcgccagaaggctgacatctcctccgaggggcgatctgtcccaccgtctcaatccgcctcatttcgaggcagtcagagagggagccagaagtatgatccccgtttctgagagcgttgtccgggaggcagccccctggatcgccgaaggacgcaggccgaccatcggggtggcggtcatcacctataccgcgaaaaagatgctcccgcactgcctcccgccgttgctcgcctcgccgttgaagccgcgggtgctggtggttaactcatcttccaatgatggtaccgttgagctcgcgcaggaaatgggggccgaaacccttgtggttccccgacggtcttttaatcacggcatgacgcgagaacatgcacgacgtgtcctgggaacggacattgtggtgatgatcacgccggatgcctatgcgacatcgccggatatgattggccacctggtggcgccgatcgtggacgggctggccgccgtcacttatgctcgtcagataccgcatacaggcgcgggaatctttgaaaggttcgcgcgcgagttcaattatccgcctgaaagccacatccgttcctacgatgagcgcgccaggtggggcagctttctctacttctgctcggatagctgtgcagcgtggtccaatcccgccctcgacgcaattgatggcatcggacctacgctgaccatggaggacgccattggtgcagctaagttgctgcagcgtggacatcgtattgcttatgtggctgaagccatagtgcatcattcccacacctacagtctgaagcaggagttcagacgtatgttcgacgtgggatatgagcggcgccgtcagaaggagctgctactgagcagcggcggagatgaagcgcgcggcagccggtatgtgaaagcgctgatgaggcagctgctgcgagaacaaccccatctgattctatatgctgtccttcagaacgctgccaaattggcgggctacaaactggggtaccatgcaatgaatctcccgcgcagctggattcccaggttgagtgggcaggatttctactggaccagtgaagcgtttgaactcagggagggacgcgaatggggggagatcccggcgcgctctccgtcctgaagggaccaggaaactgacaggcggctccgccttgttgcaaagtcgcgctagcgagatcatgccgttgctggggggccgccagctgttgtccggtggcttctgtatcgtttttatcaatgtaccgtcagccggatgcgcttccggcgaagatgcaggagaagacattcgatgagcgtgatcgtgccggtgatcctgtgcggtggcggcggaagccggttgtggccgctatctcggaagtctcttccgaaacagtttttgccacttgttggttcacagaccatgctccaggagaccctgcagcgcgtcgctccgtcggctgggttttcgtctcctgtcctgatctgcaatgaggaacatcgctttcttgtggcggaacagacccgggcgacaggtatacaacctgccgctattgttctcgagccggtggggagaaatacggcacctgccattgcagtggctgcgagggcggttcaggacgtcgatccacacgcgctcatgcttgttctcccgtcggatcacgtgatcggaaaggcggatgagttccgggctgccgttgcggcggctgccgcgtcggcggccgatggtgcctttgtgacgtttggaattcggcccaccggtccgcacaccgggtatggttacatcgaagctggagatgtcgcaggcgacggcctgtttgcgatccgcagatttcatgagaagccgaccctgcagacagcgacggaatatctcgatgcaggcggcttctactggaatagcggcatgtttatgtttccggttgcgggcatattgcaggaactcgacgcattagctccagacgtatttcgagcagccctccaggcctacggagcacgctctgcggatctggatttcgttcggttgtctcgggcggagtttgaagaagcgccggatgtttccattgatgttgctgtcatggagcagacccggcgcggtcttgtgatgccggtcgatatcggttggtctgacgttggaacctgggatgctctgtgggagatcagtccgcaagatgatacgcgttccgttattgtcggcgatgtcataacgaatggcgtcaccggcagttatcttcggagcgaggggcccatggtggcagcggttggtgttgaagacctgatcgtggttgcaacgcgggacgccgtcctggtgtcgtcgctttcacatgcccaggacgtcaagaaggttgtcgagtccctcattctggagcaccgttcagaagcggagacgagcgacacggtctatcgcccgtggggtaattataccggcatcgatcttggcgagcgtttccaggtgaaacggattgtggtggagccggggaagaagttgtcgttgcagatgcatcaccatcgggctgaacattggattgtcgtcagtggaactgcggaagttacctgtgatgatcggacgttcctgctgaatgaaaaccaatcgacgttcatcccgcagggggccgtacatcgcctcgccaatcccggccgaattccactccatttgattgaggtccagtccggatcttatctaggggaagatgatatcgtccgcatagcggatgagtttgggcgtgtagcgggatgacgctgcgaagcgactggagttttgcccggtgaagaagtttagtctcctgcttctgacctttattttgtttaccggcttggcttgggtgatcatcaagcagctgtcgtttgattatgatatctatcgaacgagtgagatcatatatgttgatcaggcatcgattgatagaagccagtccagtggtgctggcggcctcctgtttggcaacacggatgccagcaagcgcatcaccgaattcatccagatcacgcaaggtaagagcgcggccatcgcactcctgaaggagccgtcggttcgacaggaagtggcgtattggcgtagcaaccagtttttgtcctcgcgtcaggtttctccggaggatctgcgccccgaggatgtcgttgcgtttatcaataagtcggtgactgtgacagtactgcatgacagcggcatccttcagctggaatttgtcgcgtcgacgccagagatgtcccatcgctttctggacttgcttactcagtattttattgagttcagccgatccaacgctctggccgggcttcttaagcagagggaggaactctattcggagctctcgcgtgcgacaattgtatccgtcgggcaggcgttgtcgaaccagatctctaccatttcaactcgaattgctctggcaaacgcagacgcgaccttcggaatcaagattctggatgctgcttacacaggccaaaagccagctaacatgagtcccatgattcaggctgggcttgctatttttgcaggcattgtccttagtttcatggtctatatccttatccagatcattaactatgcgaggcgggaagaatctcagtgagtactgcacgagcagctcccatgatgtctggagatggcctgacgcggaacgagtaccgtccctttgcgtccaagatgacgtgcgcggtcttcgtttttctcgtcctgatgaacggcttcgcaggggcgctgcctgttgatgctccggctgcggtggcgctctttgtcgtcgccgcacccgtttattcagttcttgtactcattaacttgaagtcggttccgtatcccaagttttcgctcttcgtgctcgtatccctaatgatctcgctcgcgcaagctagcacaatgtataatcttgcatttaatatttattatgcgagcgctgcactttttatcattctggttttttatatgatcagaaatcgcatgctatcgataactagtatatttcgttatacatatatatctattgcatttgccatatatttttcggtgtttgacttcctgttcttggtttcgcgatctgggggattgtatcggggtacctggggttattctctgttttttgatgataaatcgcattacacggttttcattggcttcttcctttttttgggggccatggttctaagggacattgctcgcgagcgtaaacttcagggcgtctacccctcaatctggttcagccgggtcgtgccgctgtggatcgtatttaattcggttgtcgctctgatgatgtccagcacgacgatgtcgcggctcattgtgtttttcgttcctgcttttgtgtttcaggtgtattacgccgtcgagtgcctgttcttcctgggaaaaagatacgatcaacacaagaaggtctccctcttctatgtgttcacgttgatcttcttgatcatcgggctaattgttttcatcgcagctggtgatgccatcgtcaacaatccgacgttccggcgtgtcattatggttctggaacagcagcaggataattcattcaaagctcatgttctgcttatcgagctcgcaatccgttccaagtttttgagcctcagcaattttatatttggtgttgggcttggcaattaccagcatgagattcttgagaacggactcgcattggaattgacgagccacatgagtgtctatcgaacggcggcacgcggttatcttcccgcccactcggtatggggcaccttgtggatcgaggccaatattgcagtgtttctggtcgttatgtgcggtatcctatggatagttgcgcaaggcataattcggggagtatttgcagccagcgcctttgcgttggggttgatcggtagctctatgttctataacacgatcaacgaacccttctacttcgttatgtggctatgtgtcattgccagtatatttcataaccggtacgattggggtggcgttgtcgttccgaaaggcgcgccgatgaggaagcggcgccgtatggccccgtccgctcccatacaggcgccgtcggaggagtctgagagtccgtccgagaagttatctatgatttccggctccttgcgattctccgcatcatgatccggatcatggcgaggcggagaaatgccagagccatccgtgagaggttctcgaagtccttggccagcctgcggcagcggccgagccatccgaaggtccgttcgacgatccagcgtttgggcaggacctggaagccctttgcggtatcggaacgcttgacgatttccaggtgccagacgccgagttcacgcacggcggcagccgtggcggcgccctgatagccaccatcggcgaagatgcgctcgatgaacggaaacaggcggcggacctctttcagcaccggcaacgcaccgtcccgatcctggatgtcggcaggctggatctgcgcttccagcatcatgccgagcgtgtcgacgacgatgtgccgcttcttgcctttgacctttttgcccgcgtcgtagcccgacggatcgatccgcgcccccctttttccgcgcttttgacgctctggctgtcgatgattgccacgctcggtccggcctctttcccggccaactcgcggacatccacgaacagggcatggtggatccgcgccagcgtgccatcccattcccacaggcccagatattcatgcaccgtgctccgcggcggcagatccttgggcagggcccgccattggcagccggtcatcagcacatagaatacgccgttcagaacctcgcggacatcgaccgtgcgctgtcgaccgccgcgcttcgcgggcgggatcagcggttcgaccagcgctcattcttcatccgtcaggttgctcggatatctcaaccccggccgctcataaatccggcggctttccctcgtccacattctgtccgctcccatttcctttggggcggcatcgaatcacaacagattcaccggattcaataacattccggacgggccctcagattcttgcgtcgagaattcccttaatatatgcaaggctgtgatctggatgtgataaagcaatggtcggaatatttaagggatataggccattccaaggcagaatgcgaggaatggcctgggcaggtcggcaatagcgctggtatcaggctcaacgggccggctaataccaatctgcaataatcagaacccatgagcccagcgcctcaacccaatggacatgatcttccatggctggctgatgagcttgttccaggcatggcagcacatggcgatgatctggtcgtaggattcgaagacgcggtttgacagccagttgtcacgcatgaactgccagacattctcgaccgggttgagttccggggatctgggcggcaggaccatgatggtgatgttcgccggtacgaccagcttgtcggtcatatgccatccggcccgatccatcatcagcatggcgtgcgctccgggcgcgacctgggtggcgatctcatcgagatgccattgcatgccacgggtatcgcagcggggcaggatcagggcggcgccggcaccgcgttcagggcacacggccccaaagatgcaggccgacctggtgcgttgatcctggggcgctacaggacgtgttcctcgcctggcccagcgtcgcgtgccccttcttgccatcttgttcttctggccgatccgggcttcatcctgccaccacagctctatcccggttcccggcggtaaggcggcttcgatttctgccagtctggtctggaattttttttaaagtcttcaagcgcttcgacatcctgggcatggtgacggggccgggctgacagcttgcggaaccccatcgccttcagctctcgtcccactgtcgtctcgtcgatcgagatgccgaattcctcgaagatccagtgcgccagatccttgagccgccaacgcaccacaccgtcaaccgccggggttggcccgcgcaccactttttccgccagtgcctgacgctgggcagcgttcagcttcggcaccgcaccaggcgccttgcgatcgatcagcccgtccggcccgtgggcgttgaaacgcagaacccaatcccgaatgatctgcaggcccacgccgcccagctgggccgccgaacgtctgctgccgccatcgtagatcaaggcaagcgccagcaggcggcgtgtctgatcggcatctttcgaccgtcgggccagggcacgaaggccggcgccgtcataatcggggcgaagggggatcggtgctgccatggggatcgctccggctgtttgccggagtgactcataatctgctggtcttgggaatcccctatcgtgagtcgggggcagcgctcattggtatcagaccgatctgctgttgcagtcttgaggtgtcgacagaaggtgatcccgttgcgattgcatggctcacgcgttatgtcgccgggttagttcaagggcatttcacggatctgtctgcatctttcgcaccgcctgccgtactgctcttctttcggtcgctccggcgtgcgcccgcacgaccggatgacccggatggagccctcattgcctaaatacgatgatcgcgaccgccatgaggtgggccattctctgccacttgtggtatttgatagtgatcggcacggcgcccactgccgccgattatgtctggagatgaggggtatcgtgctgaaacgggctttggcatcacggttgtccgccccgacgaaactgaagcttcgccggattgcaaaccgtatcttgatcctgcctaattatgtctatgacctgcgacgcttcgtggcctcatcgaccgctgcgcgggaggcggacgatctggagcgactgtctgcgcatatcacgatggactatcatagaatagagaaaggtttggctctgccggttcctcgtccgggatttggccaggatgttgtggagcgtctcctcgcattcattccagagtacgagaataaatacggacctgcggatgtgacttgcactgcgcgcgcggcgctggcggagtatcagcagtttaatgcggagcaggggctacagctgccgaagcttgacgcatttctcaatcgctctgaaatgaatggtgccgcgggtggcacagtgctgctctcaaaagaggatctctttccttttgatggagaagcagcgcgtcgttttgttctgagccggagaagcgttcgccagttcactggccaggcgattgccaaggatgtaatcgaggaggctgtctatcttgcccaacgcgcaccttctgtctgcaatcgtcagtctgcgcgagtattcgtgacccacgatccggcacgaatggccgaagtgctctccttccagaacggcaatcgaggcttcggtgacacgcttggtgctgtcttcgtgattacggcggatatgcgtgcttttacgacgatgggggagcgcaatcaggcttggattgatggaggcatcttcgcgatgtcattggccatgagcttgcatgcgctcggtttgggggcctgtatgctcaattggagcgtagaggcacgccacgacaaactcgcccgtgccgcgatgggcatcggggatgaatatgcgatcatcaccatgctgggagccggatatccgaaggacactgtccggattgcggcctcaccccgccgcgacgtctcgagcatattgagttggctttgacggtgattacgcccgtcaatactgcaaggcagaacgaggaaatatcgctatgaaagcggggcgagctctgttcatcagcgcctatctcccctcggaagagattcctgctgcagggaatcgtctgagtggtgcggccttgaaggactttgcatccagatttgaggttgtggatctggtttccttctgtaacggaatgacaaagggctatgatgatccgttccccgtacctgccggcgtgaataccgttttatttgacgtcgacatgaaggcgcgcctggtcgcaatggtactgcatcccttctctccatccggagtcgcagtgcgccactacctggccaggcggaaagtgacagaccttttgtcgcaccatgcttatgatgaaatctttgtcgatttcactcagggactcggtgcgatcgatcagaaattgtggccgaaagtaactttgcgcctgcatgatgtcatgtcgcagctttatcgtcggcaggctgcgcaagggatctctgcatccggcttgatcggaaagctggaactcagccgttgcttggcgtgggagcctcatgcccttcggcgtgttggtaaattgcaggcgcttaccgcaaaggatgcagctctggtccggcagctttctggacgggatgatgcggaagtggtgccgccctccggatttctgatcgttgaaggccggcagcccgccgggattgacccgaatatgatcttgttttggggcaatatggggcggaaggagaacgtcgatgctgtcctatatttcgaaaagcggattttgccggctattcgtgagaaggtccctaatgcgtatcttgttgcagccggtgcaaatcctcccaaatccgctatggctctgaccgggcctcatgtcacctggaccgggtttgtggaatctcctgacgaatatttccgtcgctgtgccgtcggcatcgccccccttcttagcggcgcagggatcaagatcaaggtgcttgagtttatacactcgggaattccaaccgtggcgagttccgtcggagcggagggaattgctgagcatgaaaatctgacaacggaagatgatccgaagctatttgccgaggcatgtgtcgctattatgcgggggaataatttgcgatcgggtgcttgaggactggaattttgttggggggcgctggtgggcgataactgtatcgggcgccaagcatttgtattacaagctgtggttcttggattgtcgggtcagtcgcgaggggaacttcgttctttaatcggccagatactcgccccatcgcacgcgactacggcatctggatgatctctgagagcatatgccgttgttcacacgatgagcgtccggctcggcggatcgacagattgaacagattggttggcttttgacccaaacggagggcccggccatgacgcgcgaaccatcctctccggtctgttacgccgacgaggccgatgatctctatatgggctatgtcgggcgtgacgagatcctggtcctgctgaccgatcttctgcgccgggaggatgtggtggggcgggatgaggcggtgcgggcggtgctgaccggggaaatccggcggctgggcggcacgccgccggaaccaggcgatcttcaggcagcgggggctgtgccggcggcggatattctgcgccggctggcggatctgctgccccggctgcgcgatgacggccttcatgcggtcttgcggcggctggtcgatcggtgatcgggcaggttcgcgcttgccttcggcgccggggaagcggagggtgcggcgctgatgcagcacctgaaggagaccggacatgtccgaccagggtgacgactacgtgtatgacgaggccaccggcgaatggctgccggcctcggagttggctgcctcgcaacccgagggccaggcccccgcgggggagcgggtggtgaaggatgcggccggcaatgtgctggcggatggcgaccaggtgacgctgatccgggatctgaaggtgaagggcaccagccagacgctgaaacagggcacggtgatccggtcgatccgtctgacggcgaatgacgaggaaatcgactgccggcacgagtccatcaaggggctggtgctgcggaccgagttcgtgcgcaagcgctgatgatccggaccggtaccggtggttgcggtgcatgccgcgtcacctgtacagtcggatggtcccacagccccgagaggccatgtccgagatgatgccgaccgtctatcagagcgatctgttcatcccccgctaccggccgatcagccgcgggcgctgggagctgcgggtggtgccgatgaacatggccccgggctattggacgatgtcggccctggtcgagaacatggccgtgctgctgcgcgaccggcagagctggatgtcgaccaccccgctcgagatcgaaagccaggagatcggcgtgcatctggcacgcggccatgtgctgatctatggcatgggcatgggctggtcggcactggcgagcgcgcttcaggatgcggtgaccgcggtgacggtggtcgagttcgacccggatgtgatcggactgcatgaagagctggatctggcggcacagctgcccgaggcggcgcggaccaagctgaagatcgtgcagggcgacgcctatgcctatgtgcccgaccggccggtcgacctgctgatgcccgatatctggctgccgatgctgaatgacggccgggtggacgaggtgcgacagatgcaggcgaatgtgcaggccggcgcgatctatttctggggccaggagctggagatcgcccgccatgccgtggcggccggccatgcgctggacgatgacggcatcgccgccgccattgccgggatggggctgccgctgatcggccccgagtatcccggccataccgacaagctcgtcgccgccgcccggcgctggctgcgcgaccgctggctgcctggctccacgccgccctggtgaggccgaccctgtcgccatctggccccctggctcagccgcccccgccgcattccaggcggaaggcggtgcgcagatgcgcttcggcggccgccgtatcgagcccctgggcgcccgagagcagcagcccggccaggccatcataaagcgcacccagcctgagcgccgtggcgtcggggtcatccgcccgccagcagcctgcggcgtgaccgtcgcgcaggatggcggccagactgtcctgcatgcgctgccgcgcggtcgaaagcgcttcggcgagcgctgtgtcggtgccggcaagatccgtcgcctcgatccagagccgccagtagatccaggcatcgggcgcgaaggcggtggcgagatagcgctccatcgccactgccggcggccggttgccgtcgttgatgtccccggccacggcgtcgaagatcgccgaccaggccagcgcccgcagttccggccagcggaaataatggttcagcagccccgtgccgacgccggcgcggtcggtcaccatccgggtggtcgccgccttcagccccgccgtcagcagcacctcggccgccgcggcaaggatgagatcccgccggccgcggggcgcatcgtcatgccgtgccacatgtccctccttgactcgttgagcggttgctcaataaattgagcgcatgctcaatggcgggaggatatcatgccgggcccactccgcaccacaccggctcgcaacacatcagcgcgcgatacagccgtggacaccatccgcctggtcgggctggtggggatctgcgtggtcaatctgcccttcatcgccctgccgggtgcggccgggctggtgctgcccgatgccggcctcgaccgcctggccatgctgatggtggagacactgttccaggccaagttcttcctgctgttctccttcgtgttcggctggagcttccatcttcaggatctggcggcacggcgcgccggcgccagccccgctcgccggcatctgcgccgcatggtcgcgctggcggtgatcggctgcctgcacggcatcctggtctttccgggcgatatcctggtgatctatgccctgctcggctgcgggctggtggcggtgcggcatttgtctccgccggcgctggccaggcttgcgctggcgatgctgccgctggcggcgctctgtctgaccgtgctctgggtgtcgctgccggaagcggcgttcagtcagcctccggccggcgacgcgctgtcgcggcggatcgacgagtggctgtcgacgctgggttttctgctggtctttcagggcccgctcgccttcggggcgttctgcctggggctggcggcgggcaagagcggtttcttcgcccccgaccatccgtggcagcgccggctggaccgggcgctgccctggctgctggtgatcggcctgccgctcaacctgttccatgccgcagcgaccggcggggtgctgccggcggaatgggcgctgacgacgctggcgggggtctgggcgctggcgccgggggcgccgatcctggcagccgcctggctggcgctgatcctgcggctgacgcggcgccggccgctgcccgagatcctggtcgcggccggccgcaactcgctgtcgatctatgtgctgcagggcgtgctggggggtgtcaccttctatctggtcggccatggcagcgtgggtcaggcgcggctgctggtcgtggccttgccgctggccggggcggccattctggcactggccgcctgggcggtggtcgctggccgcggaccgctggaacggctgctgcgccggatgtcgggggcctgacgcgccttcagcgtcggtcagctgaccgatcgccagacgaccggcgggccaggagcatcagcaccgccaccgcgagcgccgatttcaccagcccgccggcgatgaagggcaggacgccgtgttcgatggcacggtcgagaccgatcttcgtcgacagccaggcagctcccagcgccagacagatcgcatgggcaaggatcatggccgccagcgcacgcaccggtcgttcgccgttccagccgcgttcggcaagcaggccggtcagggcccccgcgatcgggaaggcgatcagatagccgccggtcgcgccggtgaagcggtcgatgcccgcggtgccgtcggccagcaccggcagaccggcggcaccggccgccagccagaccagaattgtgagcccgcccagccgccagccatagagcgcgccgatcacgaagaccgcgaaggtctgcatggtcatcggcaccggcaccatcggcacttcggcgaaagacgaggcggcgagcagggcggcgccgatcagcacggcggcgccgcgccagccgatcggacgggtctcggggcggagcgggctgaagctgcggaggctggtgtcggacatgggatgcggacccctggatggttgcggcgggcgagacatcgacccaaaatgcaaccataagaaagcatgggcgcgaaatccatctcacaagttgattgttcttcgggtttctggtgttcgagaacgtcagggcttgttctgggatagtctaagatatatcttagacctgtctggaagagaggagtgacgcagatgcgtttcggacacaggcagtgcgaccgtcgcggccgcgggttttacggcgaaggccgtcacgggcatgagagcgacggccttgatgggaattttggtcgcgagtccgggggcggccatggctggggccgcggcttcggccgcggtttcggccgcggccgctctggcgaggactggatgtcggagcggggcggccgccggcgcttcttcgatgcgggccagctgcggctggtgctgctgaagctgatctcgatgcagccgcgccatggctacgacctgatccgcgcggtggaagagctgacgggcggggcgtatgtgccgagcccgggcgtggtctatccggcgctgtcgatgctggaagacatgaaccaggtggcgggcaccgaggccgagggcggccgcaaggtcttcgcgatcaccgccgatggcgaggcggaactcgccgccaatgcggcgatggtgaccgagctgatggcccggctggcggcgatggccgagatgcgcgagcgggtggacaccaccccggtcgaacgcgcgatcggcaatctgaagatggccctgcgcggccggctgacggcacctgatgccgatcgcaagctggcgctggagatcgcccggatcctggacgaggcgacgcagaagatcgagcggtcatgacgaagaattcgaggcttgcggtcctcaggcggcgccatggtcttgagccgccgctccgatccgttcccgatcttccgaacgacaccctgatggagaagcaatccatgacgacgaccacgaccaccgttaccagcaccgccgtggtgccgacggcgcatggcagccgctatctgcagcagctgtgcaagcattggagccacaacctgacggttgagttcagccgcgagcagggctcggtgatcttcccccacgatgcccgcggtgccgcatggccgggcgatggccggctgctgctggatgccggcgacgacaccctgacctgccggatcgaggccagctccgacgggcagctggaggcgctgaagggcgcggtggtgcggcatctggaccgtttcgccttccgcgaggcgccgctgcatgtcgactggcgggacggcgtctgatcaggtggcgccggcccggcgcggtgccgtggccgaaaggatgaggccgagcagggcgaagctgccggtgagggccgcgatcgccgtccagccgccgtgctgccagaaccagccgccgaccgaaccggtgatgctggagcccagatagtagaacagcagatagagcgacgcggcatggcccttggtggcaccggcaagggggccgaccgagccgctgaccaccgaatggcagacgaagaagccggtggtgaccagcacgatgccggcgatgatcgcgggcagggccggcaccagggtgaccgccaccccggccagggtcagcaggaaacccgcgatcagcagcggccggcggccgaagcggtcgccgaggccacctgcgatcgaggacgagacgatgccgaagccgaaggcgaggaagatcatcgcgacccgggtctggctgagatcgaagggggccgcggtcagccggaaggtggtgtagttgaacagggtcacgaagatgctggtcagcgcgaagccggtggcatagagccggagcagccccggattgcgcagatgcccggcccaggcccgcagatggaagccgggtgagacgccccgtgccggcacgaaattgcgcgagcgcggcagcaggatcaggaagccgatcgcggccaccaggccgaggccgcccatcaccgccatcgccatgcgccacgaggtgaattccgtcagcagccccatgccgacccggcccatcatcgcgccgaaaccggtcccggcaacataaagccccatggccttgcccagatggcgcggctcgatttcttcggccagataggccatggccacggccggcacgccgcccagcgccaggccttcgagcgcccgggcgatcagcagcccgtgccagtcggggctgagggcggcggcgaggttgagtgccgccgccgccgccatcgagccgaacatcagcccgcgcctgcccagcgcctgagagaaggcgccggccagcaggatggagagcgcgagcaggctggtggtgaccgacagcgcgagcgaggccgaggccgcccccaggccgaaactggtggcgaaggccggcagcagcggctgcacgcaatagatcagggaaaaactggcgaagcccgccaggaacagcgcgatgccggtccgccgccaggtcgtggtgccgcgggtgatccagaccgggccgtcgattctgacggcggtcggagccgggtggtgccggtggcgggcgggagccatggtcgattgaagggtcatggagcaggcgctttcggggccgggtctggtctttcggatatagcgctggccctttccatgcgtccaatatatggaagcagcaatcttcatatctttggtgtatggctgatggaattgcggcacatccggtacttcctggcggtggccgaggaacgcaacttcacccgggcggccgcccggctgggcatcggccagccgccgctgagcctgcagatccgggatctggaggcggagatcggcacggcgctgttccaccgcgttccccatggcgccgagctgacggaagcgggggccgcctttctggcggcggtggcggcgatcccgggccaggcggcgggggcggtgaaactggcgcagcgcgcagcccggggcgaaaccggccggctcagcctgggcttcaccggcacggccgccctcaacccgctgattcccgaagccattcgcgccttccggcgggcctgtcccgaggtggtgctgaccctgaccgaggccaattcggtggccctggtcgaagggctgctggaggggcgcctgcaggtcgcgatcctgcgtccggccgcgacggacccggccgaactggcggtccacaacctggccgacgaacccctggtggcggcacttccggccacccatgccgcggcggcgctgccggggccgatcgatctggcgcagcttgccgccgatccgctgatcctgaccccgcgggcgatcggcaccagcctgcacgacgtggcggtcgcagccttcagggcggcggggttcgagccggtgctcggccagccggcgccgcagatcgcctcgatcctgtcgctggtttcggccgaactcggcgtgtcgctggtgccggtgtcgatgtgccagctgggcatgcgcggcgtagtctatcgcaggcttcgcgatccggaaccgaccgtggggctggcggtggcctatccccgccaccgaccaccccaggtcgtgctgaatttcgaccggctgatccggcaggtggcgcgggcggcaccctgacctccgtcccctcgcttgacgaggcggtcgatatccatataggttgatatcaacaatattcaggagggacctgcccatgaccacgaccgcgcaaccatcggcggccgaacgtgccgcggccttcgggctccattcgctgaccccccatctggtctgcgccggtgcggctgcggcgatcgacttctacaaggccgccttcggggccgaagagctgatgcggctgccggccccggacggatcgatcctgcatgcctgcatccgggtcaacgggtcgtcggtgatgctggtcgacgaaaaccgcggctgcggcctttccgggcccaaggcgctgggcggcaccgccgtcaccctgcatctggtggtcgacgacgtcgatgcggcggtcgatcgcgcgatcgtcgccggggcggtggtggtgatgccggtcgccgaccagttctggggggatcgctatggtgtgatcgccgatcccttcggtcatcaatggtcgctggcgacgccgggcgcgccgaaatcgcccgaagagctcgcagaagcggccgcagcggccatggggggtgtgtgatgacgatcggctatgtcgacgggttcgtcgcggcggtgccgaccactgcccgcgaggcgtttcgtgcccatgccgaagcggcagcggtggtgttccgcgagaacggcgcgctgggcgtgaccgaatgctggggcgacgacgtgcccgagggcgaggtgacctcgttccccatggccgtgcagcggcggccggacgagacggtggtgttctcgtggatcctgtggccgtcgaaagaggtgcgcgatgcggccatggcgaaggtcatggccgatccgcgccttcagcccgacgtgatgccgatgcccttcgacggcaagcggatgatcttcggcggattcgtacccattgttcaggcctgaggggccgatgcgtccagctgcttgtacatgaaggtcgtggcgcccattccgctgccgtcggtgcggatgcagtagtcggggatggtgccgacggtgacatagccgagtgccgcatagagcggctcggccttgtcaccggtgagcgtgtcgagggtgagcagatgccggcccatcgcaccggcgcgggcttcaagatcgagcatcagcgcccgggcgatgccctgccggcgaaaatccggatggaccagcagcttgcgcacctcggcccgatgcggctggttgggcggggtgtcgtggtcgagctggaccgtgccggcgatccggccgcccacctctgcgaccagcaggatcagcccgccggccatgagcggcggcaacaccttcgcctcccagaagcgccgcgccgcctcggccgtgaagggcagcaggaagttgacgctggccccgtcctcgacgcaggcgcggagcagatcggccagttcgtcgagccggtcccgggtctcttcggcggaaagcgcagtgatcgcgacggtcatctcaagggcctcagaggatgaagaggtgatagcgggcgccctcggccggtgtcgtctcgaagcggctggcgccgtgcaggcggtagcgcaggcagtcgccgggttcaaggtcatggggcgtgccctcgaccgtgacccggagccggcccgtcatcagcacgaggtgatgctccagccccgggcgcggcggctggtggtaatcgatccgcgtcgccggcggcagttcgcagtccagcacctcgccgccgagcgtcgccgcgggcggtgagagctggcggcggcggaagccggtggcggggtcggtccagaccggctggtcggccggccgcagccgggcggcgaaatcctcctcggcgagcgcgatcagccgcgacatggggagcccatgggcggcggcgagccggcccagaaccgcggcggtggcgctgacctcggcattctcgatccgcgacaggctggcccggctgaccccggcgcgggccgccagatcatccagcgaccagccggccgccagccgcagccctttgagccggcgggccagacgatcatcgatgtcggggatggtgggggatttttccatattcgggagaatattccgaatatgagaagtcggcaagccacctcagggggccggatcgagcccggccagaaagtcacgcagcagggtatcgagtgctgtctgttccgccgccgacagatggccgaccagccgcttctgggtcgcgacatgatcggcgaccgcggcatcgatgacccgtcggccctgatcggtgagggcgatgagcacgctgcgcccatcctgcggattgggccggcgctgcaccagcccggatttttccagctgatcgatgcggttggtcatggtgcccgaggcgaccatggtggtcgccatcaggtcgccggggctgagcgcgtaaggggggcctgagcggcgcagggtcgccagcacgtcgaagctgggataggcgaggccgtgggcggcgaaggtcttctccatctcccgcatcagatgggtcaccaggcgggtgagacggccgatcagccccatcggcccgagatcgagatcgggccgttcgcggtgccattgatcgagaatgcggtccacgtgatccatggccgggatcatggagcccggccgtcttgcggtcaagaaggtctctcgacatcgagataattatcttgacgtcgagagatatcggcatagcctgaaaggacagtgccagggaggttccatgcaccccgagaccagccgcaacggcgatgtgctgctgaccgcgatcgccccggcgatctggggcagcacctatctggtgacgacggggctgctgccccagggctatccgctgacggtggccatgctgcgcgccctgccggccgggctgatcctgctgctgctggtccggcgcctgccgacgggcggctggtggtggcggtccttcgtgctgggcgcgctcaatttctcgatcttctgggcactgcttttcgtttcggcctatcgcctgccgggcggggtggcggcgacggtgggcgccatccagccgctgatcgtgctgctgctggcccgcctggtgatcggcacgccggtgaaggcggccgcggtggcggcggcgctggccggcattctgggcgtggcgctgatggtgctctcgcccgatgcggcgctggatccgatcggcatcgccgccggcctcggcggggcggcggcgatggcggcgggcaccgtgttcagccgccactggcagccgccggtctcggccctgacggtcaccgcctggcagctgaccgcgggcgggctgctgctgctgccggtggcgctgatcttcgagccagcgctgccggtgccgaccctgcatcacctgatcggtttcgtgcatctgggggtgttcggtgccgcggtcagctacatgctctggttccgcggccttggccggctggggccgggttcggtggcgccgctggcgctgctcagcccggtgaccgcggtgatcctggggctgtcgatcgcaggcgagcatctgtcgatggtccaggccctgggcatcgctctggtgttgggcagcgtgctcgcggcacaatgggtgcaacggccacgtccggtgaaggcccccctggccaccggctgagccctcaagggaggacagatgaccgggactgcatcaaagaacaggcagtgggtgcttgccgcccatcccgacggcaaggccactgccgacacctggcggatgatcgacagcccgatgcccgagccgggccccgggcagatcctggtccgcacgctctggctgtcggtcgacccctatatgcgggggcggatcgcggcggccggcaattacaccaaaggcgtggcgccgggagagctgatgcagggcggcggcgtgggcgaggtgatcctctccaaccatcccgcctggacgccgggcgatctggtcgaaagcatgaccttcggctggcaggaatatgcggtgttgagccccgacctgccgggtgccgcccgcgccaaccgggtgaaccccgacatcgccccgcccgaggcggcgctgtcctggctgggcatgccgggcctgaccgcctatgtcggcatgatcgagatcgcgcggccgaagccgggcgatacggtgctggtctcggccgcatcgggcgccgtggggcagatggtcggccagatcgcgaagctgcagggtgcgcgggcggtggcgatcgccggctccgacgacaagctcgcctggtgccgggagctgggcttcgatgccggcatcaattaccgcaccgccggcgacatgaaggcggcgatcgccggggcctgccccggcggcgtcaacgtcttcttcgacaacaccggcggcccgatccacgatgcggcgctggccaatctggcaacccatgcccgggtggtgatctgcggccggatcgcggtggtcgatcaggcaccggaagacgatatcggcctgcgcgccagtgcccggctgatcgtcacccggtcgatgatccaggggctggtggtcttcgactggtggcatctgcgcgacgaggccatggcccgcatcgccgcctggcaccgcgacggccggttccgcttccgccacgacgtgctggacggtttcgagcgcatgcccgaagccttcctgcggatgatggccggcgacaatttcggcaagcaggtggtcagggtcgcctgaccggcgccctgccgggcctgcggcggagggcgccgcgcagcaggcccggcagccgcccgtcgatcagggcgaggccgaccgcgatcatcgccatgccgaccagatgtttcggctccagccgctcacccagaaaggcggttcccagcaggatggcgctgaccggcaccaggaaggtgaccagcatcagattggtggcccccgccgtcgccagcaggcggaagaacagcacataggcgaaggcggtggagataaaggcgatggccaggatcgcggcgaccgtcccccaacccggggcgggcagcgtccagggctgatcgacgatcagggcgagcggcaccagcatcatcgccgccgtggtcatctggccggtggcggtcgccatgggcgccacccccagtcgggcgaagcggcggccgaagacgccggccagggcataggagaaggcggcgcccagaatagcgagctggcctgcgacattgccgcccaggccgttcagcgccgccggaccgatcatcgccgcgacgccggcaaacccggccagcaccccggcgatgcggttggggctcgccttctcgtcgctggtcgccagatgcgccaccagcaccccgaacagcggtgtggtggcgttcaggatggcggcaagcccgctcgcgatctgggtctggccccagacgatcaggctgaacgggatcaggctgttgagcagccccatgccgaagaacgccgcccagacctggggcgagcggggcatggccagcccgcgcaggcgcagcacgacgtgcagggcgagtgccgccagcagcacccgtgccgccacgatggtgaagggcggcagctccttgaccgcgacgccgatgaaaaagaacgagccgccccagggaatggagagcagcaccagcagcccccattcccgcagtgtcatgctgcgtcccgcggccatgccgcacctccggattgcctgactgtcgccggccatgaaacccgccatgcgccgccgccgcaaccgaggttttcaagccggaaggccaagtctgcctaagcctcagccggcggcgctggcggcgatgtaatccgcgatcatcaggtcgagatgggcgccgccgccattcttgtagacggtgatctcgtcggccgagcgccgcgccggtgcagtcgccggcaccaggtcgtagagatcgcccaggacatccgcctcggtgatcacgccggctgcaatcggcatcgtcagctcgccgatatggtgcagcgtggtggcacgcgaatccacgaacagccggctgccgccgatcagggtatcgtcggcctcgcgcatatcggccttgaaggcgccgatcaggtcgacatgggtgccggggcggacccgggcgccatggatgaccgggctgcgcgccatggtggcgctggagatgatgtcggcctcggccagcgccgcctccagatcgggggcggcctccagccgggcggtaatgcccgcggcttcggcggtgccgcgggcggcatcgaccagcgcccgggcctgttccggccgccgcgcccagaccgagatccgcttcagatcggggaagatcgcgccataggcccggatcaggctggtggcgaccacgcccgcacccacaatcaccagatgccggctgtcgggccgggcgagcaggcgcgcgcccagcaccgaatccgccgcggtcttgaactcggtgaccaggcggctgtcgatcaccgcgcgcaggctgccggtctccgcatcatagaccatcatcgcgccctggaccgtgggcaggccgcgcgcggcattgccgtccatcaccgtcaccgccttcacgccataaccgagaccgggaatgaaggccgcacggttgagcagggtggcggtgcgggggccgaggaaaatatccgcaatctcggcccgggggcgcagatggccgcgctgcaacgcctcgacggctcccgcccagtcaagggcgcctgcacaggcctcgtaggtcagcagatccggcgtcaccatatctcccccgcatgtcttcggatgatcagaggcggggatgatacgggtttcggcggcggccggacaggtcgggatcgacgggtcaggccgagatccgggtgtagaccgccgtcatgaattcctgccagctgccatcgggcatgcggaccttcgagacgacgagccgccggtcctcgctttcgatccggtggatgtcgtgatagagagccatgccggtgccggagaaatccggcccctcggcagcgagcgtcagttcacgaccgctttcgtccatgcggccttcatagacccagagccgggtcatcatcgatccgacccaggtgccggtatagccgccgcgggcgggatcgaaaccgatggtcagcaggctccgaccggtgtcgccgtcgggcatctcgccttctccctcggcgatcagccagaaatcgcccagcatgcgggcggtctcgatgcccgtgaaggtccgacggggctggtcggggcccatgagacagtcggcggtatagcgccaccggccgatgagatggcggagccaggcgtgttccggtgccggatcggtgtgcatgcgtggtatcctcgtcaggaaatgcgggcgggggcgcctgctgcgatgccagggctgcactctgggtgtggtctttttaccttgatatcaaccttgatggaccatgtcaaaacctgcgatcgttcccttcgaaaccacacttctggtccgcgacgcctgcctttgcctgcatgtgcagcgggcggcgcgggcactggcccggcgcttcgacgatgcgctccgtccggtcgggctgacgaatggccagttttcgctgatgatgtcgctgaaccggccggtgccgccgcgcaagggggatgtggccagcctgctggcgatggatcacagcacgctcaccgccaatctgaagccgctggaacgccgcggcctgatcgaaagcgagatcgaccccgaggaccgtcgtggccggctgttgcggctgacgcccgaaggtatggccgtgctggcgcgggccgtcccgatctgggagcgtgcccatgccgccaccgaggcgctgctggccgggggcgaggccgggcggttgcgcagcgatctgatggctctttcgacatcatcaccagatgattatcaaccataagtattttatccctcgcataatgggccgttcgaccttatcatcaggtgactatcaaaccataaaaacacctgtagacggggcgagtcatgaaagctggtgtccatccgagccgtgcgctgtgcatggcccttgcgttctgcggcctggcagccgcatccctccctgcggcagcggccgacggcctggtgatcccgcagccgatgccgggcggtttcaacttccccaccccgggttacgtgatcgggcagtggggcgatgcaaacgaccagacggccatcaccggacatggctgggagatctggcaggcgatgacccagcccaccggccagaacaacctgccggtctgggacacctgggtgtcggaggcccagattttcggccagacgagcaaaaccggtaccaaggccgcagcggagaccgatgcgcttggcgccgttcagggccagctggagcgcggcgtcgccctgccgcagctcaggccgctcaggattccgcgccagttctctcacaccccgcatggccgtaacgcgctggcggcgaccgcgtcgcagggatcggtgatcgtcgagaccgagcgcttcaacgacgccacggccatcttcgtctccacgccgcaggtcaccccttacggtaccttcaaggtgaacaacggcagcagccttcaggcctatgccgccgccttcccggccaatacctcgaccggggcccgggccgtgcgcgacttccccgaaaccgggatggagaccaaaccggtcttcggctatgtgaaggccacgacgcccaccgccgtgccctactggcagggcaccggcgcggtcaacaccgacaacgacccggccctgggctattacgtccagaactggaacgactgcgtgatcgtcgacccgtcgaacacggcgaccacgggcatgacgaagctttcggcggcgccgaccccgggcagcttcttccaggatccgcagctcagctgcagcagttattacacggcgccgatcggcatgttctatgccttcgcgatgacggcggcccaggcgcagggcttcgccaatgccaacgtcgccgccggcgacatggcggtgctggtcgccatgcatgtcagcaccaaagagcaggatccctggacctggcagaccttctactggcagggcatgtccgaattccagacctcggaaggccccggctccatgaccggtcagcccgcggaacttgcggcaccctggaacgcctatgccatgtgcacggcctattctcagcaggtcaacggccagatgctggtctgctacaacccctatcttgagaccaatccgggcattccctcgggcatcacctcgaactgcatgacctgccatggcatggcggcggtctatccggccggatcccagagccagacgccgagctaccccgccagttacgaccagccggtggccttcgacgatccggcgctgttcggcaatgccatgaagaccgacttctcgtggagcatggcggatcaggtgtttgattgagggaggggaggggagtcttttagtccctcggcccaagcgggcgttccacgcccttggccgccgccgcaatggcggcttgcaccggccaccgtctggtggccggcgcggtgcgttggcagggggctgcgtcagatgccgagggcggctttggcggcggtgtcgaagcccagggcgatgacacggccgtcctcgtcggtgaagaccgggcgcttgaccagggtgggttcgcgggcgagcagggcggccagggcagcgcggtcgccggtgcccgcgatcgccgcctcgaccacggcccgatcggcgtcacccagattgcgccaggtggtggagcggcggttgaccagccggtcggcgccgatctggtccagccaggcgccggcctcttcggccttgagcgcgtcgtcgcgcaggtcgcggatccggtgggcgcggtctgcggcttccagcgccttcgccgccttgcggcaggtgtcgcaggtcttgatgccgttcagcgtggggagcatcagcgggcgtgtcccgtcttgagggtgggggccatctcggccaggacgtcgaggcaggcgcgggccagccgccggcagcccgcgggcgaccagccttcttccgcatccggtgcctcgacgcaatccttgaacggctgttccagcgtcatcgccagcgcgccgaaggtgttggccacccagttggtgcacatcgacagatcgccggtctgcggccgggcggccggatagccgatccgggtctggaaatcgggcgagacctcgtccagccggccgcgatagcacgtcagcaggtccagctgccccgggcgcagatcggggatgccctcgaagccggcgatgaaattatgcggcagcgcctcgtcgccatggacgtccaggcagaaggcgacgccggtctggagcatggccgcgcgcaccaccgccacctcggggctgcgggccagggtgggggccgcccattcccggttcagattggcgccggcggcattggcccgcagatggccgcggaagctgccatcggggttcatgttcggcaccaccaccagatctgccgcggcacgcaagcccgcggccaccgggtcggcggcatcggtcagccggtcgagcgcgccctccatccaccagctggccatggtctcccccggatgctggcggccgatgatccagcagaccggccggctgccgtcgaaggcgcccatcgccagcgcatcgagcggccggccatcgacggtgctgcccaggcggatccgccgcaccccgggccggctgccggcccgcgccaccagatcggcatgggccgacaggtcgtagggcgcgaaataggccagttcgacctgatcggcttcgatctgatcggcatcaatgtccagatccaggctcagcacccggccgtcgtagcggcccggcacccgggtccagcggctgcgatcggtggagacgaccgggcgatagccgtcgaagcccttgggataggtgcagctgccggcattcagcagccgcactgtcaccggccggccggtgatgcccgacagcctgacgtcgaaccactggcggaagctgcaaccggcatcggtgcggatggcgaggtcgaccaccgtccggccgccggccgtgccaatggcgatcagatcgccattgccgccgtcgaagcggctgtcgacggcgatgccggatggggcggggaatccggtggcggtcatggggctggcgctcctgagaaggtgccttgtggcgggacgcaggtcttgtccggcgcgggatcggggcgacatatgatgtgtcgtcaggtctctgcccagaccggacgcgcattgtgaaaggagtggccgtgaccgacaagaccgacgctgcgcgcccgctcgcgcccgcgaccgttgccgcccgggccaccgggcgggtcgatcccgcgaccggtgccgtcgtgccgccgatccaccccgccacgacctatgaacgggcggcggatctgtcctatccaagggggcgtgtctacacccgggccgacaaccccaattacgacgcgcctgaagcggtgctgaccgagctggaaggcggggcggaaagcctggtcttcgcctcgggcgtggcggccgccgtgaccctgttccaggccctgccccagggcgcgcgggtggtggcgcccgagatcatgtattggggcctgcgcaaatggctgatcgaggtgggccgccccgcggggctgggcgtcgccttcgtcgacatgaccgatcagcaggcgctggcggcggcgctggatgaaggggcggatctggtctgggtggaaagcccggccaacccgctctggggaattaccgacatcgcggcggcagcccggctcgcccatcgtgccggggccgtgctggcggtggattcgaccgccgccaccccgatcctgacccggccgatcgaacacggcgccgatatcgtgatgcattcggcgaccaagtatctgaacggccattccgacgtgcttgccggcacgctgacggtggcaccggggctggccggcgatccgctctgggcccgggtgcggcagctccggtcgatgtcgggcaatattccggggccgttcgaggcctggctgctgctgcgcggcatgcgcaccctggcgctgcgggtggagcgcgcctcggccaatgcgctggccatcgcgcagcatttcgcgcgcgacccgcggctcgatgccgtgctctatccgggcctgcccgatttccccggccacgagatcgcccaacgccagatgaccggcggcttcggcggcatgctgtcgatccgggtggcggggggccgcgaccgcgcgatcgatgttgcggcgcggctgcgcctcttcgcccgtgcaacctcgctcggcggggtcgaaagcctggtcgaacaccgggcgagcgtggagggcaaggacagtcccgtacccgacgatctgctcaggatttcggtcgggatcgaggcggcggcggatctgatcgccgacctggaccaggcgctgggcaaggcgcccgcaggcgatgcgcagtgatcgtcccgcttgtcgttgacaagccgatgacgcacggttatctagacgcacgacctgccgtggaggggtggccgagtggctgaaggcggcggtttgctaaaccgttatagggtctaaagccctatcgagggttcgaatcccttctcctccgccagttccgaaggccccggccgagcgctgctcgaccggggccttcgcgcatccggcatctccacgcagggcaggcccgggcatttcgcacttgcggcaggtacccgcgggtgttactcaggcaatccgatcggtggcggtcccgcccgccacccataaaacctcaaacgggcatgttcgggctttactgctccgcgacctgccacccgccgggcgccccggccgcgtgacgaaccgcaaacggtctccccgtgggacaccgggttcgccgtcctggcgccgatctgcggcggacgcccatgactggcccaggcacgcggggcacgtcccttacttatccggctgccggtatgtccgcagccggcgtggctttttgcccgccggtcgcggcggcgccacccgttcgaaagaccgacccttgaccaatttctccgagcttggcctgtccgagacgctgcttcgcgccctggaccaggcgggctacgtgacgccgacccccatccaggaacaggccatcccgcatctggtggcgggtcgtgacctgttgggcatcgcccagaccggcaccggcaagaccgccgccttcgcgctgccgatcctgaaccggatcgccgccgaccggaaccgcgccaacatgccgggccgcacgcgctgcctgatcctggctccgacccgcgaactggccgcccagatcgccgacaacatcaagacctatgcccgccatatgcgcgtgcatgtggccgtggtggtgggcggcgtcagcgccggcccgcagatccgcgccattgcccgcggcctcgacatcctggtggcgacgccgggccgtctggtcgaccatctggacagcggcgtgctgaagctggaccgcaccgaggtggtggtgctggacgaggccgaccacatgctcgacctcggcttcatcatcccgatccgccggatcctggccaagctgccgacccgtcggcagagcctgttcttctcggcgaccatgccgaaggagatcggtgcgctggccggtgagatgctgcgtgatccgatcgaagtgtcggtgaccccggtcgccaccacggccgagcgggtcgagcagcgcgtggtgcgcatcgagcccgcccgcaagcgcggtgtgctgatcgagctgctggagtccgaaggcgttcaccgcgccctggtcttcacccgcaccaagcgcggtgccgaccgtgttgcacatgaccttgaagtcgccggcctgccggcggccgccatccatggcaataagagccagagccagcgcgagcgggccctcggcggtttccgtgacggccgggtgcggatcctggtcgccaccgacatcgcggcgcgcggcatcgacgtctcgggcgtcagccatgtgttcaactacgaactgcccgacgtgcccgagagctatgtccaccgcatcggccgcaccgcgcgtgccggcgccgaaggtatcgccatcacgctctgcgccgatgacgagctgggcctgctgcgtgacatcgagcgtctgacccgtcagaccctgccgatcgacgagcgtcgcacggccgaatcgatcgcctcggcacccgagcgcctgccccagcgtcagccgatgcgcaatggccgccctgcctccaaggcgcgccccggcggcggcgtcggccggcctgccggccgcggccatggccgcccgggcgagcgcagcgagcgcggcgagggtgcgccccggccgcagcgtccgcagcgccagggccagcgcgctcatggcgatcggccccacagcgatcggccccacagcgatcgggcccatagcgatcgggcccagggtgagcgctccttcggtgagcggtcgcagggcgacggcttccggggcgacggcttccgtggggatcggccgcatggcgatcgcccccagcgcgaccggccccagcgcgcgcgcccgccgcgcggcgaccggccccagggccagcagggccgtggcggtgaaggccgtccgcgccggcagggtcagtatgccggctgagacgttgtgccgggtgagccggtacgccggctgatcccggcctcgggcatcagaacgaaaatgaaaggcgcggttccggaaacgggaccgcgcctttcatctgtttttgggctgactcacgcgctccggacggtgccgaggaagccgtcgatctggcccttcaacccccgggcgcgggcgccgagatcgtcggtcacctgctgcaattcggcggcctgatcgccggtgcggcgcacggcgccggtgacacgaccgagaccggccgagacatcgcggctgccggcggccgcctgatccacccggccggcgatttcgcgggtggcggcgccctgacgctccaccgcggccgcgacggtggcggtgatgccgtcgatctcgccgatggtggtgccgatccggccgatcaccgtcaccacccggccggtctcgctctggatgccgccgatccgctcggcgatttcggcggtggcgcgggcggtctggtcggcaagctgcttcacttccgaggcgacgaccgcgaagcccttgccggcgtcgcctgcacgcgccgcctcgatcgtggcgttgagcgccagaagattggtctgttcggcaatctctgaaatcaggcccaccacctggccgatccggctggcggcgtcggcgagtgtggtgatctgggcattggcctcgcgggcctgacgggcggcatcggcagcaagcccgccgctgcgcgcggtctcgcgcccgatatcggcgatcgaggccgccagcgcctcggccgcttcggcgaccgccttcacatttgccgccgatacctcggacacgcggccgacctcgcccgcatcgccggtggcggcatcggccagaccgcgcatctcgcgcgccgttccttccatgccggcgaccgccgcgatcacctggcgcagcgcctcggacacttcgtggtcgaagcgccggcaggcggcctcgatctcggccgtgcggcgttcgcgacgcgcggtctcttcggcgcgttcggcggtgagccggtcgttgctgagtgcggtgttgcggaagacctccaccgcctgggccatgcggccgatctcgtcgcgccggccggtgccgggcacctcggcggcggtatcgcccgccgccagcgccgtcatgcgctgcgccatgcggtcgatcgaccggccggcatcgcggccgatgatcaggctgaccgacagcaccagcagggtggcgaagccggcggtgaccagcagaatggtcatcagccgggcattgtcggcctgggcctcggcggcgacggtgccgctcaccgcctcaatctcgtcgccgagcgtgcccatgcgggtctcgagcgcgtcgaaagcgtcgatgaaggcggggaagccggcctcggcccgggcgcgatcccgggccgccgccgtcacgatggcctctgcggcccgcacataggcatccaccgcggcggtgaccgccggaagctgggccgcgatcccgggcgagacgttcagatcgcgcaggctggccatcgcggcgcgaaactcctgggcatgctccaccagatcggccgacaccgcggcccgatccgccgccggggcatcgggggccaggcgcagggccatcagcacatcggcgcgcagggcatcatgcatcatgtcgccctgcatctgctggcgcaccgccgcggtcacccgggtcacggccgagagcccgtcgtcggagcggatcagccccagaatgccggcgccgcccgcggcggcaatcagcacgacggacacaaggctcgaccaggtgagccgggcccggattgacgaggatcgtgacatctcccctcctttcacgtacgggggcaggatgccggcggcaccctcgtgtcacgatcgtaactgtctgcaatttaagaaagtgtttagaaagactttagatggtgacgcgccctgatacgagccagtccgtccctgccggatcgagccgctgcacgccgatcgatgtggtcccggtcagaatgcctggcccctgatcgatgacggccgcctcaatccggcccgttccctgatgttccagatcgagcaggggggcggcggccgcgccgccggtcgccggatcctcggcgatgccgagccctgcggggaaatggcgggcgcggatgcagaggcagccgttctccgcctgaccggcgagggcatagaggtagaggccggtggcgccggtccgtccggccagccgggcgaccgtggcgggatcgggcaccgcccggcccaccagtgccggatcttccagcctgaggacgagcttgggccgggcggcgccggcaagcgccggcgggaaggcgtcgagccccgcgcagagcccggttgcggcggcgatatcggcgcggagcgctgcgccgtccgcgatcggccggtggtgattgccggcaagccggatcgccgcccccggcgggcgatgatcggccggcaccgggctgaccgtctgcggcccggcggcggtggcgatgaccagcgcccggtcacgcgcctgcccgtgctgccagagccggaccgcacctgccagcagcccgtgcaggcagagcgtgatctcagacgccggcaggaaaaaccgcgcccgccagccggtgtccggatcgggctgaagccaggtgacttcggcgccgtgtcgctgggccagcgcgcgtgcccgggcttcggtgccgcccagctgcaccagggccgggttgccgccgctgccgtcggcgcggcagaaggccatggccggccgttccgatgccggccgttcggaggtgggggcgggcgtcatctgcgcgccgcccggccggggaccgcggcgccctctaccctgcgggcgacatcgaccagcagccagccggccagcaggccgccggccagaaacagcgccgccatcacctggggcgggacatggccgaccgcggcgacaccagcggccccggtcatcagcgccaggcggaagcccagattcatcaccgccgccgcccggctgcggccggcttcgggcgcgagtgcggccatcagcgccagcttgggcggggcatagagcaattcgcccaccgtgaacagggcggtgaagccgatcagcagccaggcatcggtcgaccagcccagcacccagaacccggcggcgaagagcgcgaaaccgatggtgaggcggccggtatccgacatgttccgcgccaggatctgaaccagcggcgccagggccaccaccatcagcccgttttcgatccggagcaggccgaacaggcccgggccgtcgagcgccagatgcaggcccgaccagtcgatcagcttgatcgttccgggcagactgcccagccgcaccgccacgtaatgggcgagctgggccgccaccgccagcgagagcgccacgcctgcggcatagcgcaggaacagccggtcgcgcagcacctcggcataaccggccagcatctcggccggtcggaagggggccggccgctccaccggccgggtttcgaccagggcgagcgccagcgcgagcgtcacggccgccgcgagcccggcgatgccggcgagcagccagccgaaccacaagccataggcggccgccccggccagcgtcccgctggcgcgcgcgacattggtcacccagtagaccgcgccatagatctgccgccgccgttcgggcgttgcgaggtcgatcaccgtcgcctcggcggtgggggtggagatgccggcggcgatggcgagggcgaggaaaggcagggcggcgatccaggcggcgagcaccgggtcggcggcgcgggtttcgggcagcaccgcgagtgcgagtgcggcggcagccagcgcccggccggcttcggccggtaccagcacccggcgccggccgcgggtatcggccagatgtccggcccagatgcccgccaccgtcgcgcccgcgaaggccgcgaagatcagcagcccggccgtgccggtgccgaggcgttcggcgaacagcagcgccatgaaggggaagatggcggcctcggcgaatttttcgaggaagagcaccgccaggcggagccggatcacccgttccatgacgcgtcctccagccgccaggtggtgaagggggtatcgcaggcggtgccgagggcgacatccatccgccgggcggccgggtccaggatcacactcgcaaccgtgcggcccagccgcgggctgttgcggccatgggcgcagatcgacaacggcgcattggcatggtcggcgagcacggcccgtgcatctccggctccggcagcaccctccgcccaagggctttcggcgaagatctcgtccagccgcgccgtccgcagacgggtggacgaccaggccggcacccggtcgagcggcgccagatcgggatgcaggtaatgattgcaatgggtaagccgcgcctggggcaggcccggaccgggatcgagccgccggcagctgtcgatggtggtctcgatcatccggtggccggtgccgtcggccagggtgtagcagcgcgaggtggcgcgcggcaggcgggcgatggcggcttcggccgcatcggcatcggccaggcccagcagatgacggacgatcagatagggcggcggtgccacctgccagccgggggcgaccaccatgttgatgccgatggcgagcccggcccggttgaggccgaggaagcccagctggccgagcggcgcccaggccagcgaccgcccgcccggcccgtcgccatccaggtcgagcacggtgccgagcccgtccatatcgcccggcagatcggcggtctgggcgatcagcgagcggccgtccgcgccggtgaaagcaagcgtggtgcagccttcgagcccgcccgaccggtcttcgggctgtgcggcccctgcaaccaccggcccggtgccgggggcggcaagctcgcgcctcaactgcaggatcagcgcatcggcaagcgggataccggcgccctcggccaggccctcgatctctgccatcacctcgggcagcagatcggcgatcggggctgcgaaggtgagcgccagccgtcgcgcggcctcgcggcccagcggttccggccgcagccggtccagatgggcgacgtcctcgtccagaaaagcgcggatcgccgggccgagggcctggccgatgctgcggccccgcgcccgcgccggcccccgggcgcggatcggccaggccaggcccgaaagcagctctgccgcggtcgcgcggcgggtgggctgaaccaggctcatgccgcctgcctccgcctgaggccgtcgccggccaggcggatcaggctctgggccagcaggtcgaccgcctgacgtgccagcggctccagtaccgggcggttcggcccggcaagggtcgcggcggtgtagatgccgggcgtcatgttgacctccaggatcaccgggccgcggcccggcacctcgatcaggtcgacaccggcgagcggcgcatcgaccgcacgcgccgccgccgtggcaaggcgggcgagggcgggcgggatgctggtcagcgcttcggccctgccgccggcatgcagattggcgacgaaggcccccggggcggcgtggcggcggaaggcatagaccggccggtgatcgacgcattgaatgcgcagatcgctgccgtcattgggcaggaattcctgaagatagagcggcagccgcgcggccccggcctcggccagacgggcgatcagctcggcgcggtggccgagcgggccgaccccgccgcccttggtgcccaggcagggtttcaccaccatcggcaggccaagcccggcgatcagcacgtcgggatcggcatcggcgcccgcgatcagggtgcgggcatggggcaggccggcggcggcgaggcggagcgacagggtgggcttcaactggccgggatcgagcacggccgcccggttcatcaccggcaccccggccatttccagcgccttgagcagccagagcccggcatcgcgtgcggcaagcgatgtccagcccaggcaggcatcgggggtgagcgggctgccatccgcctcgaggatcaccggccgccggccgtcgatgcggatggtgagggcttccgggcggcggatgatcgggcgggcgccgcgtgcccgcaatgcgccgtcgatggcagtgacgtcggccgtggtctcgcgcgccaggaccagcacggccgggcgcgggcgactgccggcgccggagtgcggagcgggggagggcatcgccgatctctccgtggttgagtgaccggcgatttatacgcccttaactatgacgggatcaagcgacctcgggaagtgcgccgggcgcgggcggggtccgcatcccggcggcaccggcggggacgagccccagccggtgccgccgggtccagcgcgtcagcatcagcaccgccacggtggcgaggcctgaggccaggccgatccagagcccggtgccgcccatgtccagcccgaaggcgaggccagagcccacccccagcccaacgccccaatagccgaggccggcatagatcatgggaacggcggtgtccttgagcccgcggagcaggcccgcccccaccgcctgggcgccgtcggccagctggaagatggccgcgatgcccaggaagccgaccgcgatcgccgtggtctcggccaccgccggatcgttgccgtccaggaagaagccgatcagcgtgcggggcatggtcagcatcacgatggccgagagcgccatgaagccgatgccgagcaggatggcggcacggcccgcttcgcggatccgtccggcatcgccccggccggcggcgatgccgacccgcacggtgcccgcctgggccacccccatcggcaccatgaaggtgacggcggccagctgcagcgcgatggcgtgggcggcgagctggttggtgccgatcagccccatcaggaaggcggcggcgttgaagacggttacctcgaagcccatggtcaggctgatcggcagaccgatcttcagcatctcgcgaagccgcggccagtccgtccgccaccagcggccatagagcgcgaagcggttgaagcggcggtcggccagggtgaccagcgccagcgcgccgaacaggaagatgttggcgagcgtgctggcgatgccggctccctccagccccagcgccggcaggccgaaatgccccagcaccaggcccagatcgagcacggcgttgaccgcgaccgccgcgatggtgatcaccatcgcaggccgcggccggccgagggccgagatgaagttgcggagcaccacgaaccacagcgccggcaggatgccccagcgcagcgtgtcgacatagaccgcggcggcggcggccagatcgggcgcctggcccatggcccgcaggatggtctccgtctggcccagcaccaggatccaggcggtcgagacggcaaggcagagccacagcccctgacgcacggtgcgcctgagatcgcggaccatgcccagcctggcgcccaccgcctgggcgagcatcggggcggtggccatggcaaggcccataccgtagatgaacagcgcgaaatagagattggcgccgagggtggcggctgccagtgcctcggggcccagccggccgatcaccagcacgtccgtggtggtgatcgccatctgggcgaggttggtcagcacgattggccaggcgagggcgaaggtcgcccttacctcgcgcatgaacggggcctcgcgcacgaacggggtctgtgcgccggccgcggggggagcgatgccggtcatgatctctggtgccgaaatggtgaatgcgcgcacggaatccggcgacggcggctggctgaccggcggggggccttgcacctgccccggaagggggatgcggcctgccatggtcatggccgtctgacggtccgaggatggcggggctgcgatggcagcctgggctgttgtcgccatccggcgcccgagccgtacagaatacgcgcagatcgtgacgtgacacccgcgcgggaattgcgggtctggctcgcaggattcgcatggtataccaatatccggcataatggtataccaatgcccataacaaccggatgagggcggggcaagggcatggtcgaaacctgggtggtggtcacggcggccgcggccgcgctgcaggcgtcgcgcacggcgcttcagcagcggctgcgcgggctgctgagcgttcagggcgcaggtttcgtgcgctatgcctatggggcgccggtgtcgctggcggcgctggcggtcgttgctgcctctcccgccggtgtgccggatctgacgctcgcccatgccggctggtgcgcgctggccggcatcgcccagatcctggggaccaatctgctgatcatgtccttcggtgcccgcggcttcgcggtgggcacggtctattccaaggcggagaccgtgatcgtggccctggtcggttgggcggtgctgggagaggccctggctgcaacggcctgggccggcattctggtgtgtatggccggcgtggtggcgctggccacccgcggcaaccgcgaaggactgaaggctctggcgcgcggcgccggcgaccgggcggcgctttacgggctgggggccggggcgatgttcgccgtcgcctcggtctgcatccgggcgggtgcgctggagctggggcagggcgacgcctttccgcgggcgatcgcgacgctggcggtgatgaactccatccaggcggtgctgatgggcgtctggctgctggcccgcgagcccgcaaccttcactgccgtgttccgcacctggcgcagttcctcgctggtgggcctgctcagcgtcaccggctcggccggctgggcctgggccatgacgctggagaccgcggcgctggtgcgcgccttcggccaggtggaactggtcttcaccgtgatcatgggccggctgctgctgggcgagacgcccaaggccgccgacatccccggaagcctggcggtgatcctgggtgtgctgctggtgctgctcgcctgaaggcgctagtctttgggcccatgagcgatgcggacgacatcacccggctgaccgccttttccctgggcgccgacggcccggccatccggccggcgccggtggagcgggcatggatggatgccaccccccagggcttcgcctatcgctgcctgccgctcgccatcgccaatgcctggggatgggaactgctgaacccggccggcttcaccgcggtctggacgggggacgaggcgccggcgggggtggtggtgacacccgacgaccccgcggcggcggtgcccgcggtcgggcatttcggatcgggcatcctgaccttccatgtcccctggctgttccgcaccgcgcccgaggtggcgctgatggtgcaggggccggtcaaccggcccaaggatgcgatcgccggtctgcaggggctggtggaaaccggctggtcgcccttcggcttcaccatgaactggcgcttcacccgcacggacacgccggtgcggttcgaggcgggggagcctttcgccgcgatcgtgccggtgctgccggccctggtggaggcgatgcggcccgagatccgcccgatcgcgagcgagcccgagaccgagcgcgcccacgccgccttcgttgccggccggtccgccttcatcgaggccctgggtgacgagggaagcctggagcgccgggccggctggcagaaggattatttccgcggccgcacgccggacggcaatgccgccgggggcccccatcgcacgaagctgaaactcgcgcccttcatccgccgcgacggatgatgacgcggttccgctccacccgttccgggagatcgatgcacggccgcttcgtctgaatgacctgcgcagccgcgtggccctgcttgccctggtgctgatcgccgtgctggtgatcggcctgcagaccctgatcggccggcgcgccgccgaccagatggcggccgagatcggtgccgggctggcagaggtggcgcagcaggtcgccgaccgtttcgaccgcgagatctggagccggtccaacgagagcctgctgtccgccaccgaccggccggtggtgatcgacacccaccgccgggccatgggtgtcgatggcacccccgggccgcatctgctgaacgttgcagcgcccgcggtgacgcctgatggcgcccgtcacggcacgctgatcgcgtggctgggctgggattggggccgcgacattcagcgcgatctgggccgggcgctgcgtcgcgaccggccgctggagatcctggtcgccgacgcggccgggcaggtgatcatcggcccggaagctgcaatcgggcaaccggtgccccgcagctcggcgatgccggcggcggacggccgcaacggctggggggccgccggctggatcgcccggccgctgcggcgtatcgcccaggcggccgaccggatcaggtcgggtgacgacggggtggaaatctccgaggtcggcggcgcgaccgaggtggaactgctgtcgcggtcgctgcgtgcgctgatcgaccggctgacccacagccgcagtgaactggaccaggctctgtcggcggccgggcgcgacgcgctgaccggcctgcccaaccgccgcttcttcgacgaggtgctgcatctgctgaccgaccggatcgcggcccataacggcacgctgggcgtgatcttcatggatctggacgggggttcaaggatgtcaacgacgttcacggccatgcggcgggcgatcagctgctgatcacggtggccggccggctggcgcatgcggtgcgcgagcgtgacgtcgccatccgtctgggcggtgacgaattcgtcgtgctgctggatctggaaggcgaggatccggcgggccaggccaggcggaccgccgaacggctgatcgccctggtcgggctgccggtgccgctgggcgagggggccgccgtcaccgtcggcggcagtgcgggcgtcgccctctggccggcggatcatgccgatccgcgcgaggtgctggagctggcggacgccgccctctacgcggtcaagcgcggcgggcgcggccatgtccggctgcatgacggggcggcccggggtttcgtctcccggaataagtaggacaagaaagttgccatagttgtggcgaatccgacataaacgttcgattttgcacatttgccgctggacagccgacatggcatccgcataaggtccatgacagtgttatcgatacggtgatctgccggacgatgacgtgacagccggaatacccggtcgacaagcgtcgcgatgtcggccatcatgcggtcagacgtggtccataagacgccaccagccgtatgagccttacacgacggcggtgacacaccgtcgggaccagacacccaccaggaccagagacccgggaacccggaagcagatgtacgacgatccgcgccacaccgccattgccgcacgccgccgcgcttccgcgcaggccgcggtgattgcacgtgccgaggcgcggcgcgcggaactgttcctgatggcctccggtggcgtgatcgtcatcctccttggccttgccctctcgcttcgacttatcggcccctgagcgccgcacggtcacctgcgtaaaccacgggtgacacacgctcaggggacaagagacagacccgcatgcccggcgcaggatgccggtgcgtgccgaccccgtccgggcccttcccaaccgcatcgcccgcggccccggcccgtctctcttcgaagcaaggcagtttcagatgaccaccgagaccaatcccgcccgtcagccggtcgacaccacccgtgccgccgaggttaatgccggcgaccgcgtcgtgatcttcgacaccacgctgcgtgacggcgagcagtgccccggcgcctcgatgacgctggacgagaagctgcgtgtcgccgagatgctggagcgcctgggcgtcgacgtgatcgaggccggcttcgccatcgcctccaacggcgatttcgaatcggtctacaagatcgccgagcggtcgcgtgaggcagtgatctgcagtctggcgcgtgcgaagcatgccgatatcgagcgcgcggccgaggcgctgaagcctgcccgccgccgccgcatccacaccttcatctccaccagcccgctgcatcgcaagttcaagctgaacatggacgaggcgcaggtgctggaggcgatcgccgacagcgtctccttcgcccgccgcttcaccgacgacgtcgaatggtcctgcgaggacggcacccgcaccgagccggagttcctgtaccgggccatcgagatggcgatcgccaatggtgccaccaccatcaacgtgcccgacaccgtcggctacaccatgcccgaggaatatatcggcctgatccgggcgatccggaacaatgtgccgaacatcgacaaggcgatcctgtcggcgcattgccacaacgatctgggtctggcggtggcgaactctctggccgcggtctcggccggtgcgcgccaggtggaatgcaccatcaacggcatcggcgagcgcgcgggcaatgcggcgctggaagagatcgtgatggcgatgcgcacccgcgccgatctgatgggcgtgggcaccggcatcgacaccaccctgatcacccaggcctcgcagctggtctcgtcggtcaccggcttcccgatccagtacaacaagtcgatcgtgggccggaacgccttcgcgcatgaaagcggcatccatcaggacggcatgctgaagaatgcccagacctacgagatcatgaccccggaatcggtgggcgtgaacaagtcgtcgctggtgatgggcaagcattccggccgccatgccttcaagaccaagctgaaggagctgggcttcgagctgggcgacaacgccctggaagacgccttccgccgtttcaaggatctggccgaccgcaagaagaccgtgttcgacgacgatctggtcgccctggtgtcggatggtgccggccacgagggtgaaagcctgaagctgaccgcgctcgcggttgcctgcggcatcggcgtcgaccatgtcgccaccgtcaccatcgagcgcgaaggcgttgcccattcggccagcgccggcggcaacggcccggtggacgccgctttcaacgccatcggccaggcgatcccgcacgaggcggtgctgcagctctatcaggtccagtccgtgaccgagggcaccgatgcccaggcgcgggtgaccgtacgtctgggcgcccgcggccgcagccatggcggcatcggcgccgatcccgacaccgtggtcgcctcggccagcgcctatgtgaatgccctcgccaagctgctggaaaaggcggcggacgcaccggaagaggcggccgatccgtcgatccgcagcgccgccatctgatcacgcccggcttgcctgtttcggcgcccccgccggacacgacgcccgcccgggaacggcccccgcccgttccccgcgcgggcgtcgtcgcgttcgatgcgctgacaccgaattgacagtttcaatgcggtgcggtttgtggcgtaatctcgccgcgttcgcccccgaccgtcccagagcgcgcagacccttgcgcgcagcccggacggtaaccggggcgcaggcttcgacgccgccggcgcacccccggtccgggcactgacagtcagatccagcgagcaaagccagctacatgttctcgagcctcctcggcattctctcggccgacatggccatcgacctcggcaccgccaacacgctcgtctacgtgaagggccggggtatcgtgctcaacgagccgtcggtggttgcgatcatgaacgtcaagggcaagaagcaggtcctcgccgtgggcgaagaggccaagctgatgctcggccgcacacccggcaatatcgaggcgatccgcccgctgcgtgacggggtcatcgcggatttcgaagtcgccgaagagatgatcaagcatttcatccgcaaggtgcacaaccggcgcacctttgcgagcccgcagatcatcgtctgcgtgccctcgggctcgaccgcggtggaacgccgggccatccaggaatcggccgaaagcgccggcgcgcgccgggtgttcctgatcgaggagccgatggccgccgcgatcggtgccggcctgccggtcaccgagcccaccggttcgatggtggtcgatatcggcggcggcaccaccgaggtggcggtgctgtcgctgggcggcatcgtctattcgcgctcggtgcgcgtgggcggcgacaagatggacgaggcgatcatcgcctatatccgccgcaatcataacctgctgatcggcgagtcgagcgccgagcggatcaagaccgaggtcggctccgcctgtccgcccgccgatggcgacggcaaggtgctgcagatcaagggccgcgacctgatgcacggcgtgccgcgcgagatcgtgatcaccgaacgccagatcgccgaaagcctggccgaaccggtggggcagatcgtcgagtcggtgaaggtcgcactggagcacaccgcccccgaactcgccgccgacatcgtcgacaagggcatcgtgctgaccggcggcggggcgctgctgggcaatctggatctggtgctgcgcaatgcgaccggcctgccggtctcgatcgccgatgatccgctctcctgcgtggcgctgggcaccggccgggcgctggaagagatgaagaagctgaagcacgtcctctacgaacagtactgactctgcaagcagtgctggccggcgatcggatcgccggtaaagaaatccttaaggtcttccaggaaacgggctgtcgatgcccgcactccgggaagaccagccctgcaggcgcgatgatgtccggaccatggtcttgtggccgtcgtcatgtcatgcttgaagatcagtcgagcccctcagcctcggggagaacgctccggtgaagccgctcggatacggccgcgccgtggctcagccactcagacagctcgcccatcgcttcgccttcggagcgctggtggtgggctccgtcggcctgatgatcgcgacgcgcttcgacgtcgtgcccgtcaccgatctgcgcaccgccatcgccgacgcttccacgccggcgctggaactgttctcgcgtccggtctccagcctgaccgggctgaccgaccggatcggcacgctgaccgatcttgccgccgagaatgcccgtctgaccgaacagaacgagcgcctgcgccattgggagcaggtggcgctcaggcttgcggcagaaaacacggcgctgcgccggcagctgggcgtggtgcccgatcccgaacagcgcttcctgtcggcgcggatcctggccgacaccggcgggcccttcgtgcgcaccctgctgatttcggccggcgcccgcgacggcatggcccgcgacggaatcgccgtcacctcggccggcctggtcggtcgggtgatccaggtgggcgagacctcgtcgcgcctgctgctgctgtcggatctgaacagccgtgtgccggtgacggtggaaaccccggacggggcggcccagcgggccattctggccggcgacaattcgccgcgtccggcgctcgcctatctgccgccccatgtgatgcccgaggtgggcgcgcgggtggtgacatcgggcgagggcggcattttcccgcccggtctggccgtcggccgggtgatctcggtcgaagagggccagatccgggtcgagcccttcgtcgactggcggcggctggatttcgtgcgcatcctgctcggcatcgagctgcatccggaaggggcgcccgaggtgtcgccggccctgccggtggcaccggcgccggcccgcagccagtgacggccggcggaggggcatgaacgacaccctgttgcagaagctcgaccgtcaggtgcgggcttcggtgcccttcctggtgagcctcgccttcgtgctggtcgccgcagccccctggtcgcgcctgggcggcaccgccatggtgccctggccggtgctgatcgcggtgacctattggagcatctaccgcccggaccggctgccctactggtcggtcttcatcctggggctggtggaggatgcgatcggctgggggccgttcggccagaccgcgctggtgcttctggtggtccgggcgatcctggtcagccagcgcaaggtgtttcgcggcaagtcgttcctgctgatctgggcggcttttgcggcggtggcgctggtcgcctgcggcctggtctggatcaccaccatgatctatgcctggtcggcgctgtcgccggccccggcggtggcgcagtggatggcgagcgttgcggcctatccgccggctgcatggctgctgggccagatccacgcgctggcgctgcgccggcagtgatcctatcttcccaagggtccggccccggccggccccggcggcgcagcgcccgtcccctgcgcgtcgaccttcggtgtcctgctccatgcgtgacgaacagaaccgccaccggctcatcactcgccgcaccctgctgctgggcggcgcccaactggcgctgaccggcgtgctgggtgcgcgcatgtggtatctgcaggtggcagaggccgaccgctacaagacgctggccgacgacaaccggatcagcctgcgcctgctggcgccgccgcgcggccggatcttcgatcgtgacggccggccgctggcgctgaaccgcgagaattaccgcctgctggtggtgcccgaacaggccgccgatctggaacaggttctctcgcagctcgctcagctggtggaactgcccgaggacgtccaggcccgggtggtgcgcgaggcggagcggcgacggcggttctcggccctgccggtgcgcgacaacctcacctgggacgaggtcgccaaggtcgaggtcaacggccccgatctggccggggtgatgatcgatgtcggccttgcccgcgaatatccgatgggggccaccatggcccatatcatcggctatgtcggcgccccggccgagaaggatctggatggcgacccgctgctggaactgcccgatttccggatcggcaaatcggggatcgagcgggcggcggagccgcggctgcgcggccgcgccggcaccatccgggtggaggtgaatgcctatggccgcgaaatccgcgagctggaccgcgccgaaggcgtgccgggcgacgacgtccagttgaccatcgatgccgacctgcagaccttcaccaccgcgcggctcgccttcgacagcgcggccgcggtggtgatggacattcattcgggcgacattctggccgcggcctcggtgccgaccttcgacccgatgctcttcgaccgcggcatctcgatggccgagtggacggagctgacttccaatccgcgggcgccgctgatcaacaaggcgctgggcggccagtacccgcccggctccaccttcaagatggtggtggcgctggcggcgctggaagcgggcgtgatcccgcgcgaccacaccgtcttctgccccggccatctggacatgggcgacaaccgcttccattgctggcggcgcggcggccatggcgaggtcggcgtggtggaagccatcgcccagtcctgcgacgtgttcttctacgacatcgcccgccgggtgggcatcgatgccatcgccgccatgggccagcgcttcggcctgggccaccggctgcagatcggcctgccgggggaacgcccgggactgatgccgaccaaggactggaagatggccgcccgcggccgtggctggacccagggcgagaccctgatcgccggcatcggccagggctatgtcctcacgaccccgcttcagctggcggtgatgacggcgcggctggcgaatggcggccgggctgtcgtgccgcggctctatcgcgagatcgacgatgcccgtgccgccggtgcgcagctctggaacgtggcggcccccgctgccggcaccgggctggatccggccgtgccgctgcccgaaagcggcattcagctggccgataccatgggcatcgaccgcagccatatggaactggtgctggagggcatgcgccgggtggtgaacaaccgccgtggcaccgcgcacaaggcggcgatcgaggatccggcctatgcctatgccggcaagaccggcaccgcccaggttcgccgcatcacccgggccgagcgcgacagcggccgctacaaggcggcggacgtgccctggcttgaacgcgaccacgcgctgttcgtgggctatgcacccctcggtgccccgcgctatgcctgttcctgcatcatcgaacatggcggcagcggcagcggcgttgcggccccggtggtggccgatatcctgcgggcgacgattgcgctcggggccgagcgcgagcgccgcggcaaccggccgccggcgccgcagccgcagccggcagggcccgggcgtcccgatcggatcgtccagggccccggccgcccgggccaaggggaggcgacatgagcctgcacgatcattccgccccggccagcctgggcctggcccagcgcatccggtcgttcggctgggggcttctggccctgctgaccctggtcgccggcaccggctttctggtgctctattccgccgcgaatggcagtttcgatccctgggccaatgcgcagatgatccggttcgccatcggcgtggtgctgatggtggtgatcgggctgaccaatctgaagctgtggttacggctcgcctatccgctctatggcgtggccctgctgctgctggtggcggtggagatcatgggcgatatcggcatgggcgcccagcgctggatcgatctcggtttcttccagcttcagccgtcggaggtgatgaagatcgccatcgtgctggcgctggcccgctatttccacggctgcacggccgaggacatccgtcggccggtcaccctgctgctgccgctggcgatggtggcggcaccatccctgctggtgctgcgccagcccgatctcggcaccaccggcatgctgatcctgggggcgggcgcgaccttcttcgtggcaggggtgcgggcctggaagttcctggtggtgctggccctgttcggcgcctcgctgccggtcggctggtcgatgctgcacgaatatcagcgtcagcgggtgctgaccttcatggacccgtcgcgtgatccgctgggtgccggctatcacatcacccagtccaagattgcgctgggttccgggggcgtcaccggcaagggcttcatgcagggcacccagagccatctgagcttcctgcccgaaaagcagaccgacttcatcttcaccatgtatgccgaggaattcggcctgatcgggggcatcctgctgctgctgctgttcgtgtcggtggtgctctatgcgctctcggtctcgctcagggcccgcacggtgttcgggcggctggtcgcggcgggggtggggacgaccttcttcttctactacttcatcaacatcgcgatggtgatggggctgatcccggtggtgggcgtgccgctgccgatggtgtcatacggcggtacgcagatgatgaccctgatgatcgccttcggcctgctcgcctgcgtgaacacccaccgcgacgtccagctgcgccgccagcccgggctggagggctattgaaaacagcggggaaattcagggcgtcggaaaaaattcacgggacatcgaaaaaccctcttggcagaccctgctttcccttgttataagccgcgcaccgcacgatgcgggcgcatagctcagttggtagagcagctgactcttaatcagcgggtccaaggttcgagtccttgtgcgcccaccaaattcgaaaaccctccggtgcagagattgcatcggagggttttcttttttgtctgattatcttcagcgggtatgcgggctggtctacatgcatcgaagcctgccatgatcacccggcgggcatcaggaaaggacatggctatgaatcaggtaaggaagccgggcggcaaccagaccatgcatttcatggcggcagatggctcgtcggcggaccatgacgccgccgaggaaatcacgcgggcagagctccgccttgccggctatgttgtcgatatggaccggttccgcgccgatctcgcagcttcagccgatatgcctgacggtgcggagatcatcggtcggagcgccaggccgcgccgttgaaaacagaccggccgtgattaccgctgcggcgaccgcggcaacagcctgcgccccttgcgcatcagctttttcgggaaatgccagttgcggaacaggccgcggcggctcagtggttcgaagatcgcctcggggccgtcggggtccaggatttcgttgtcggccagccatttttcggtggggctgagttcgggcagttcatagggcaccagcgtgcggccctggccgcgcagatcctcgatcaccttgatcatcgagccacaggcggcgtagcgatcggcgatgtcttcgggcgtggtgtccagatgttcggccagcagatcgtcgcggatatgggcgatgcgcggcccgagggcggcattggccggcaggctggtgtcgatcaccacgtcgcattccgtatccagccgcatcgagcggttgttgaaattcgacgagccgaccctgagccagcgatcgtcgatcaccgtcaccttggcgtggacatagatcggcgtgcctttcgccgtcagcggatgatagatccggaagcggccatggcggtccaggcggcgcagcgcctcgaacagccgggcgcgggcggtgtccatggcgatcggctccagccagccgtcggcgatcaccgggttgatcaccaccacctcgggcccgtcctcttccagcaggcgggcggcgatggcgcgggccacccggcgcgaggcgaaatactggctttcggcatagatcagccgccgggcgccggcaatcagatccagatagagcgcctcgatctcgtggatcggctccaccccgtccatgcgcggctgggtgcgggcgatggcgatctccacatcccgcagccagggatccaggatcgcgggccagcagtcgccggcgccggtcaccgccggcagcgtctcgcccgaggcggcaaaccagcgcgcccgggccagatcggcgatcgcccgggcggccgcgccgtcgaaggcgctggtcgcatcatgccaggggggcgagggccggccgtcgggcagtgtgcgctcgggatcgtcatcagcatgggcgcggcggtcccagcgctggccggtcatgtcgatgccgccgcagaaggcgagcccgtcgtcgatgaccacgatcttctgatggtgcgaactcatgaagggatgggcgccgtcgagccggagcgtgatccgcggatgggccttccagcgcaacacgctccacagcgtgtcgccgcggaacagggctttgaaggcgccggtatcccagcgcagcagccggatttccagcgagggcgtgcgccgcgccagccacagaatgaaatcgcccagcttctccggcccctcctgcgggccggccgggcgaccgaagcggatgcgggcatcgaaatcccagccgatcagcaggatgctgtggcgcgccttcagcatcgccgcccgggcggcgttgaaataggcatcggcatcgatgatcagcgagaaccgctccgcccgggcggtccgccagcagttccggccatgcgcaagcagcgccgccgacggacgatgctccggaagggtctgggtcatgggcgggctgcgggctcctggttgcggcgatcacgattgcgatgccggtatcgcaccagatcccgcgggcgcggccaagtgatcagacggtgtccggttggtgatcctggacctgctgctctgcccgcgccattctgtgcggctttgtgcctggcatctgcccggcgcgctggtgcgacggagacatcggacgatatggccacggaattcgacggacgggtgcgtgacgggcggggtgacgatctgccggtcctgctgagcatctgggagcgatcggtacgggcgacccatgatttcctgaccggggcggatatccgtgatctggtgcccgtggtgcgtgaccaggcgttgccgtccgtccgtctgctgattgcagcggatgccgatggccggatcgcgggttttctgggcctcgacggcaacagggtggagatgctgttcgtcgaccccgatcatttcggatgcggggtcggacgggccctgatcgaggcagccgcggctctggcggggccgcggctcgacctcgacgtcaatgaacagaaccccggggcgcgggggttttatgcggcactgggcttcatcgaaaccggccgatcgcccctggacggacagggacgggcctttccgctgatccatctgaggcggagctgagaggggagaggcgctcagtcgatgggcgcgaggcccgcgaagcagccgtcgtgatagaccagggcggtcgcggcatcgcgggcgcggacctcggccacccggccgatgatcagcgtgtggctttcgaaggtcaccgtatcggccagtcggcaatccaggctggcggcggcaggcgccagcagcggcgcgccggtgatgccggtggtccagagggcatcctcgaaccgggcctcgccggcgcgcgccgggtcgccaccggcgaacagccgggcaagcggcccgtgatcggcggcaagcagattgatcgagaaacgacgctcggccaggatccggtcatgggcctgggctgagcggttgatcgccacggccacccgcggcggttccgccgtcagcgacatcaccgccgtggcggtcagccccgcccggtcgccgcgatcgcccgtcgccacgatggtgacacccccggcaagccggcgcagcccggcgcggaaggccgccggcggcacgacatgcgcttcggcatcggcagtgccggcagccggcagggtgatggttccatcggtcatgtccggagacctttccgtccagggatcgctgatgccagaggcaatatatgcgagtgactatcaatcgcgcggatcatgcctcatccgctgcccagaagatatggtcgtgatgcggcgctgtcgatgttgccgccatcatatcccgcaagctagggtcgccggtaacgagccgggagaagtcggatggcagggcagggcgaaagcggtgatcgggcagcggcgggcggcgggcggatgtcccggcgtagtggtgccatgcgcgacgaggtgatcgccttcaagcgcgaacggattctggaagaggccgccgccgccttttacgaacacggctatcagggcaccacgctggaggcggtcgccacccggctgggggtgaccaagcccttcatctattatcatttccgcaacaaggccgagatcctgtcggaaatctgccgccgcgggatcaccgaggcggtggcggcgctggatgcggcgcaggcgggcgagggcacccccgatcagcggctggcggcggcgatcgaggcgatcacccgcaccgtgctggaacagcaggcctataccgcgatctattttcgcgaagagaagaattaccccgccgatgacgcggtggagctgaaccgccggcgcaaggccttcgaccacaagctgtcggcgctgctggaggaaggggtggcggccggcgtgttcgagatcgaggatgtgcgcctcacggcgctcgccatcggcggcatgatttcctgggccttcacctggtacaatccccgggggcggctgtcgaccgccgagatctgccggcgcatggcggggctggtgctgcgcatggtccggcgccccgaataggcggggcgccggttccgcccgtcaggcggcgctttccagaatgccgcgcacgaccgcaggcccgtccacggtgcgcggattggtgcggatccagatgtcgtgcatggtcgcctcggcgatgcggtcgaaatcggccgccgtcacgcccaccgccgacaggctgcgcggcatgccgagcgccgcgatgaagcggtcggccgcatcggccgcagtttcgcccgccgcggcgcccaggctcagggcgatccggacctggcggccggcattgaccggcgcgttgaagcgcagcaccgccggcgccatcacgcaggaggtgtggccatgggccacgccggccacgccgcccagcatgtggccgatggcgtggctcgcccccatcggcacgccggcgacgatcgggatcatgctctgccagacgccgatctggcatttcagccgggcctcgaaatcctcggggtcggccttcacccgcggcaggccttcggccagcagctccagcgcgcaggcggcgatgccgtcgcaataatcgttggagagcagggagcccagcgtctccatggcatgatccagcgcccgcaccccggtcgacagccacagccattcgggggtatggcgggtgatggccggatccagcaccaccacgcgcggacccataccgcggctgagatagccctgcttcagcccggtcacctcgtcggtgctgccgcccagcggataaaattccccgcccgacagagaggtcggcacggcgatctgcgggatgtcgggatcgggcaccggcggcaccacgatgccgccgtcttccgacggatacatgtggtgcggttccatctccgccggatcggtccagcccatcttcgccgccagccgggcgaccttgccgccatcggtgatcgaaccgccgcccaccgtcaccagcaggtcggcaccgctttcgcgcagggtctggccaagggcgatcacccgggcgcgggggctgtgcggcggcatgtcggcgctgctcccgaccagccggtcacccaggccggcgcggatgcgtgcgatctcgtcggtttcgcggtcgagcgtgcccgaatgcagcaggaatacccggctggccccgatccgcgccgcttccgcagccaccgcctcggcggcaggtgttccgtacaccacctgctccatcggtgcgcaggcgatcaccccctgtttcatggcccggtctctcctccctgggcgggcgccggctcgttgcggccgcgtcccgtcgttgacgatcatatactgatcatcatttgaatatactgatgagtaggaagcggacaagagggcgcgcggccgcaagtggccgcatccccggccatgcatcgccgccccctgacctgcatgctgtcggatgacggatcggcgtctctgcctgctttggcatgcgtcatcccctcatccgacaggacctttgatccgatgcacgaccttctccagggcctgtggtcggcgatgcgtgaaaccgccgatcttctgggcctgaccgtgattgccgcctatctgggccggctgctcgtccatgtgggcgaagtgcagcgtggccggcggcgctttttcagcacgcacctgctgtgggaactggtgacggcgatcgcgatcggcatcgtcgccgacggcattgcccatcagctgggtctggccggcccgccccgcaccgcggccatcgtggccatcgcctatctcgggccccgcgggctcgaggaagtcatcgtgcggctcatcgccgtgcgccgcagctgagggagaccgatcccatggacatgtctctgcccgacgccgccccccgttcacgcctgttcgaggcgagcctgcagatcgtgctggcctgggagggcggcgagaccgtcaccgacgacccgctcgaccccggcggcatcacccgctgggggatcagcctggcctttctgcgccggatcgaccccggcgccgggcccgaccagatccggactctcggccgcgacgaggcggcggcgatctatgcccgcgacttctggcgcccgatccgcggcgaccagctgccgccgccgctcgccctcttcaccttcgacagtgcggtcaatctgggcgtgccgcgcgcggtgcgcctgctgcagcaggcggtgggcgccgatgtcgacggcatcatgggcccgcgcaccgtcaatgccgcccgggccgccgcccagcggccgcagcgcctgacccaggccctggccgacatggccgcaggccgtctgcagatctatgccacccgccccggctttccgcgcttcgggcgcggctggacccgccgggtgctggatgttcacgggcgggccgtggcgctcgccgtcgaagaaggagcagccgcatgaccgggatcgacgatatcctgatcgaccgtctgggcggtgccgtggccgaactggccggggccgggttgatgatcgccggcgcctgggctttgggtcgtatcgccggctgggcgggtgtcgcccgtgacgaccgggtccgggcctatctggaagcggcgctcgaccgcgcggtcgaccgggcactcggccatgcgcctgcgggcgagctggtgccggccgccacggcctatctgcgcgagaccgtgccccaggcgctcaagaccctgtcgatcgcccccgagacgctcgaccgcatggtcgaggcacggctcgccgcccgcaatgctgcaccggaaccgcagaagcccgtggctcagccgtaatcgctggcgccgacgatccggtggatgctcagtacctgacccagctcgtgttccagctcgccgcgcgggttgaactggcgcagatgcagccgggtcgcggtgcgccggacgaactgcttgatcaggccgcgggtcggcacatgcggatcgccggtgcggatctggaccaccacgaaacagccgggcgtgatcggccggttcgggttgacatggaccagttcgccggcgaagtagcgcggctccatactctccccctgcacgtagaccgcatagccgttggccactccggccaaaattggcggccgggcgacgtattcgttgaccgtgccgttgaaatcgaacgccccgtcatcgccgcccatggccgcaccatagaccggaaggtcacgtggtgtggcgccgggcggcgttgccgtttcatgggcgggctcggcgacgaagcctgtaggcagcgccgcgccggcaagtgtcggggagggatggggcgccaccggcggcagaccggccgtttcgcccagctctccgccggctgtcggcagatggtcggggaccagcagatcggccggcgcgcagtccagcgcccgcgcaaggcggctcatccactcggcggtcagccggcgggagcccttttccagcttgttgatctgtgacgcctcggttcctacgcgctgtcccagctcatgcatggtcagcccgcgccgttcgcgccactcgcggatgcggttctgcatggccataaaatggtcgatgtggccgcaaagtgcaatggccaaaacggacatattttgcttgatcagaggggtggccatggtcaatctttggggacgcaaccaaaacgggaggcaatacgatggcacgcagccctgaagccctgggttctcttgacgagatggagggggggtatgttcggcgcgccccgcgcgcaggaccttctggcgccggtgaaggcgctgttcgacgaggcggcgcagacgctgcgccggctgccgccggccgagcggccgcagcgggcacggatttcctgggatgatctgggggtcggcaacggccgccccgcgggtgggcagcgtgaggtccaggggcgtgggcttgcccccgatgcggcgcagatctcgcggctggatctggcgctggaaatcagcctccggctggaaccggtgcaccggcggatcatctgggcgcgggcggaaggccggctgtggaaggtgatcgccggcgatctggggctggaccgcaccacctgctggcgccactggcagcgggcgctgggccaggcggcgctgatccacgccctgctggttacggaacaccgcagccggacacgcatgtaagcgggccgccgtccgccgccggttcaatcgacggcgttgttcaggatatcgacgatcacgccggtcgccgctgcaatcagcaggatgtcgcggccggcctggatccattcatatccctcgcgccgggggagacgatcgtagagggggcccggcaggcgctgcttcgcgatgcccggcggcagcggtttgccccgcgccagattgcgcgcgatgcccggcggcagcggctcgtaggtgaacaggccgcgatggtcgccgacatagtcggtgatgatccggcgctcgttgcccgtgatgatgttcacattgatcagggccggtgcacgatcgtcatggcgatgatcatgccggccgggaccgcggtcatcgtggcggtcgtcccggtcatgcttcccatgtttcggcccgccaccgccctttgcatgcgggggcgggtcggccagcgcgggattgaagacaccgggcccggccacaatgccgggcagggcgatcagggatatggccagaacggccagatggcgccgcactgaccggtgcggggcagacgggtgctcagacatcggcttcgtcccattccgaccaaagctcggcttcagcgccccgagggctgtcgaaaccgccaccataacgatcatcgtaacggccgatggcgcggcgatgtcccggggctgccggcacctcgagggcgacttccagccccggcacagctgcgatcaccagcctgccgccgtcgccggccatggcgggcgtgcccagcatcgcggcaagggcggtgccggcggcgacgctgacgacgatccgccggtttctgcaggggaggtggggcctggcgcggttgcgcatcgggacatctgctccatcgggtcgaggcagggacctgtccacagaacaagaccgcgccccatatcgatccgatgatgccgcagtttgtggccgcgcgggcgtgatcagccgatgtgcgaactgtgaccggcggggggcggcccgtgccctcgcccgaaccctgccctcgcccgaaccctgccctcgccccaacctcgcccttggcaggctcagccgccggccctctgccagccggcggcgcgggcatcggcttcggaacagaaccagcgttcgccgtcgccttcgtcgatgcgggtgcgctcataagaccggctgccgggcacatgatacagccgccggccgtctttggagatgttgcctttgatgtcgcagcccttgggatggccgccgctgccggtggcgggcgtggccggcgcgcgctcgggcttggccggcaccagtgctcccggtggcgggttcagtttcacccccttgcgatggtcccagggcatcacgaagcggcccgaccacagcccccgtttcgcagccttcgcctcggcttcggccggtacatagtcgcggccgtaattgacataggccaccgccaggccttccgagaccatgcgccggttgatgtcctcgccattcaccgcacaacgccccaccacccggccatagcgatcgcgatcgacgatctcgcaggcgacggtgcgtcccgaggtcagccggtcgagcagctgtgtcgcgtcgcggccgcagcgccaggcacggttctgtgcatcggcgcagatctgcgaactttccggcgcatcgatgccgaacatgcggatacgggtgccgtggatgtcgagcgtgtcgccgtcgatcacgctggcacgaccggtgacgtcggcggcaagggccggtgtgatctgggccggcagggccagaagggcgagcagggcggcagccgcggaagcgaggcgggggaacatcgggctcctggtcggtcggaggagggggcaacaactcgaccgggagcttaatcatgatttcgaacttatggtagtaactgtcccgcgaaaacgcgcggcggcatgcagccggagcgcgcaggcgcaggtatgcgcgccctgcactgccgccacaagtatcgggctggcttgaaaagatgtcggggtgttgcgacatctgcggtccttgaccatggcccctggcgggccctatacccctttctcggaaaggcgcgttcatggcccacccgtgtcgtatgcgggtgcgggtggcgcgcctcgcagatgaggacatgacccatggcgagcgagatcgcgccggacgtctatgcaatgcgccattcctgtgcgcatctgatggcagcggcgatccgtgaactctatcccgaagccaaattcggcgtggggccgccgaccgcgaccggtttctattacgacatcgacctgcccgagccgctgaagctcgacgatctgcagaagatcgagcagatgatgcgtaagctgcgcaagaagaagctgcggttcgaccgccgcgaactgccgatcgaggatgcgatcggcttcatgcgtgagcatcaccaggattacaaggtcgagctgctccagctgctgcgggatcgcggcaccaccgccatcgccaaggagaccggcgacgacaccgccgtcgatggcgaccagtcgggcgtggacagcgtttcgttctacaccacgggcaatttcgtcgacctctgccgggggccgcatgtcgagaacaccggccagtgcggcgagttcaagctgatcaacatcgccggcgcctattggcgcggcaacagcgacggcccgcagctgcagcgcatctatggtctctgcttccccaccaaggaggagctggagcactgcctgtggcagatggaacaggccaagctgcgcgatcatcgcaagatcggccgcgagctgaagatctaccgcttctcgcccgaggtgggcgcgggcctgccgctctggctgccccgcggcacggcgctgcgcgacgagctggaattcctggcccagaaggaagagcggcgcgacggctatctgcgtgtcgtcaccccgcagatcaccaaggaagagctgtactaccggtcccggcatctgccctattatgccgaggacatgtacaagcccttcgagatcgacggcgagcgcttctatctgcggccgatgaactgcccgcatcaccaccaggtctatctggcggagaagcacagctatcgtgacctgccggtgcgcctgtcggaatacggccaggtctatcgctacgaggcgagcggcgcgctgtcgggcctgatgcgggtgcgcggcttctgccagaacgacgcccatatctattgccgctacgatcaggccaaggacgagttcctgaaggtcatgcggctccatgcccgctattatgacctgttcgggatcaaggactattatatgcgcctgtcgctgcccgatctcgacaagctcgacaaatatgtcgacgagcccgagaagtggctggcggcgctgaagatcatccgcgaggcgatgatcgagtcgggctatcccttccgcgaggtggaaggcgaggcggcgttctacgggcccaaggtcgacttcatgatcaagtcggtcatcggcaccgaatacgccatctcgaccaatcagctcgacttcctggccacccagaccttcgacctcacctatatcggcgaggacggcaaggagcacccggtctacgtcatccaccgggcgccgctgggcagccacgagcggttcgtggccttcctgatcgagcattacgccggcaacttccctacctggctcgccccggtgcaggccatggtggtgccgatcgccgaccggcacaacgactatgcccaagaggtgcgcaacctgctgttcgacgctgacgtgcccaccggcaccggcggccttcgggtggaggtggataccagcaccgagcggatgcagaagaagatccgcaacgcccagctggagaagatcccctacatcctggtggtcggcgacaaggaggccgaaaaccggaccgtggccgtgcgcctgcgcaacggcaccgatctgggggcaatgccgatcgcagaggtcatcgcccgcatgcgcgacgaggtggtcaaccgccgcgacatcgagctgccggtgatcgagaccgccggagatgccaccgctcattgagcggtgcagtctgcgcggtaaccgcatctgcacagaagccgccgggcagcggtgcccggcggtttttcgttctgtggtaaacctttggcgacaaggtgcggacacgtcgttgcattaaccatatccctggcataacctccgcgcgttttcgggacctgacatctcttgaaggaggcgtgcgtgaggcggacgaggattggaatcgccgggatcgcgctgatgaccgggctggccatggcactcggtggctgcgcgacgcaggggcagagccgttacagctataaggacgtcggccgggcgagcgaggtggccttcggcaccgtgctgtcgtcgcgccaggtggacatcaccggccagaacaccggcgccggcgccgtggtcggcggcaccgccggcgggcttgccatgtcgaatgtggggcagggcaccggcaatgtcgccgctattctgggcggtgcgctggtcggtgcggtcgcaggtgccgtgatcgagcaggcggcggccgaccgggtcggcatcgaatacgtgctgatcctggccaatggcaagaccatcaccgtggtccaggaacaggacgagggcgacgagatcttcgcacccggcgccccggtgatgatccagaccaatggcagctatcagcgcgtgctctccaccgccaacttgccatcggaagtgtcgcgccccaaggaagtgaagatcgtcgactgacccccgacggcccgctgacgtccagaagaaagccggacccgcccatgaagaagctcatcaccgtggccctcgggctgctgatgctctccgcctgcgccttcaccgaggattcgatccccgtccattacaccgccccggccaatctggagctggtgcagggggcgtcggacgtgacgctggaggtggtgggccaggatggccgcgtcgccaaccgcgatcgcatctccagcaagaagaacggctacggcatggagaccgcccgcatcctggcggccaatgacgtggtcgccgaggttgcgaacgcggtgcgcaccgagttgcagtcgctgggcttcaccctcggcgagggcggcatccacgtcgtcatcgagacccagaccttctacaacgacttcaagaccggcttctggagcggcgatgccgtggccgaggtcgccttcatgctgaccgcgacgaagcccgacggcacgctggtctacagccgcgcctatcgcgcggtcggcatgaacaaggacatcatgatggcctcggccgagaacgccgccccggcgctggaagaggcattgcgtgaggcggtccgccaggtcgttcaggacaaggcgcttcaggcggccctgctcgccgcgaaataaggtcgccccacccgccgacccaccccaccgccgggcagcgctgcccggcggttttttgtcgggcgcgctgacggcgaaggtctttggaatcgtttttcacgatcaaagggcttgaggaatcgctcttcacggcgtggaatcgtttttcacgacagccggaggatttgtcatgcgtgccgcatcggatgccgcgtttcccggtcgtgtgacggtctttggggatcggcgtctgccggcgcctgcaacaccggcggggtatgccgcgttgatcgaggcgtaccggctgaacgtgcctctgccgcgccgcggggagttccaggccctcaccgacgccgaggcggccgcggtggaggccctctatgccgatatcttcggtgaacgaagccaggccaggcgctgccgcctctctgctcctgcatccccggcgcgaccgtagccgtgtcgtttctcttcatggtatagttatcaccataagaaaagcgcgggatgcgcgcatctgatggcatgcagtcagatcatgcctggatgatcgctccggccccgcgtccagggaggagacaaggatcatggccctcgaacccgcggcgcggtctgcgctggcagagatgatcgacgccatcgacgggcgcggcttccggtcgcccgagctgatggtgatcggcgacaacgcgctcaacgggatgagttccgccaccctcgacggccgccgcgcggcggcggcaccgccggtgctggccgctgcggctgccgggctgccgatccggccggtgacgctgccccgggcggtgctggccgatatggagcaggcctgccgcgatctggcggcgggtgccctgaacgtcgccggtttccgtgagcggatcctgggtgatctggcgctgtgggaggcggatctggccggcccgaaggccgagggtccggcctggttcgacgtgctcgcgatttccggcgcggcggtggccgacctcaccgatgcggcctcgggcagtgcgggcggcgcgcggcggatgctggcgggagccgcgaagcgcttccgggccgccgcgggcctgccgggtgacgagctggtcgagatccatatgggggtggaaaccgtccataccctcaacccgcgcggcctcgccgaactcgacgggctgacccaggtcgaccatgtcgatctgcgccggcccaagcggctggtgatcggcgtcggccagaatgacgggctggtgagcgcgatcatggccggcaagcggatcgacgtcttcgaccgccgtctcgcccgtctgcccgaggcgatgcgccggctgggcgaggccctggcgccgggcctggaagagacgcagcgcgtggttctgctgggcctgccccggcccggcctggtcgccaatctccgtccgaagaccctgcacccggacgagcaggatcccggccgcgaccccaaggcgcgcgaccactggcggcgctatgtcggcttcctggccatgcgcggcgacatgaccggccgagaagtggtggagttcgacgcccacgccgccgaaacctggcgcaaggcggtggaggccttccgcggcgccattggtcgggcggccgaccgggtgatcgaggtcgatccggctgcggtgctggccccttacgaccagaagcatggcggcgcgggcctgccggtcgatgtcggcggccgccgtctggccctcggcaatctgatcaccgatcccgaaaccccggggctctacggcatcgacaacctcaatctcaacggcgccggccaggccctgatcgcccgcgcgctggccgatgccctggtccccggcacgggggacgcggtcgatatcgacgccgccgctcgcgccgaaccgctgctccacgatgccccgccgctgctcaacccggccgctttcctgatctcgctgctctcccccttcgtgacgttcgagcggatctgaggggcggcccgcagccgccggcatgtcacggtcttgtcgcaccatgagttgaatttcaggggcatgattgtcgggtcaggcccatgatgccaggaaccagatgccaggaaccagatgctcgaccggggactgagcgatggagcgtgtcgactatgccgacggccgcctgcggatcaccagaaacggcagggtgacggaggtggcaccgtcggagatcgtctgtatcgatgactgcgagctggaagacccgatccaccagggcgatgaacgcttccacatcatccatggccgccgacggcagggccagggccgattctggctcatcgggcctttcgtgccgggcgggctggcggcggttgcagccctgaccgcagcccatccggagcttccgcggcgcgatgtcgtggtgcgtgggctgccgtggaaattgcgggatcccggatggctggggctacgtctcatgcccgtcgccgggctgggggcgtttccggagcgcgccctaccaccagccgcccttctgacaggcgcccggcaagcggcatcttgacttacctgtctgactggccgattgacgggatgcatatgccattccgtccgaggctctgaagccatgcatcacgtccgcccgcaggcccgcaacgcttcatgccgtcagcggtagcggcatgacctggctcaccctcgccatcttcctggcggtctatgccggcatggcggccgggcgctggccggggctggcggtggaccggacggggatcgccgtgatcggcgggctggccatggtcatcagtggggcggtggcgcccgaggcggcgctggcggcgatcgactggccgacgctgatcctgctgttcgcgctgatgatcctgtcggcgcagttcgcgctcgccggcttctacgaccgggcggcggcgcggctggcggcgggacgggtgaggccggctctgctgctggggctggtggtggcggtctcagggctcacctccgccgtgctgtcgaacgatgtcgtggtcttcgcgctggccctgccgctggcccgtggggtgtgggggcgggggctcgatccccggcccttcgtgctggggctggcgggcggggccaatgccgggtcggcgctgaccctgatcggcaatccgcagaacatcctgatcggccagctgggcgggctcgatttctggagctatgccgcggcggcggccgtgccctcgctcgcggcccttctggccgtgcatctcgccatcgtcctggtctggcggcggcgctggcatctggcggcggacagcttgtccgggacggcccccgacatggggatggcgccggccgtcgaccgcccggcgctgatcaaggcggtggtggcgctcgttgcggtgctggtcgccttctcgaccccggtgccccatgtcgaggctgcggttgccatcgctgccgcgctgatgatcagccggcggatcgaaacccgccgcctgctggccgaggtcgactggtcgctgctgctgctcttcgccggtctgttcgtggtgaccggcgccttcgccgccaccggtctgccggggcaggcgctggcctggctcgcgggggccggtatcgcgccggaccggctggcggtgatggccccgctgacgcttgccggttccaacaccatcggcaatgtgccgctggtgatgctgctgctggccatccagcccgactggtcgccggcggcgctgaccgcgcttgccgtgctctcgaccttggccgggaactttctggtggtcggcagccttgccaatatcatcgcggtcgaacgcgtccgcagcctggggctggtggtggatttcgcgacccatgcccgatcgggcgtgccgatgaccctggccggcatggggctggcgctgctttggttcgtcgtttgacgcccctggacaggcaccggccagtccaggcagggtgggtacagtcggcgccccccggggctgccatcttcagcgaggacccgacgtcatgacggctctcacctggcggttcgacaacagctatgcgcgtctgcccggggccttttacacccggcaggggccgacaccggtggaggcgccggtgatggtggtcttcaatcaggggcttgccgatgcgctggggctggtgccgccgggcgggatcgacgaccggtctccggagcttgcggcgctcttcgccggcaaccgtctgcccgacggtgccgaacccctggcccaggcctatgccggccatcagttcggcggtttcaccatgctgggcgacggccgggcgatcgtgctgggggagcatctgacccccgatggccaccgggtcgatattcagttcaagggatcgggccccaccccttattcgcggatgggcgacggccgcgccgcgctcgggcccatgctgcgcgaatatctgatcagcgaggcgatgcacgggctcggcatccccaccacccgcagcctggcggtggtggcgacgggtgagccggtctatcgcgaagaggtgctggccggggcgatcctgacccgcgtcgccgccagccatttgcgggtcggcaccttccagtatgccgccgcccgccacgacgtcgccgggctgaaggcgctgctcgactatgccatcgcccgccatgatccggatgcagccctcgaccgggtgccggcgctggcgctgctcgatcacgtgatccggcgccaggcggcgctgatcgtggactggatgcgggtcggcttcgtccacggggtgatgaacaccgacaacatgaccatctcgggcgagaccatcgattacggcccctgcgccttcatcgacgcccacgacccggcgatggtgttcagctccatcgatcgcggtggccgctatgcctatggcaaccagccggccatcgcccagtggaacctggcccgcctggccggcgccctgctgccgctgatcgacgacgaccaggaggcggcggtggccgtggcgcaggagcggatccaggggttcgaggcgctctataccaccgcctggcaggcgatgatgcgccgcaagctgggcctggtgtcggaacagccgggtgatgccgcgctgatcggcgatctggtcgcctggatggtcgatcgtggcgccgaccacacgctgaccttccgccacctgacgatgggccggctgccggaagacggcgtctgggccgacgaaggcttccgcagctggcatgcgcgctggtgcagccgccgcgcggccgatgatgcgcccgaggccgagcagcaggccgccatggcggcagccaacccggtctatatcccccgcaaccaccaggtggaaatggcgctggccgccgtgacggaagagggcaatctcaccccgttccgccgcctgctggaggtggtgtcccgcccctacgaggcgcgggacggcctcgacgcctatgaggcaccgccgcccgtgggcagcggccgctaccggaccttctgcggcacgtaaaagggcggcggctgtcgttcagtcgccgtcggacgtggtcgaggccaggggcgtgggcggcacgatctcggtctggcggatcagcacctcggccgggatctccagcgcttcgtgcagcttgcggatcatctcgatcgaaagcgggcggcgccggttcaggatctcggcgacccggccgcgggtgccgatcatcggctccagatcccggcgtttcagccccagggcgttcatgcggtacaggatggcatcgatcggatcgggatggttccgcgcgaaatgctgcgcctcgtaggcctcgatcaggatggtcagaacctcaagccggtcgccttcggggctgccggccggggcgccccacagctgctccagctcggcgagcgccgccgcgtggtccgatccggtgcggatgggcttcaggctcgcggacatggttcacctccatgacgtcgattttatcgaaggcccggtgccggcccgcccagcggatccagacgatgcccctgtcgaagtcgacggccgtgaccaggcgatagccgccgtccttgatgccgaacaccacccggtcgacaccggtcaggcttgcggtcgggtattgccgggtcaatgcggcggcatccggccactgagccgccgaaacctcggcgacccagatgtcgagcgcggttctgaccgcccgtcggtccctgtggcccttcaggtcggcgatcagatcgtgaagcgtgctgcgggcgatgatcctcatggatcggactatacgagggaacccgctttgggatcaatggtcaaccggcgggcagccgtggggcgtcgccctccggctgtcatggactcgtgtcgtggctgcgctatcctgcgcctggaaccgataacggggagacgggcatggccggaacggcggcaggcgtgcaggtggtctggttccggcgcgatctgcgcccggccgaccatgcgccgctgacggcggccgcagaggcggcgcgggcggcgggtgccgggctgctgccgctctatgtcttcgatcccgatctctggcggcgggccgatctggccggccgccactgggcgttcctgcgcgaggcgctggtcgatctgagacgcgatctggcggcgctgggccagccgctggtgctgcgcaccggggccgccgtgccggtgctggcggcgctgcatcgcagccacggcatcgccgggctctgggcccatgccgacgacggcacgcccggcacccgcgaccgcgatgccgccgtggccgcctgggcggcgggggagggcattccctggcgggtgacgacgcccggcccggccgtcagggcgccgctgccggcccccgaagcgctgccgccggttgccggtatcgagccgggtgccatccccgagacgatcgaccgggtgatgggcgatcgtgtgccgggctggctgcccgacacctgccccggccgcccggccggggggcggcgcgccgggcttgccgccaccgcccgctttcttgagcggcggctgccgcgctatctgcgcgaccaggcgatcccggcggtggcgggagaggcggtgtcgcggctggggccgcatctggcctggggcacgctgtcggcgggcgaggtgcgggcggcggccgcccggcgccgcgacgagttgcgcgacctgcctgaggcgatcaccggcgcccggccgcgggcgctggaggtcttcggcgaacggctgaacctgcgcggcgcggcccttgccgacccgccgcaggatctgcccggcgagctgatgccccaggcggccggcaccccgctcttcgacgcctggagccggggggagaccggctggccgatcgtcgatgcggcgatgaaggcgctcgcccgcgacggctggctgcccttcaccttacgggcgctggtcatgcaggtggcggtgctgcatctggatctggatccggtgcgggccggcctggcgctggcccgcggcctggtcgactacgaaccggcgatccactggcgccggctgcgcgatcagaccgccggtgcccccgggggcactgtgccgcggccgggcagcgcggtgcgcttctcggaacgccacgatcccgacggccgcttcatccgcagccatttgccggcgctcacccgtctgcccgccgcctggctgcacgccccctggacggcaccggcggacgtgctggccacggcaggcctcaccctcggccgcgattacccgcacccggtcgccgatcccggagccaccctccgcgccgcacgtctccgccttcagatcgccatcgctgcagccgtgccggccgacacggccacggccccgccagccccgcgccggggccgccgcaagccggtcgatccgcggcagctcggcttcgatttctagagcttcgggatcggttttcggagacggaagaagagaggggcattcatgctgatcgcgcagatatccgacccgcatatccgcccgcgcggacggctttatcagggggtggtcgattccaatgcgcagctggccgcggcggtgcgccagctgaacgcgctttcgccggcgccggatctggtgctgctgtcgggcgatgtggtcgacgagggccgggcggacgaatacgccatggcgcgggagatcctgggcgggttgcacgcgcccctggtcgcgctgcccggcaatcacgacgaccgcgacgctttccgtgcggccttcgctgcggacggtttcctgccggccgaagggccgctgcatctggtggtggaggacaagggaccggtccgtgtggtcgggctggacgtgaccgtgcccggggcccatcacggcatggtcgatgacgcggctgcgtcctggctggatgccacccttgccgcttccccccaccggccgacgctggtgatgctgcaccatccgcctttcgaaagcggcattccctatatcgacatctatcgctgcctcggcgccgaccggctggcggcggtgatcgcccgccatccgcaggtggagcggatcacctgcggccatatccaccgtcatatgcagatgcgctttgccggcacgctgctggtcaccgcccccagcacgaccaccgccatcgcgctccgcccggagcccggggcagagcccgcctcgtttctggaaccgccggccctgttgctgcatcactggcgcccaggcaccggcctgatcacccacctgctgccagtggggatatttcccggcccctggccctttgcctgatctggcccttcttcacctgaatgcggcgtttcaggacagtcgcgccgtccgacgcaccgattgcggcggatggccgaaggcgcggaggaaggcgcggcgcatgcgttcggcatcgccgaacccggtcgtctcggcgacccgttcgatcgagtcgcccgaggactggacccgttcgcgcgcgacctccagccgcagccgctcgatcgccttcgacggggtcgagccggtctccgcggtaaagctgcgggcgaaatggcgcgggctcaaccccgcccgttcggccaggctttccaccgtcagcggcttgtcgaggttctcgcgcacccaggagagcaggggcccgaagcgcccgtccggggtcttcagctccagcagcgacgagaattgcgactgcccgccgccacgccggtggtagagcaccagctgccgggcgatgtctttcgccaccgcatcgccatgatcctcggccatcagggcgagggccagatcgatgccggcggtgatgccggcggaggtccagatattgccgtcgcgcaggaagatgcggtcgggatccagccggacctcgggatagcgggcgacgaaatcctgggtgcggcaccaatgcgtcgtcgccttgcggccgttgagcagccccgccgccgccaggacataggcaccggagcagacgctggcgatccgggtgccgcgccgggccaggtggcgcagcagggcgagcgtgtcgcggcagtcgaccgcctggtcgacgccgaagccgcccgcgaccaccagtgtggtgatgtcatccaccgcctccagcccgccggccagaacctcgacgcccgacgaactgcgcaccacgccggggcgcaccgcaatcatcccggcggtcgccgcggccggcaccagccgctgcgcgatctcgaagaccgaggcagggccggttgcgtccagaagctggaagtcgggaaagatcaggatgccgatcacggttctgtccgtttatgagggaactacggcatttcggatttaatccgaacatggcaccgtcatctcgtcaagtcgtttcgaggtgttcgatgtcaaagaatctgcggttcggtcttctggtctttccgaatatcacccagctggatatgaccgggccactccaggtgttctcatttctacccggggcagaggttcatctgctctggaaaaacacagatgcagtccagagcgacggcgttttgtcgatcacgcccacgaccaccttcgccgactgcccgcaactggacgtgatctgcgtgcccggcggctatggcaccgacgcgctgatggacgatgccgaagtgctggatttcctgcgccgccaggctgccggcgcgcaatatgtcacctcggtctgcacgggatcgctggttctggctgcggccgggctgctcgacggctaccgggcggcgacccattggagcgcggtggaggcgctggccctgttcgacgtgaccgtctcgcgggagcgggtctgcatcgatcgcaaccggatgaccggcggcggggtgaccgcgggcatcgacctcggcctcaccatcatcgcccggctgctggaccgtcaggctgccgagacgatccagctgcggatggaatacaacccggcgccgcctttcgatgccggttcccccgagacggctccggcggcggttcttgcggtgatggaagaccgcttccggacggcccggcagcagcggatggatctggtgcggcagatccgggcggggaggccttcccgcccggactgacgaggcccggccgtcacttgccggcagcggtcaccaggctgcaatcgctctcgctgagcgggcgataggcataggcggccgggatcgtctccagcacgttgtaataggcccagggcttctcctgcgcgcccggctgcttcacctggacgagatagaagtcgtggacgagcttgttgtctgcgcgcaaccgggcgccgggggcgtagatgtcgttgaccggcgtcgcgcgcatatgggcgacgacccgcccggtctcgtcggtgccggttgcggcaaccgccttcagataatgcagcaccgccgaatagaccgaggcctggggtgccgtgggcatggcgccgtggcggtcgaagaagcgcttcgcaaaggcccgtgtcccgtcattcagatcccagtaccaggcggtgacgccggtcaggccctgggcggtttccagccccatgccgtggatgtcggtcaggaacatcagctcggccaccgggcgctgattgccggcgctcatgccgaactcgttccactgcttcatcgaggtgaccagctgggcgccggcattggcgaaggcgacgacatctgcccccgaactctgcgcctgcagcaggaaagaggcgtagtcggtggtgccgagcgggtggaatacggcgcccatcgaggtgccgccggcggccttcagcgcgctttcggactccttcaccatgttctgcccgaaggcataatcggcggcgatgaagaaccatttgtcctggccctgcgccaccagccggcggatcgggccgctgaccaggttgtaattgtcgtgcagccaggcaaggccggtgggggaacactggctgccggtgatgtcggtggtgccgaccgcggcgtagatcaccagcttgtttcgttcgcgggcgatagactgtacggccagcgcgaccgccgaattgccgacatcgaccaccatgtcgacaccctcggcttcgtaccatttgcgcacgatctcgacgccgatatcggccttgttctggtgatcggccgcaacgatctcgactttgagcgacggcgccagcgccttgaaatcctcaagcgccagcccggccgcgaccaccgagcccgcgccggccagatccgacagcggccccgactggtcgttgaccacgccgatcctgaccacatcgcccgaaatgccggccgcgcttgccggcagggctgccggcccggctgcggatatggttatggcggcggcagtcagcagtcgaccggccaggccgcgtgtcttcgacacggacctgtcgtccgtcttcatcgtcatgtcgtggtccccctgtggcgtccgttcccgcagtcttcccctgcgtgcacggcccgatcggcaagttgatcctgcatcttctgatcgggccgtcttatacagtcgaggctaagggggtgtcagtatgtccacaagggcggatttccggcgttttctgccatgatcaggacatgcgccgggctgtttctggtcttggccgtgcggccgggtgtctcagcccggctcatgcccccagctctgggtcagctgcggcacgccgccggccgaccagccgccatcgaccggcaggaccacgccgctgacataggatgcggcatccgaggccaggaacagggcgacccgggcgacgtcttcggggctgccctggcggcggagcggcacgctgcgctcgaccatggcattggcctcgggcgtgggggcaaggcgggccatgccctcggtgccggcgatcgggccggggaccaggctgttgatgcggatgccttcaggcccccattcctgggccagcacccgggtgatcatgtcgacgccggccttggcggcgcagacatggacctgcagctccatcgcctggaaagcctgcggggccgatatattgacgatcgcggcccccggtttgcgcagatgcggatgggcttcgcgcatcacatggaaggtgccgatcaggtcgatatcgaccacggtgcggaagccgttgggtgagatgccgagggcaggggccgggaagttgccggcagcgcccgagatcagcacgtcgatcgggcccagcgccttggctgccgcctcgaaggctgcgcggacctgggccacgtcgcgcacatcgcattgatagccctcgaccgcgccgccatgggtggcgagctcggcaacggcggcctgaaccttttcgggcttgcgactggccaccgccaccgcggcaccggcccgggcgaagccatgggcgatgcccagattgatgcccgaggtgccgcccattacgaagacggtcttgccggtgaaatcgaaactgaagccggtcatctgccgggtctcctctcctgtccgcccctgcggatgccccgcgggtttgcgccggttgggcccggtgttcgatgggccggtgtcttatggggccggcgtcttatggtgcggggcgttcagcataagcgggcaggcgggagaccggaagcggggctgcatgcccaacccggtttcaagtcgcgttggcatggcggtcgacggccggctcctgcatgatttcatccgcaaccggacagatagtgtccggacgatcatccgggagaggagatgcgcctgatgactgaccaacccctgagcggccaggtcgtctgggtgaccggtgccggcagcggcatcggcgaggccggggccgtggcgctggccgaagccggtgcggtggtctatctgagcggaaggcgggccgagccgctggaggccgtggccgggcggatccgcgatgccgggggccaggccctgatcgccctgctggacgtggccgacaaggccgaggtgaagcgggtggccgacgagatcctggccgcccagggccggatcgacatcctgatcaacagcgccgggctgaacgtgccggaacgcgcctggaacgtggtctcgccggacggctgggatcaggtgatccgggtcgatctggacggcgccttctattgcacccatgcggtgctgccggcgatgcgcaaggccggcggcgggctgatcatcaacgtctcgtcctgggccgggcgctacgacacgcgcctgaccggccccgcctacaactccgccaaacatgccatgctggcgatgaacgccagcctgaacatcgaggaaggccagaacggcatccgcgcctgcgcgatctgcccgggcgaggtcaacaccccgatcctggaccgccggccggtgccggtttccgccgaagacaaggcgcgcatgctccagtcggaagatctgggcgcgaccatccgcttcgtcgccaccatgccggcccatgtctgcctgaacgagatcctgatcagcccgacctggaaccggctgaacgtgatctgatcggggccgggtcgaaagccgggctggccgccaccattgacagcggcggcccgatcgccgacatgcaggggcgccggatgcccgccggcgccccggtcccgctctcttcgcgggccccgcagaggagagacgagaccttgcgcatgcagcacgatccccgcatggccgagcagctgcgccgccggcagccgatgttcaacctgccgcgggcgacgcagatcctgatcgccatcaacgtgatcgtgcatctggtgcgccagatcctgccccagggaaccgactgggagctgatcgccaatgcggcggtcgatccccgcccgctatacctatggccccggcttcgacctgccgtcgatcatcgcgccgctgaccttccagttcctgcatggcggctttctgcacctgctgttgaacatggcgctgctggcggcctggggcgcgggtgtcgaacgggtgatcggcccgctgcgcatggtggtgttctatctggtctgcggcggggccggcgcgctggcccatgtgctgctctatcctgagagcatggtgccgatgatcggtgcctcggccgggatcagcgggctgtttgcgggcgtgctgatcatcatgcgtcgtcaccgcgccagcggcggcgccatcctgccgctggcgctgctctggatcgcgaccgcggtgatcacgggcatctggggcacgccgggagcagagggcgaatcggtcgcctgggtcgcccatatcggcggcttcctggccgggctggcgcttttccccttcgcgatgcccaggcgctgaaccgtcagagggggccgtcagaggggatgggccttcagcgccgcccgccaatgggcggcgcgcgccttcagccagtcggtgacgacatagggcgccggggtttccttgcctgggtccatcacctccagcacctcgaagcccagcccggcctcgccgtcgccggcccaggcggcctgaagatcgcgcgcccggtggctgccatggcgcagcgtgaacaggatccggttgcggatcgtccgcacatccggcgccgaccccacccagaccgcgccggtggtggccgagcgcagggcataaatgcccgcggcgctcctgcgctccttccaggcgtcgatcgccgccttgcgatcctgccggttcatctcatcgtcctttctgccattttttacccgggtaaaaaatgcgataccatccggcatgcggtttgccaagggaataatacccgggtataaaaccggtctcgcgcaccgaaaggcccggccgatgcccgtcaccgcctccatcccctgcaccgcctccaccccctgcaccgccttcgacggcccgcgccgcatcgccgccggcccgctctcccgcgtggcgccggccgtgaaggcggtggtcgaggcggggacggccggcccggttctggtcttcgacgaccggagcggcgcggtgatcgatctggatctgcgtggctcggccgacgaggtggcggcacgcctcgcctccgacccggtgccggacgaggcaccgcgtggtcgcggccggccgaagctgggcgtggtcgcgcgtgaggtgaccctgctgccgcggcactgggactggctggccgaccagccgggcggcgcctcggtcgccctgcgccggctggtggaagaggcacgccgccgcgatgccggcccggcgcgcatccgtgcggcccaggctgccgcgcaccgcttcatgaccgccatggccggcgacctgccgggatacgaggcggcgctcagggcgctgcatgccgccgaccgcgcgggcttcgatgcggcgacgaccgcctggcccgccgatatcgccggccatgcccgccatctggcctccgctgccttcggtgagggcgcgtcggaaaagggtcaatcctcctgaccctcaccccgagaaagcctcgtttgcggggggcaggccgtctgccggaagatcgggccgttccaggtgatcggaacgcccgtcatccccaggccggcggcccctgccggcagaggggcgttcccggcgtgcagtcgtcccctccggcggctgcacgccatttttttggcgacagtcttccaccagtccgcccatcctggccgtatccccagccaggagagccgatgatgaatgtcaggcaggcaacgccggaagatgtgacggtctgcgtggcgctcgccgaggcacgccgtgacgcctacgaggcatatgagccccggttctggaagaagtcgccagactctgcttcggcttgccgaacctggttcgagacgctgttctccgacgggcgaagcatgtgtttcgtggcagaggaggagggcagcatcctgggcttcgtcatcgggcgcggctttcccacgccgcctgtctacgatcccggcggtgccacggccatgatcgatgatttctgcgtcgtcagcgcggaccggtggggtgatgtcggtcgggccctgttgcgggacatccgggcggagatgagacggcagggctttgcccaggtggtcgtggtgagcgcccgcagggatctggagaagacggcgttccttgaggaagccggcctgtccctggcctccacctggtggacctctgccatatagcctccggttctgccggcgaggccttcccgctcctgtccgatggtccgacaatccgtcttcatatcgtgcatttttgcagaagatgtcagaatctttttgcaggacataggccgtcgtatccctggcgttttgcggagtccggtctgttctcaaaaatgctgcacccgcacagtggatccatattgtggatcatctgccctgatccattgacccgccctgtctcagcctcctaagatggccaggcaatatccttacaaaaagagcggccgagtcgacatccgaacagtgtttgaggcgccatccgggaggaaaccggaatgtggcgccttgggacatgggatggcgggatcggcagccgatgcatcgaacggacgcttgttcgaacaatgacagggccggcgggtggctcccggacggcacctgaagggaggaaccaccaatgaccatgcgcacgcgcctgggccgcctcgtctgcggtctggccggcggcgtcgccgccgcggcccttgccctcggggcggttcccgcctcggccgagaccttcaagctcggcatcgtcaccttcctgtccggccaggccgcggaagccttcggcgtgccggcggcgaacggtgccaagaccatgatcgccgggctgaatgccggccagctgccggccccctatgcgaccaagggcttcggcgggctcgaaatccagccggtgatcatcgacgaggccggcggcgccaccaagcaggtgcaggaactgcgcaacctgatccagcgcgagcaggtggacgcggtggtcggctatatcagctcgggcgactgcctggcggtggggccggtggcggaagaactgaaggcgctcctgatcctgttcgactgcggcacgccccgcatcttcgaagacaacaagttcagctacgtcttccgcaccgccgcccatgccaccatggacaatgtcggtctggtccgctacctgaaggaccacgacgtcaagatcaacaccttcagcggcatcaaccaggactatgcctggggccatgacagccgcaacgacttcgtcgccgcgatgggccagctctatcccgaggcgaagttcgaagccgatctgctgcccaagttcggcgccggccagtacggcaccgaaatctcggcgctgctccgccagggctccgacgtggtctattccagcaactggggcggtgatctgcaggcactgatcctgcaggccggtccgcgcggcctgttcaagcgcagccaggtcgtgctgtccgctgccgaccatgtcctgccggccctgggcgacaagatgcccgacggcaccatcatcggcgcccgcggcgcctatggcctgatgagccagcccagcccgctcaatgactggtggcagaagacctacaccgccgagcatggcgtctatccggttcaggcgccctaccgcatggcccaggcgctgcttggcctgaagaccgcggtcgagaaggcgatggcatcgaacggcggcaagaagccgaccccggacgagatcgcggccgcgctcaagggctccagctgggaaagcccggccggcaccatcaccatggccaatggcgacggccatcaggcgatccaggacatcgctttcggccgcacccgctatgacgccgacaagaagatggtggtgatcgaggatgtcggccgctatccggcgaagtgcgtgaacccgcccgccgacatgaaggcgatcgactggatcaaggccggcttccccggcgcagagtgcaactgacctgatccttcctccgcggccggtccggccggtgggcaatccgccccgccgcccggaccggccgttccgtctcgggcgcaagccccacccgtcgtcttcccggagacctctccgatggagcttctgctcaccgtcctcgtggacgggctgatctatgcagcctggctgttcatcgtggcgctggggctgaccctggtcttcggcgtgctgaagatcctgaacatcgcccatggcagcttctacgcgatcggcgcctatgccgccgcctcgaccgtcggctggttcgcgagcctgggtcttgcacccgaatggtcgctgttcgccatgctgctggcggcggccggcgttgcggcgctgctggggccgctgctggaacgcggcctgctgcggctgttctacggccgggacgaggtgctgctggtgctggtcacctatgcgctgttcctcatgctggaagatctggtcaagctggtctggggcgtcgatccctattacgtgtcggagccctatatgctgttcggcaatatcgaggccgggccgctgttctatgtcggctacgacatcgcgttgatcgggctggccgtgctctgcggcctggcggtctggttcgggctcaatcgcaccaccatcggaaagatcgtcctcgccgtcatccacaaccccgagatgtcggcttcgatgggcgtgaacatcaaccgggtttatgtcggtgccttcgtctgcggcgtgttcctggcggcactcggcggtgcctttacctcgccccagatctctgtgcagccggggctcagcgtcggggtgatcatcctgagcttcgcggtggtgatcatcggcgggctcggctcgatcgagggggccgcggtgggcgccctgatcgtcgggatcgcccgcgccggtgcggtgcatctggtgccggatgccgagctgttcatcatctatctcgtgatggccgcggtgctggtcttccgtccggaaggcctgttcgcccgcgtccaggcgcgcaagatctgacgggggtgcctctgatgtcgacccgatccgccgtcctgcgcccgctcggggtggctgccctggtggtggcggccctggccgcggccggcctggcgctgccgtcctggctgctgttcctcgccaccatggccatcgcccatgcggtggtggcgcttggtctcgtcttcatgatgcgcggcggcctggtctccttcggccagggcctgcccttttgcctcggcgcctatgccgccgggctggccgggccgtggctgggccttgccgatgcggtctggctgctgatccttggcggcatcaccgccggtgtcgtcgccgccgtgttcggcccgctgctcgcccgctatcgcggcatcttcttcgccatgctgacgctggcgttgtcgatggtgctctacggcctgctggtcaaggccacgccgctcggcggctccgatggcctcaacatcgcccgaccggccattctgggcgtcgagcccacggccgagaccgcagattacgcgctgttcctgctcgccatcgtcaccgccggcatcctctcggcgatcgcggccgcgcatttcaattccgtgcgcgggctgatgtcgctggcggtcaaggagaacgaactccgcgtcgaatacatgggcgcctcggtgcgctcgatgatggcggtgaatttcatcgtcgctgcggtctatggcggcatcggcggggcgctcgccgccatcgccctcggccatatcgagccgaccttcgcctactggaccacctcgggcgaaatcgtgttcctggcgatcctgtcgggccaggtgagcgtggtggcggtgttcgtcgcctcgctgatcctggaactggtgcggtccttcgccaatctctacttccccgagacatggcagctggcgctgggcgccttcctgctggcggtcattctgttcctgcccaagggcatcgggtcgatctggcatcgcggccctgcgagccgccgcggctccgccgccgacgagccagtcaccgatgggccagtcaccgatgggcctcttgccaaggagagtggccgatgaacaaggcgaccccggtgctggagacccgcaatctccagaaatccttcggtgccgtcaccgccgcgcgcgacatctcggtcgcggtggaggcgggcacgcggctcagcgtcatcggctccaacggcgccggcaagaccaccttcgtcaacatggtcaccggctatctcaagcccgacgaaggatccatcctgctggcgggggaagacgtcacccggctggacccgcggcggctgacccgtcgcggcatcgcccggtccttccagatcccccaactctgcgccgagctgacggcgctcgagaacatgctggtcgcgcgggcggcggccgagggcgggctgcccttcttccgtccggcgcggtcggcagaagcgcgtgatgcggccctcgcggtgcttgagcgtttcggcctggcggcgatcgccgatcggccggtgctggaactggccggtggtacccgcaagctgctcgacatcgccctcgccatgaccggccggccaaagctgctgatgctggacgagccgaccagcggcgtgtcggcggaagagaaattcccgttcatggaccggatcatggcggcgctggatcgggacggggtgaccgtgctgttcgtcgagcacgacatggacatcgtcggggcctatgccgaccgggtgctggccttctatgccggccagatcatcgccgacggcgccccggacatggtgatggccgacgagggcgtgcgccggcacgtcaccggccactgacggcggaggagggatccccatgctccagatcgatcacgtctccaccgccatcgcctcggtccgggtgctgcgcgatgtgaacctcaccgtcggcaccggccagatggtcgggctggtcgggcgcaacggcgccggcaagaccagcctgatgcgcacggtgatgggtcatctgccggtgaccggcggccggatcacgttcgaggacatcgacctttccacccggcccaaacacgcccgggcggcgctcggcatcggcttcatgcaggaagatcgtggcctcgtccctgaactgacggtggaagagaacatcctgctgccggtctgggtgtcgaagagcctgaagcccaagccccggctggatctggtctacggctacatgcccgagctgaccgagatgcgcgaccgccgggccttgcagctgtcgggcggtcagcagaaactggtggcgctggcgcgcgctctggccgtcggcacgaaacttctgctgctggacgaacctttcgagggcgtcgccccggcgctggcccagcgcctggccgatgtcatcggccggctgcgtgccgagaagcagtcgatcctgatctcgcattccgacatgaaccacgacaaatcgctctacgacgacgtgaccgtcatcgaacgcggcgccaatgccgcggccggtgctgcggcgcattgagctgccgccttccgctccccagtcagatgcgaagccagaccgatgtcccagactgatcagaccaatcccgctcccgttctccggcgcgaactccatttcggcgaccgcgtcctgccctgttacgccgatcgccccgccgatctgggcgcgctggtccgcgccaccttctcccgcatggtcgaggccgaggcggtgatcgacggcgaccggcggatgacctatgccgggctggaagcggcatccgaccgggtggcgggtgccctggcggcggcgggcgtggcccagggggaccgggtcggcctgctgctcggcaaccgggccgagatcgtgaccgcctgggtggcctgcatccggctgggggcgatcgcggtgccgctcaacacccgcgagcagaagcccgaactcacctatgtgctgggcaattgcggcgcgaaggccgtgatcttcgaggacgagcttgccgaccgcctgcccgatgcggcggatgtcccggcgctcgccctgcgcatcgccgtgggcgatggtgacgggccggcgcccgcgggcgctgtgccctgggccgagatcgaggcgggccggcccttcggcggctgggccgcggtcggcgaagacgacaccgccgtcatcctttatacctccggcaccaccggcaagcccaagggtgccgagctgtcgcacatcaacatcgtccattcctgcgagcactatgttgatcacatggcgctcaccatggacgggcgcgagcgatcggtgctggcggtgcccgcaacccacgtcaccgggctggtggcggtggtggcgctgatgatccgggtcggcggcgccacggtgatgatgcgcgccttcaaagcgcccgcctttctgaagctcgccgaagccgagcgcatgacctatgggatcatggtgccggcgatgtacaatctctgcctgctccagcccgatttcgccggctacgacctcgccgcctggcggatcggcggctatggcggggcgccgatgccgatggcgacgatcacgcgcctggccgaactgctgcccgggctgatcctggtcaatgcctatggcgcgaccgagaccacctcgcccagtacgatcatgccgctcggcgaaggtgccacccggggcgacaccgtcggccggccggtgcgctgcgccgagatccggatcatggacgaggccggccgcgaggtggcgcccggagtgttggcgcgcacttaaaactgacccaggctgcgcgttgaactttgacccacccggtgtacggggctgagggtatcagttggtggtctgggtggtggcctcctttgccctgattctggctttggtcttgttggcggcggtgctgttgcgcagccgccaggagtcgttgccggtctccaggatgtggcagtggtgggtgatgcgatccagcagcgcggtggtcatcttggcgtcgccgaacacctgaccccattcggagaaggccaagttggtggtgatggcgaggctggtgcgctcgtagagcttgctgatcaggtggaacagcagcgcgccgcctgagggggtgaacggcaggtagcccagttcatcgaggatgaccaggtcggcataggtcaggcgcagggcgatctgcccggccttgccctgggcctgttccttctccagcgcattgaccagttcgatggtggagaagaagcgcacgcgcaggcgatgctggcgcacggcctggatgccgatggcggtggccaggtgggtcttgccggtgcccggtccaccgacaaggacgacgttctcgggggtgtggatgaagtcaccctggtggagtcgttcgaccagtgcgcgatcaacgggactggccgcgaagtcgaacccgagcaggtcacgatggacggggaaacgtgcggccttcatctggttggcctgggcacgaacctgccgttcggcggactcggcctgcagcagttcggccatccagtgttcgggctccatggtgtgcaggcgcatcttggccagcagttcgggccactggctggccatgccgtgcagcttgagctgctgcatgcgcagcggcaggtcaggcgtcgacatgatctgcctcccgcagggcgtcgtagcgggccggatcggacaccggcggatgacgcagcgtcactcgcgaggcgaccgtctcgatcgtgcggtccggatgctgcaatcgccccagcacgttgagcacgtggtcggcgcgcaccaggccggactcgagtgccagttccaccgccaccagtaccgcttcgagcccgtgcacgggtacggcggccagcacctgggccatggcgcggtcgccgtgaggctggcgcagcaacacctgctgcagcttgcgcagcggatcgggcatggacaggaacggcgcgccgtcacgcagtgcccccggcttgcgctggaccagggcgatgtagtgctgccagtcgtagtggacccgatcacgctcgaagctgcgccggtggcgggcgacctcggcctcgccgaccaccacggccagttcgaagggatacacgcgcaggctggcgacggcgtgggcgtgttcgcacggcacgctgtagcggttgcgctggaagctgaccagcgcggtcgaactgacccgcaccggccgctcgatgtagccgtcgaagggcgcgggcatcggcatcaggtggggctgttcgtcctccagagcttcggccacggtgatgtcggaggcatccggatgcgcctgcatcggccaagcggcgcggcactcgctggcgagccaggcattgagggtgtccagatctggccagtggcgggccccggcctcgatccagatctgtcggcgccggtcctgcacgttcttctcgacccgccccttctcccaacccgcggcgcggttgcagaactccgcggcgaacaggtagtggctggtcatggcgtggaagcgggcgttgacccgccgttcccggtgctggccgatcccgtccaccgccgtcttcatgttgtcgtagatgccgcggcgcggcacgccaccgaaggcggtaaacgcctgggtatgagcatcgaacagcatctcgtggctctgggtgggataggccaccaaccagaaggcgcggctgcaggccagcttcacgtgggcgagatccagcggcatcttggcgtggctgccgacgaaggcgtactcgcggctccagtcgaactggaaggcttcacccggaggaaagtgcaacggcacgaaggccgggcggcggctggcgccgccggccgccttccactggcggatgaaggccgtcacccgggtgtaggtgcccggatagccgatcgcctgcaactgcgagaacagcaccttggcggtgcgttgttcccgccggggacgatggctgtcggcacgcagccacgtctccaactgggaccggtagggatcgagccgggagggcgaggctcgcctgggatagaccggctcggactggccgctgcgcagccatcgccggatggtattgcgggataggcccgtgcgcttggcgatctcgcgcagcggcaggccatcgcggaaatgcatccgccggatcttggccaacatgaccatggtgatcactcctgaaatcccccgagcaaaagatgctcaggatgtgggcttcaggtgggtcagttttacccgcgcatcaccgccgaaagtgggtcagttctggatgcgcgccaacagcgtcaggcactttcgagcattgccgcatcatttagcaaccgttgaatgcgctggcgagtctcctctggaataccttgcacagacgagtcaggtccgggcctgtttggctgctgctgggtgcccgcgatgacccgcacgaccatgcccaaatttcctggtgtcacgatgtcgatggctgcgcgatcacccaggtccggatgtgggcgggtcagcatccggtacaggtcccacggatccgcatgcgggcactggttcatgagcacctgtgccagcttgtgcttgaggggtaccagctgccagtcgggcacgcgttgcccgcggttgcccaagctgatggacagcagcttgcccgccttcagctcgcggttgatctggtccttggacttcccggccaacttgccgaacagcgggaccggcagactgctcggcgattcgtagatgaccagcatttcctcgcgctcgcgctggatgacagacacctccggctctggcgcatgcgtcgggggcggtggtacctgcgacagtcgctggaatgtgattcccccgtcgtttggcgtcacgacgatgggttcggccaccacaggcggaacggatgccgcagaagcagcagcgacgatggtgttgggcttgtcctcctctgccatggccggcacgccctcgatatggatcgtgaggtgcgcgctggccgcttccacttggccctgttcgagcagatcgagacgatccgcccagtcctgcatcatccggcggcgcggctcaacatacttggcgtggttgtaggccgaactcaccttgttcgggtccgagtgcgaaagctgcgcgtccacccaaatcttgggatagccgatctcgttgagcgccgtcgagatggttccgcggatgccgtgaccggtcagttgatcctcgtagcccattcgtttcaaggccgcgttgagggtgttctcgctgatgcgcttcttgagttcgctgcggtgcgtgagcagatggacctgggccggcctcatcacacccaacaggtagcgcacgatctcgatggcctgcacggacaacggcacgatgtagggcggaacgtcctgcgggcgcttgccggccttgcgcatctcgtcttggagttgcttgacgatctgcggcgggatgatccacaggccacggtcgagatcgaactggtccggggtcgccagccgcagctcgccggtacgcacgccggtcaggaacagcagccggatgccgagttgggtctgccaaccacgagggttgtagagcctgagcttgtgcaggaactcgggaagctccggaagatgcaggtaggggttgtggttcaccgggggcttgggctcggccaccacgtccaggtcggaggccggattggcttccagcccctccacgatgacgagggcatagcggaacaactgccccagccaggtgcggaccttctcggcagtggtgaacgccttgcgctcctcgatcctcgccaggacgcccaggagttggggccggcgaatgtcgtagatcgacatctgcttgaggctaggcagcacgtccttgttgaagatccgcaggatttgcgacagcgtgctgttcctgccctccttgatttccttgcggcgatgctcgacccacgcatcgaagacggccttgaaggtgtagtcggccgcaagcttgaccgcgtgtcgcttctgtttccgatcggtatgggggttgacgccctttgccagaagcgcccgggcttcgtcgcgcaaggtgcgcgcttcgcgcaaaccgatctcggggtagttccccagggagatgcgcttttgcttgccgagccagtaatagcgcaaatgccacgacttgccgccggtgcgggcgaccaccaggccgaggccatcggtgtcggggatgctgtaggttttctcggcggccttggcttgccgcacggtcagatcagagagtgtcatcatcaagctcctaagtcttggacttaggcccgatgctgcttgtcatcccgatccaaccccagcaacaacccggaaccggcacgacccgcattctttggccttgtttttggcctcaaaaatggtggctgtcagtggactttcgtggctttcgctggaatgaaaaaaggagccgaagctcctcttttcaatgacttacagacgtcagtggaagtctgtagatcataaattggagcgggatctgagactcatcatggggtcatagaccagcgccatcatgatgacccagatggcgaacagcgaaaaggcacaggcgcggcggacggacaccgccgcggcttgttcgatgagatctgtctgcatctgagaacgacgggctgaggccggctccttgggggacgggccgacggtgcgttgcggagacggcgcgttgtggaacggcgacgggcagaggtgccggacggcaggaccacgtgacggaggaagagcacgcgacgggagaacacgggagcaggggccgatacggcagacgacctgcacctgttaccgaagatgggggccccgtcacggcgacgccagtggcaaaattggtgcgtttatcctagcccgcggggccccggcctgtcatcccccgatacgagggcatgtcatgaccttctgcgcgaagaggccccgtccgcgcgatcttcaggcgaaatttcatcggaatgccgtgtggatatcacgcgggggcgttcaggcgcggcgccaggcccagattgtacatcaccagccagaaaatgattcgcaggatccagagataacccgccgccaccagcggccgcagccccggcagaacgaaacgcggggtcagcggcgccgtcagccgcagcaccggatcggtgatccggcagaagaagcgccagatgtagttggggtcccccggccggatgaaggccgagagcagggcgcgcccgatcagggtgtagatcagcagcgacagcacgtaattgggcaggttgtaggtccagtaggtccagaagaacggatcgaactgcatggggtggtgcggtctctcaacgacggcggcgccggaaggttactccctccggcgccgcgctggcttgacgggcgatcggtcagttcttcaggccctgggcataaggattgttctcggccaggcgggcgctcggcacccgcacgaactcgatgaaatcctgcatgtccttcgacggttcccgggtcatcaggctgaccgcccaggtgaccaggaagccggcagggatgccgaacagaccggccgagacgttccgcacgccgaaccacagctccatgccataccactgggtgccggccagatagaacaggcaggctccgaggccggccagcatgccggcacaggcgccagccttggtcgtacgtttccaccacacccccatcacgagggcggggaacagccccgacgcggcgatggagaaggcccaggcgaccatggcaagaatgccggcagggcggaacgaggcgacataggccgcaagcatcgcaaccacgatcagcagcacccgggccacgatcagccggcgggcggcgctcgccttggggtcgatcatcttgtagtagatgtcgtggctgagggcgttggcgatggcgagcagcagaccgtcggcggtggagagcgccgcggcaaggccgccggccgagaccagaccggcgatcacataggggaggccggcgatttccggggtcgccagcacgatcgcgtcattgttgatggtgaattcggcaagctgaagcagcccgtcgccattggcgtcgcggatggcgagcagaccgatatccgaccagatccgcacccagtcgggcaggctggcgatgggctggccgatgacgttggtatagacctccagcttggcgaaggcggcataggcgggcgcgctgaaatagagcaggaagatgaacagcaggctccagcccacggaagaccgcgcctcgcgcacgctgggcgtggtgaagaagcgcatcagcacatggggcagggcggcggtgccgaccatcaggcacagcaccaggctgaagaagttcagcatgtcgccgtcgcgggcgaaggcggtgacatggccgaccgcaacgccgagcgtcggctcgatctgctcgatttcctgcagcgcatagccgtacatgatctgcggcaccggcacgccggtcagctgcgccgacatcaggatgatcgggatcagataggcgatgatcagaatgatgtactgcgcaacctgggtccaggtgacggcacgcatgccgcccagcatcgagcagaccagaatgccgacgaggccgacgaagatgccgatctcgaacgggatcgccagaaagcgcgaggcgatgatgccggcgccggtcacctgggccacgacataggtgaaggaacacatcatcagcacggcgatgccgatcagccgtggcgcgtgaccgtcatagcgggtgccgagaaagtcgggcacggtgaactggccgaatttgcgcagatacggtgcaagaagcaccgccaccagcacgtatccgcctgtccagcccagcacataggcgagcccgttgtagccggaagcatagagcgtgccggccatgccgatgaacgaagcggcgctcatccagtcggcggcggtggccatgccgttatagagggcgggcacccgccggccggcgacataatattccgagacctggaccgtgcggctcaggatgccgatcatcgcatagacgccgatcgtcaccgcgacgaaggcgtagccgatgatccggtcgggcacgcccatctgttccaggatggcgagcagaatggtgaagccgacgaagccgccggtgtagatgccgtagaccttgcccagattctgggtgaaatcgcctttcatggcccgtgccccttcagtcttcggacacgccgaattcgtcgtcgatccggttctggcgcgcgacataccagaagatcagccagacgaagatgatcagcgagccctgtgcggccatgtaaaagccgagcgggaagcccaggatccggatctggttcagttccggtgcgaaggcgtggatcacgaatcccgacaggaaccagatcgcgagcaccgtccacatcaggcccttggttctctgccagtactcctgcgccttctgcggcgtcaggctgcgattttcagacatgtctccccccataagctccacatggccgctttcatgcagccttggccggccgggccggcggtcacccgtcggatcaacccaggggcgggtgacgatcttctatagatttccgggccaaactggtaatcttgtcaacaaccaagatgacgatccgctgatcgcagcggcttcttctgtaaaatgcgacagaatgtttcccgagggaggaggttgcccccaccgatgctccggagaatgatgcgccttctgcgcgagacgccgcgcgatcgcgaccgggctgccctcgaccgcttcgtcgaagcgcagtctgcctatattgcgcagcgcatgaccatcggttactgcgagatcaaggcaggccccctgcggcacagcctgtttcgcgaagcgggatttcaggtcctgcttgaacggtcgcgctgggaagcctttgccgccgtgcgggccgatatggcggtggcgatccgcgaccggctgcggctccatgccggggatccggccgccatcgagagggcgctggtcgaagacttcgcggccgccctggcggccgccccgcatttcaccgaccggccagacggcttcgctgccgaggtggcggcgcttgcggcgcgcctggcgcttggccgggccgcagatccgcaacccccggcccggattttcgcccagggcggcggccgggtgttcgactgcctgcccatccatcccagcctgcgcgaccacgagcgggagatgatcgtgaacggggtgtgcttccacgccgtgggggcgctcgccagggccgatctgcgcttcgactggcccgcactcgccgccgatctggctgccggtgcccgtgctgccgcgtaacgtgctgccgcgtgacgggctggcgcgtgacgagaaccggccggcgctgatcgccgccgggctgctggcggcgggcgggctggccggtgcggggtgggcggggcttgcggcgggggccgcgaccctgccgctggggcttgccctgttcgccggcgcctcggggttggggctcggcctctggatcatccgctcggccgcccgggctggccggcggctgcggggcgatctggcccaggcgctgcgggcggcgaccgatcccgatctgccgctcccggcctttgcggccggggatctgccgggcgccgacgggcggctggtggcgctggcgcgggcgcttgccgaaaccgcgcgggccgccggcggccgcggcgatgcccggcttgccgccctggtcgcggccctgccggttccgctgatgggggtgggggcgaccggcctggtcaccctggtcaacccggcgatggcggcgctgatcggggcggtgatgcccggaacctcggtctatgcggcgctggcgcgggaaagcctggccccgctgctggcggccgccggcggcggcatgcggcgggccggcgttcatcatgtcgatggccggctgctggacctgacggccgtacagctgcccgccccggcggcgacggcgggctggctgatctttgccgatccaccggcggccggcatgccggtcctgccggccgccgagctgccgatggcgctggcgctccacgatcttgctcccgatctgccgccggcctgtgatgccacgccgctcgaccggctgccggtgctgtcgctggatctcgagaccacgggccttgaggtgaccaccgaccggatggtctcggcgggcgcggtgtgcatggtgggcgggcggctgttcctggccgatgtcctggacatgctggtcgatccgggcggaccggtgcctgcggccgcgacccgcgttcacggcatcgaccgggcgatgctgcagggtgcgccgccgccggtggtggcggtggaacggctgacggccctggcggccggtcgggtggtggtggggcataatatcggcttcgacctggccgtgctgcgtgccgaagcggccagggcgggccgcgcggtacccgactggctggagccgggcgggccggcactggacacgctgcgcctggcggcacggctcgaccccgaccggccggaactggatctggaggccatcgcccaccgctacggcatcgccgtatcgggccggcacacggccctgggcgatgccctgctcaccgctcgggtgttcgcggccatgatcccgcgcctggtcgagatcggggtgcatgatctgggggcggcccggcgctttgccgatgctgcgggggccgtggctgcggcgcagcgtcgcgcgggctggtaggtcgcgcgggctggcgatcggcggcgtggcatggaatgatcggggggcgcatgatcgcagcagcctcatgatcccagaggggagcccgtcccgatggagccttccgaagccgaagccctgttccggctggacagttatccctatcgccatcgggcgggggaggtcgcctcgcgaccgctggtgacggcagagccgggtatgacggttcaggacgctgcccgagccatggcgcgggcgggcatttcggctctggtcgagcgggacgaggatggccgccccaccggtatcctgacggagcgtgacgtcgttcgtgccctggcccgcgagggtgccgaagcggcggttctgcctgcggcggcgctgatgagccggccggtgcgcaccgtcgacgacgacgccttcgtttatgtggcgatcggccgcatgcgccgcttcgagatccggcatctggttgtggtcgacgcggccggccgggccaccggcatgatcacccgccgcgccctgctcaggctccgcgccggcgatgcgctggccatgggcgaccgggtggaggcggcggaagatgcaaaggggctggccctggtccgggcagatctggggccgctggccgccagcctgctggatcaggcggtcgatgcgcgggccattgcctcggtgatttccgccgtcacgcgcgacctgacccagcgcgccgccgccctcgccgaagcggccatggtggccgaggggcagggtgccgcccccgccccctatgccgtgctggtgctgggatcggccggccggggcgagaccctgctggtgcccgaccaggacaatgccatcgtccatgccgggcgcgatgccgatgacggctggttcggggcgttcggccagcgcatgtgccggctgctcgccgatgccggcatccccttctgccagggcggggtgatggcctccaggcctgcctggcgccatgggctggagggctggcgtggccgggtgcgggcctggatcggcgatcctgacggtgacaacatgctcaacgccgacatctttttcgacatggcgccggtcgcgggcgatctggcgcttgccgaagagctgcatggctatgcccttgcccaggccgcccatgcaccgcatttcctgcaggcgatgatccgcgatctggaccgcatgcacgcgcccatcggcctgttcggtgatctgcgcaccgacggtaagggccggctggacctgaagcgccacgggctgctgccgctgacgctgaccgcccgggcgctggcgctgcgccacggcatcgccgccaccggtaccgcggcccgggtaaaggcgctggcccaggccggcctgctgaaccctgccgatgccgagcagctggaccggtcccacgccctggtgatggcgctgctcttggaagcgcaggtcgcgcgcctgcgcgaaggcaaggtcccggacaccctggtcgacgtcacggcgctggactcccgccgccggtcgcggttgaaatcggccctcaagcatattgatgcgatgacctgggtgatgcgcagctcgctgggaggctgaaggttccgatggatttcgacgccgttgcggccgcccgggccgcgctcgcctcggtgacggtgccccccgcgccccaggggcccgaggcagatcaggccgatctgctcgaccggccggacggcatggtgatccgctatctgatctggcatccggcccccgggatgccgccgcgcggcacggtgctgctgcttcaggggcgcggtgaattcgtcgagaaatatgccgagctggccggatggttgcgggcggcgggctgggcggtcttcgcccccgactggcgcggacagggccggtccggccggcttgcccctgatcgggccatggggcatctgaaccggttcgacgactgcctggacgatctggatgcgctggcggcggggccgcttgccggcctgccgcggccgctggtgatgctgggccattccatgggcggccatctgggcatgcgctgggtgctggaacgggtgccggccgtggcacggccggcggccattatcctgtcggcgccgatgatcgacatccgcatgccgctgccggcccggcggctggtgccgccgctggcgcggctgatgcgcgcccgcggccgcggcatgacctatgcccccggccaggggccggggcgggccagcggcggcggtttcgccggcaaccggctgacccatgatccggcgcgctgggcgcgggaacaggcgctgctggcggccgatcccgccctgcatctgggcggcagcagctggggctggctggcggcggccttcgattcgatccgcgatctggagcgggcggtgatccgtgcgggcgcagggctggatgttccggtcaccctcttgcagggcggcgccgatatggtggtcgacccggtcgcgcagtccaggctggtggcgcggctgccccgcgcccggctggtggtggtgccgggggcgctgcacgagatcctgatggaaaccgacgagatccaggcccccgcccgggcggcgatcacgcaggccttggaaggcatctgatcacccggccagaaagccgccatcgacgcagaggttctggccgatcacgaagccagcggcatccgatgcaagccagagcacggcagcggccacgtcttcgggccggcccatgcgccgggcgggcagggtggcggcgatggtcgcgtaatcggcgaccccggcgcctgccatcatcggcgtctcgatccgcccgggggagacggcgttgatccggatgccccggggcgcgtgctcgatggcaagcgaacgggtgagcgagagcagcgccgccttggaggcggcatagatcgcaaagcccggataggggttgcgcacgccgctgaccgaggcgtcgttgacgatgacccccccgcccgcccggccgccgtctctttggcgcatgacccggatctgggcctgcatcgcctcggcgaccgatcgcaggttgatcgcgaacacccggtcgagcacggcgagatcgcgatcgaccagcgacccctgcggttcctgccagccggcattgttgaaggcgatgtcgagccgcccccagcatgcgatcgcggcatcgaccagggcggtggcggtgccggcctcggcaaggtcgccggcgaggaaagtggcctcggcgccttcggcccggcaggcggccaccacggcctcgccgcgtgccgcatcccgcccgcccagcatcagccgggcgccctgacgggcaaaggccagcgccgtggcccggccgatgccggaggtggcgcccgagacgagaacgacgggtctggtcatggcggcaggctccctgatcatgatgtcctgccagactggccggtcagcgggcctctgtattggcggatcttgcgcccgcgaccgccgccgcccaaagccccggcgtgatgccgtagcagcgcttgaactggcgggtcagatggctctgatcgcagaacccggtcgcggccgcgacctcggccggtgccatgcccgccgcaagatgccggcgggcgagatccagccgggcctgggtcaggaaggcatggggggcaaggccggtttccttgcggaaggcgcggcagaaatggaacgggctcatgccggccagggcggcgagcgtcgccaccgaccagtcggcggcggggtcgtcgcggagcgccgccgccacccgctgcaccggcctgccttcccgcccggggaccggcaggtggggcgccggggcgccatggcgccggaacagcagggccagggcctccagcagcagggtttcgcgcatgagccgcccggcgccgccgtcgatcgcccgatgggccgcaagcatcgaccgggccagatcagggtcgttcaccaccgcctcgcggaaccagggcagggtgatgcggcggccgaaggtctcgtcacccagggtggtcagcagatcggggcccagatagaagctgcgatagcaccagggcgcgtcgcccgtcacgccgccctgatgcggttccccgggattgaacaccatcaccgtctgcggcgtgccgaccgaggcggtgccgcgggtgacgcagcgccccgccccggcctgggtgacggcgatgaccatttcctcgtggacatggggcgcgaagaccagcgtgccgaaggcggcggtcagcaggccgagcccggcgatctggcggtccaggctgaagacggcatggttgtcggggtcgtatcgggccacgtccggacatcaccgttggggaaggggggagaggtcatcctaacccgtggaaagccgtggcgtattggacggatttgaccccgcagccctgcgaaacgcgctataaaccggaaagcaaaggcgctgccacctcccccaacgagcgggcgccggtcgagacgaggagacgctcccgatggctttcatctatgcctatgacgacgtggtgccggtgatcgatcccaccgccttcgtgcacgagaccgcggtgctgatcggcgacgtgatcatcggccccgaggcctatgtcggcccgggggcatcgctgcgcggcgacagcggccggatcaccgtgctgcggggcgccaatcttcaggacaatgtcgtcgcccatacctatccgggcggcgaggtcgtggtgggcgagatggcggcggccggccatggcgcggtgctccatggctgccggctgggccagctcgcgctggtcggcatgaatgcggtggtgatggatgatgccgagatcggcgatttctcggtcgtcgccgccatgtccttcgtgaagaccggcatgaaggtaccgccgcggaccatggtcgcgggcgtgccggcaaagccgctgcgcgaagtgggcgaggccgagatcggctggatccgcgagggcgcgctcagctatgacgacctccgccgccgggcgctggccggcgaattgcggcgggcggagccgcttgcggcgccggagcccgaccggcggacggtccgggcctatcaggtgaagaagctctcggccatgcgcagctgacaggggcgcccccggccccagaacattgaagcgaccggccctgatggggtacaaccggggccgacacgggcggggccgacacgggcgagcgctgcccggcaccatttctcttcaagcgcccgcggagatcgcctccgccagggcctcacggggtggcatatggcttcctaccagtacgtctataccatgcgtggtctgaacaagacctatccgggcggccgtcaggtcgtcaaggatgtgacgctggccttcctgcccggcgccaagatcggcgtgctgggcgtgaacggtgccggtaagtcgacgctgctcaagatcatggccggcatggacaccgactataccggtgaggcctgggcggccgaggggctgaaggtcggctatctgtcgcaggagccgcagctcgatccgtccaagaccgcgctcgagaacgtcatggacggcgtgcggccggtgaaggatctgctcgaccgtttcgaggcggtcagcgcgaagttcgccgaggtcgaggacccggacgagatggacgcgctgatcaacgagcaggccgagctgcaggagaagatcgacgcggtcaatggctgggaaatcgaccgcacggtcgacatcgccatggatgcgttgcgctgcccgccggccgatgccgacgtgaccaagctgtcgggtggtgagcgccgccgcgtggcgctctgccagctgctgctctccaagcccgacatgctgctgctcgacgagccgaccaaccatctcgacgccgagtcggtggcctggctggagcgcttcctgcacgactatccgggcaccgtcgtggccgtcacccatgaccgctacttcctggacaatgtcgcgggctggatcctggaactggatcgcggccgggcgctgccgttcgagggcaactacactgcctggctcgaccacaaggccaagcggctcgagcaggaagagaaggaggaaagctcccgccagaagaccctcaagcaggaactggaatgggtgcgctcctcgccgtcggcccggcggaccaagtccaaggcgcgtctggccgcctatgagcgcctgctggagcaggaccgcgagcgggtgggcgaggtcgcccagatcgtgattccggccgggccccgtctgggcaatgtggtggtcgaggcggagcatgtctcgaagggcttcggcgaccggctgctgatcgacgacctgaacttccgcatcccgccgggtgccatcgtcggcgtgatcggcccgaacggcgccggcaaatcgaccctgttcaagatgatcaccggccacgagaccccggattccggcagcttccgggtgggtgagaccgtgaagctcgcctatgtcgaccagagccgcgacgcgctggccgccaacaagacggtctgggaagagatttccgacgggcatgaagacatcgtgctcggcaagcgcaccgtgaagagccgcgcctattgcggcgccttcaacttcaaggggtctgaccagcagaagaaggtcggccagctctcgggcggtgagcgcaaccgcgtgcatctggccaagacgctgaagtcgggcggcaacctgatcctgctcgacgagccgaccaacgacctcgacgtcgataccctgcgcgcgctggaagacgcgctgctcgatttcggcggctcggcgatcgtgatcagccatgaccgctggttcctggaccgcatcgccacccacatcctggccttcgagggcgacagccatgtcgaatggttcgagggcaatttcgaagcctacgaggccgacaagcgccgccgcctgggcgatgccgcggtcgagccgcaccagatcaggtacaagccgctgacccgcggttgaggcgacggatcttcgcatctgcggagacctgtcacagcgacatcatcgcccccatctcttgcagggatgggggcgatatcgtttcaggcgatggaaagaaggcggaagataacgtatgacgcgaggcatgccatgatcagcgccacgtccgacctcagtgcatcaggtgtgactgcgggtgtcggccacaacaccggacagccgaggcgcaccgtgcatgccattgctttcgacctggacaccgaagcgttgaagacggcctgccacaatccctcgtggcagaacgcttacaacgacatcggcaaggtgctgacgaccaaaggcttcctgcgtcagcagggcagtgtctatttcgggaatgagcgcgtcgatccggtgacctgcgtcctggccgtgatgcaggcggtcgagggcagctgacatgaaaaaccggcggcccctctggagaggccaccggctttcagtgacgggtgtgcagagccgggcttaccgggccgaggcggtgacctgttcggtacggcgcttcagctcgccgatcagcccatccatgcccgagcgctcgatcaccgacgagaactcggagcgctgggtgatggccatgctcacgccctcgatcgcgatatcgatgatctgcgggctgctgccgtccacgcggacgcggaaatccagcggcaccggcggcccgtccgggcgccagatctggccggaaatcacgaccatccggtcgtcattgctgtcggcgcgaacattggtggtcttgaaggccttgccctcgcccgatgccgccagctgcttcgaataggtatcggcgatgtagtcggcgaagcggctggaataggtggcgacgacataggcgtcgaaggcgtcgcggaaggcgtcgcgctggggctcgctcgcggtccgccagtggcggcccagcacgaagcgcgagatccagtcgaaatcgaagccttcatggaacagcttgcggaaccgctcggtccgggtctcacgatcgaggccgggttcggacagggccgagatcgccttgttgccgaaatcctcgatcgagctggccgcagcctggggcgagatggcggccatcgccacggacgaggtggcgggtccgaagactggcagaaccggcagcgctgcgccgagtgccacggcaaccgcgattccgcgaagacggatggtcatcgcgatgactctcctggtggtgtgcctggtgatggtgggctgcacgccgggtgctgcgctgcccgacggacgtaccgccatcatatgggccatgactcagtccgcgtcgaggtccagacggaagacgtcgtcattgccctgaccggtgccgaccttgccgttggagatttcggccagccggcgctgccagtaggcgctgcgcacggcggcgtagaaatcgaccgaattgcgctgcaggtcgtcgagcggctcgatcgcacgttcacgcgcgacgatgccgttggcgacggcgatcccgatcgtggtgccctgatcgtcgatggcgtaattgaccgggtcgccgaaggaatcggccgcgcggccaaaggtgtgccgcagcgtcgccggccccaggatcggcagcacgatataggggccggggccgatgccccagaccgcgaaggtctggtcgaaatcctcatcatgcgcgggcggcatgccggcatcggtcgccacatcgatcaggccgccgacaccggcgatgctgttgatcatgaagcggccggcggtttccgccgcgcgttccggctcaccctgggccacgtcgttgacgaaaaccagcggcagcgacaggttgacgaggaagttgccgatcacggtctggatcgccggcgggatcatctggcgatagaacatcgccgccggacggatcagcaggccgtcgacgaaggtgttggctgcaaagatcgcccggttcacgggctcgatcggatccgacagctcggccggctgattgggtacggccgacatcggcacgtcgtttccggcggtggcacaggctcccagcatcgccagggccgcaacagcaccgccaagacgtgccgccagacgccggggccgggggccgtccgcttccggggactggatggtcatggtctggcactccgcccggcttgcgactgcggccatatgcgtccgtcctccgtattcgcggccccgatccgacccgcaccccgaactatcacatggaaagacgacgtgcgacaggttcacctatcacaggacactgccgcaggccacggaaaagcccgcagcccccgtgcttcggggggcttgcgccggctatgcgctgccggcttgccacaggtcgatttaagatataaagatatgtttatgtcatgacccgctgaggagcatcaggggatgggaagtcttccggccgtcgacgggccgcatgagacggcgaccgtggcagccatggacacgctgctggacgggctgaaggccgcggccgaaccgacccggctgcgcctgctcgccctgctgtcggccggcgagctgaccgtcaccgagctgacccagatcctgggccagagtcagccgcgtgtctcccgccatctgaaactgatgtgcgaggccggcttgctcgaccggattcccgagggggcctgggtgttctatcggctggcgcgcgaaggcgctgccgcaggtctggcacggcgcctggtggaactgctgccgctggacgatccggcgctggcggtcgatcttggccggctgcggcgggtgaaggaagaccgcgcccgccaggccgaggcctatttccgcgccaatgccgcagaatggcgccgcatccgcgccctgcacgtgcccgaggcacaggtcgaggcggcgttgtccgggttgatccgcacggccgggccgcgcagcctgctcgatatcggcaccggtaccggccggattctcgacctgctggggccgctggtcgatttcgggctggggatcgaccgctcacgcgagatgctggcggtggcgcgcgaacagctggcctcgtccgggctcgatcattgccaggtgcggctgggcgatctgaaccagctgccggtgaccgatgcggccttcgatgcggtggtgatccaccaggtgctgcactatctggacgatcccggccatgcgctggccgaagcggcacgggtgctgcgcccgggcggcatgatggtggtggtggatttcgctgcccatacgctcgaggatctgcggcgtgatcacgcgcatcgccggctgggattttccgacgacgaggtcgatggctggcttgccgcggccggactggaggcggaaacgccgatccggctgccgggggagccgctgacggtggtgttgtggcccgcgcgccggacgggtggcgcggcggggtccggggaggacgaaacccttcgtcgggctgcggcggaccgcaggaccggccataagaacagggagacgacgtgatgacggtgaccaccgacgggcgggtcctgaccccccgggcgctctgggacgcgcccgcgccggtgcccgggctgaagatcagcctggagttcttcccgccccgcggcgcccaggcggaggcgcggctgtgggagactgtcgcgcggcttgccgcctatgcgcccgacttcgtgtcggtgacctatggcgccggcgggtccacccgcgacaagacgcgtgacacggtgctgcgcatgcgccgggactacggccttgccgccgctgctcatctgacctgcgtggatgcctcacgcgcggacgtcatggcggtggccgagggctacatcgccgacggcatcgatcatgtggtggcgctgcgcggtgacccgccccagggggccgggccctatgttccgcatccggacggcttccccttcgcggtggatcttgtgcgcgccctggccgatctcggccggttcgagatcagcgtggcggcctatcccgaggttcatccccaggcacaaagcgccggggccgatctcgacaatctgaaggccaagctggatgccggcgccacccgcgccatcacccagtatttcttcgacccggcggtgttcctgcgcttccgcgaccgcgcggcggcggccggcatcaccagacccatcctgcccgggctgatgccggtgctgggcttccagcagatcaagcggttctcggccgcctgcggtgccggcattccggactggatggaacggctctatgatggcgccgatgccgacgaagccacccatcaggcggtctcggccatgctgctcgccgaacaggcgcgggtgctggcggccgaaggctgcgcggatctgcatttctacaccctgaacaaggcggagctgaccatcagcgcctgccacctgctcggcatccgcccgcgggcggaagtggccgccgcccgcgcggccggctgaccgcagccctcaccacgttatcctggcccccgaacagcgcgatcgaggcaagatgtcacggcttctcgactttctcggctccaacgtcctgctgctcgatggcggcatgggcagccagcttcaggcgcgtgatctcagcgtcgacggcgactattggggcaaggagaactgctccgaaatcctcaacctctcccgccccgacatcatccgcgacatccataccgcctatttcgaggcaggcgcggatgcggtggagaccaacactttcggcggctctccgatcacgctgggggagttcgacctcaccgatcaggccttcgagatcaacgtgaaggcctgcgagctggcgcatgaggcggcggagcggttcaggggcgacggccgtgagcgcttcgtgatcggctcgatcgggccgggcacgcggctgccttcgctcggccatatcgactacgaccggatggaggcggcgctcaccatccaggcccgcggcctgatcgccggccgcgccgatgccttcctgatcgaaacctgccaggacccgttgcagatcaaggcggcggtgaatgcggtcaagatcgcccgggcggaagcgggcgtcgacctgccgatcatggttcaggtgacggtggaaaccgtcggcacgctgctggttggcaccgacatcgcggcggcgaccgcgatcgtcgatgcgctcgacgtcgacgtcatggggctgaactgcgccaccggcccgcaggaaatgcaggaacacgtccgctacctgtcgcagacctggcgcaggcggatttcggtgctgcccaatgccggcctgcccgaattggtcgacggccgcacccattatccgctgggcgcgcgcgaactggcccagtggctggagcggttcatcgtcgaggacggcatcgacatcgtcggcggctgctgcggcaccggccccgaccatatccgcgcgatcgacgagatgctgcgccgtcgcggcggcgcccggcaccgcccggcgccggtgaagcgcgaggtcaactggatgccgggggcggcctcgctgttcggcttcgtgccctatttccaggaaaatgcctatttctccatcggcgagcgctgcaacgccaacggctcgaagaaatttcgcgagatgcaggatgccggcaactgggatggttgcgtcggcatggcgcgcgagcaggtgaaagagggatcgaacgcgatcgatctctgcgccgccttcaccggtcgtaacgagatcgcggacatgaccgcgctcaccaccgccatgcgcggttccgtctcggcaccgctggtgatcgattcgaccgaactcaacgtcatcgagaccacgctgaagctctatggcggcaagccgatcatcaactcgatcaatttcgaggacggcgaagagccggcccgcgcccggctggcgctggcgaagaagttcggcgccgccatggtggcgctgaccatcgatgaagagggcatggccaagaccgccgatcgcaagctcgcgatcgccgagcggctttatgcgcttgcggtcgacgaatacggtctggcgcccgaggatctgctgttcgacccgctgaccttcaccatcgccaccggcaacgaggacgaccgcaagctcggcatcgagacgcttgagggcatccggctgatccgcgagcgcttcccgcgctgtcagatcatcctcggcctgtcgaacatctccttcggtctgaaggccgcggcgcgccatgtgctgaattcggtcttcctggattatgcgctgaaggcggggatgagcggggcgatcgtgcatctttccaagctgatgccgctgcacaagatcgccgaggacgaggtgaaggtcgccgaagacttgatcttcgaccgtcgtgccgagggttatgacccgctgatctcgttcatggcgctgttcgccgaccgcaaggcagagagccaggccacgaaagtgcggcccgagacggtggaagaacgcctgaagctgcggatcatcgacggcgaccgcgaggggctgggcgcggatctggacgaggcgatggcgaagatgccgccgctcgagatcatcaacaccgtgctgctcgacggcatgaaggtggtgggcgagctgttcggcgccggcaagatgcagctgcccttcgtgctgcaatcggccgagaccatgaaggcggcggtcgcctggctggagccgcatatggagaaggtggagggcgagcagaaggcgacgatcgtgctcgccaccgtcaagggcgatgtccacgacatcggcaagaacctggtcgacatcatcctgaccaataacggctatcgggtggtcaacctcggcatcaagcagccggtggcctcgatcatccaggcggcgcgcgaacatcgggccgatgtggtcggcatgtccggcctgctggtcaaatcgaccgtgatcatgcgcgagaatctggaagagatgacgcgcgaggggctggacgtgccggtgctgcttggcggtgccgcgctcacccgcaaatatgtcgaggaagactgcgtcgccgcctatggcgccggccgcgtcgcctatgcccgcgatgccttcgacgggctcagcctgatgaatgcagtggtcgacggccgtttcgatgcggtgctcgacgaggcgaagcgcaagcgcgaggcccggccgtcgagcatccgggggccgaagaagcgggcgtcgagcgacgaggacatcaaggcgatgctcgaccggccggtcgatttcgacgaggtccgtgtgcgccgctcggaactgcatggcgggatcgaggtgccggagccgcccttctggggcgcccgggtgatcgagcatgtgccgctgaaatcggtggtgccctatctgaacgagaccatgctgttccagtttcactggggctataagcgcgccggccgcaagccggccgagttcgatgcttatgtgaagcaggagctgtggcccaagctcgaagccctgctcaagacctgcgccagggagaagatcctggatccgcaggcggcctacggctattggaaggcggcgggcgagggcaatgatctggtgctgttcgaaaccgacggcaccaccgaactggcccgtttccgcctgccgcggcaggatcgcgagggcgggctctgcgtcgccgatttcgtccgcgacatctcggatccggtgcgcgacgtgatcggcctgcaggtggtgaccgtgggccagaatgcctcggacgtcgcccgcgactggttcgctgccgaccgttatcaggattatctctacctccacgggctgggggtggagatcgccgaggcgatggcggaatacgtgcacaagcggatccgcgccgagcttggctatgcggccgaggatgcgcgcgagatcgaccggatgctgaaacagggctatcgcggctcccgctacagcttcggctatccggcctgtccgaaccttgcagatcagcgggtgctgctggagctgctgggcgccgatcgcatcggcatccagatgggcgacgaggatcagctgcatcccgaacagtcgacctcggccatcgtgctgctgcacccgcaggcgaagtatttctccgtctgacggggatctggccacccgaggccggccccggttgcatccggggccggctttccttttgtccagttctgcgcgttatggttgatgatctgcaggatggttccgtgacgatcggccgcaacctcgctgcggcgattgcatcgaacgtcatgaatccaccgttgaaccgcgcgcccgtccgggtgataagggaaggaggggaccggcatgggataccatcccgccgatccggggggccctgaagccggcgggtgatcatctccgccggtggatgtctggacaggtttgccggaccgtgggtgcactgcggcatgtgcggtgccagatgcagtggcgtatggaacggcgttccacgaaatcgcggacttggcaaacaaagttacctgaggcaagaataactgcctcataatattgctgcaccgcagcgtcggcggcgtcggggcgccgcagagacagaacgagggccggagagaccatgaagatcgcagttccgagggagacccgcgcgcacgagaagcgcgtcgcggcgacccccgaaacggtcaaaaaatatcgcgacctgggctttgaggtcgtggtggaggcgggcgccgggctgggggccgccatcaccgacgatgcgttcaaggcagcaggtgccgagatcgccgccgatgccgcggcgacgctggccggggccgaccttgtgctgaaggtgcaggcacccgacgaggccgagaccgcggccctgcccgagggggcgaccctggtcgccatgctgagcccctacaccaatcgtgatctggtgaagcggctggcggcggccggggtgaccgccttcgccatggagctggtgccgcgcatcacccgcgcccagtcgatggacgtgctctcgtcgcagagcaacctcgcgggctatcgggcggtgatcgacgcggctgccgagttcggccgcgcaatgccgatgatgatgaccgcagccggcaccgtaccgccggcccgcgtgctggtgctgggcgccggcgtcgccggcctgcaggctatcgcgaccgcgcggcgcctgggcggtgtcgtctcggccttcgacgtgcgtccggcggtgaaggaacaggtcgaaagcctgggggcgagcttcgtcgacgtgcccaatgacgaggccgcctctgccgagaccaagggcggctatgcccgcgagatgagcgacgcctacaaggcccgccaggcgcaggtgctggctgatcatgtgaagaaaaacgacatggtcatcaccaccgcccagatccccggcaaacccgccccggtgctgatcaccgaggagatggtgacctcgatgaagccgggctcggtgatcgtcgatctggcgtcggaaaccgggggcaattgtgcgctcacccgccatggcgaggtggtcgagaccccgggtggcgtgcgcatcgtcgccttcccgaacgtgccggcccgggtggcggtgaatgccgcccagctctacgccaagaacctgctgaccttcgtgacgctgatggtcgacaaggaaaccaaggcgctgaaggtcgacacggccgacgagatcatcgccggcacgctgctgacccagggcggcgccgtggtgcatccgaacttcaaggaggccgagtgatgagcgcgctcgaccagcttcagtctgccgccgatgccaatctcgaggcggccaatgccagcctcgacgccgcgcgtcaggcgcagaccgaaatcgcccgcctcgccgcggaaggtgccgccgcccatggtggcgtcgatccgctggtgcttggcctgaccgtcttcgtgctggcgatcttcgtcggctattacgtggtctggcgggtgacgccggcgctgcacacgccgctgatggcggtcaccaacgccatctcgggcattatcgtcgtcggcgcgatcatcgccgccggtcccgccaccttcggcttcgccacggtgatgggcttcctggcggtcacgctcgcctcggtcaacatcttcggcggcttcgtggtgaccaaccgcatgctgcagatgttcaagaagaagggctgagggcggaaccgtgaacgcaaacctttcctcactcctttatctcgtcgccgccgtctgcttcatcatggcgctgaaggggctgtcttcgccggtcagcgcccgcaacggcaaccgcatcggcattgccggcatggcgctggccgtgctggtcaccctgttccagccgggtgtcgaaagctactggctggtggtgctgggcgtgatcatcggcggtgctgccggcaccatcatcgcgctgcgcatccagatgaccgcgatgccgcagctggtcgcggccttccacagcctggtgggcctcgccgcggtcttcgtcgccatcgccgcctattacgcgcccgaggcctatggcatcggcaccgccggcagcatcaaggtgaacagcctgatcgagctgtcgctgggctcggccatcggtgcgatcaccttcaccggctcgatcatcgccttcggcaagcttcagggcatcttcaagtcggcgccggtgcgcttcccgatgcagcatccgatcaatctcggtctcggcatcgctgtgatcgcgctgatcgtggtgttctgcctgaccgaggcgccagcggccttctggctgctcaccctcatcgcgctggcgctgggtatcctgctgatcatcccgattggcggcgccgacatgccggtcgtggtctcgatgctgaacagctattcgggctgggcggcggccggcatcggcttcaccctggaaaaccacctgctgatcatcaccggcgcgctggtgggctcgagcggcgcgatcctgtcctacatcatgtgcaagggcatgaaccgctcgttcttcaacgtgatcctgggcggcttcggcaccgatggcagctcggctgctgccggtggccccgacctgggtgaccgcaccgtgaagcagggcagcgccgaagatgccgccttcatcatgaagaacgcctcgtcggtgatcatcgtccccggctatggtatggcggtggcccaggcgcagcatgcgctgaaggaaatggccgacatgctggagaaggaaggcgtgaaggtccgctacgccatccatccggtcgcgggccgcatgcccggccatatgaacgtgctgctggccgaagccaatgtgccctatgacgcggtgttcgagctggaagacatcaaccgcgacttcgcctcgaccgacgtggccttcgtcatcggcgccaacgatgtgaccaacccggcggccaagaccgacccggcaagcccgatctacggcatgccgatcctggacgtcgagcgcgcgggcacggtgctgttcatcaagcgcagcatggcctcgggctatgccggcgtcgagaacgagctgttcttccgcgacaacaccatgatgctcttcggcgacgccaagaagatgaccgaggaaatcgtgaaggcgatcgagcacgcctgatcaggcgccgcccgaccgcaccacgacgacgcatcagacgacgaaagacgcggcctccagcgacggaggccgcgttttttcgtaaactgcagaaagacgcgcggctcaggggaggtgacatgcgcatcgtcagtcagtgcgacttcgcggagcgtcttgaggagatctgtgacgaggttgcagatggcggggagctggtgcttgtccgtcgctccgatgggcgagagccggtggtcatcctgtcgcgtggaagctgggttggcctcatcgagacccttcatctgctccggtccccgcgaaatgcagaacgcctgcatcgtgggatggcagatgcaagggccggtcgcatctatgatcgggatcttgacgacggagccggttgatccggacggcgaagggctccggctcctgcacttacgccggcatcaacaccggctcatcccccgccaccgtggcgcggtacatttcgcggcgggcgccgtgatagtcgccgaccggcaggtgcagcaccgaccggttgtcccagatggtcagggtcccctgttcccagcgcacccggcaggtgaagcggtggtcgaccgagagctggaacagatagccgagcagggcctctgcctcggcatcggtgaagccgtcgaggccgatggtgtaggccgggctgacatagagcgcgcgggcaccggtttcgggatgggtgcggatcaccgggtgcaggcgggtggccatggcggtctcgctgaccacgatgtccatattgggcagccggtcggccaccgcctcgcggctggcggggccatagccgcgccgggcgctgtgtaccgccttcagcggttccagcagccggaccatggccgggctcagcgcctcgcaggcgcggatctggctggcgaacatggtgtcgccgccccagtcgggcacgtcatgaccgtagagcagggtgaaggccggcggcgtgtcgaggaatgaccagtcgctgtgccaggcctcgccgaagacattggggtgcgcctcgtccgccgttttcagcaggcgcagaacattggtgaagccgggcagggggcgcacgtagggatcctggccgaaggcgccgaaacgcagcgccacccgttccatgcctgccggatcgaggctctggccgcgaatggccagcacctgatgatggaccagggccgcacgcagatcggcaatggcggcgtcggaggccgtggcgacgtcgatgccggtgatttcggcacccagcgcaccggtcaggggccgggccgtgaaatgggccgacgggcggggtgcattgctgcgggcggtcggcggcttggcggagaagaacgggttggcggtcatcgggcatgtcctcccttcgggcggccggttcgtgatgccggcttcgatagatcgagagtgccgccgcaagggccgggcggctatggcggagccggccggattcttgataaaatcggccagatcgaccgctgaagacgaggagggggacgatggtccatgccggcgaccggcgcgatccggtgggcgtggtcaacatcctggagatggcccgcgggcgcgggctcgatcccgctgcactcgcggtcgcgggcgggctggatgctttgcggccggccgatgccccggtgctggcctggcaggaactggcggtgatcgaagcggtgctgcgcgccctgccggaccaggatccggccctgctggggctggaaaccgggctgtgctatcgcgtctccgccttcggcctgttcggctgggcgatgctgacccgcgcggtctttgccgatgccctggcactctgggcgcggctgccgacgctcggcctgtcattcagtgcgatcaccgcccgatatccgccgggggaggcgatcgtcttcaccctcgacgatcacggcctggtctctctgccgcgtgcggtgcatcgctttctggtggcgcgcgggctggtctcgaccgccgtgctcaccgccgatctgctggcggccccggtgatgccgatggcggcagggatcgacattccgccaccgtcggaggttcaggaccgggaccgtttccacgaggttctggggccgcatctcgtcttcggcgggggcggcgggcatcggctggtctatcatgcagccctggccggtcggccgctgccctttgcccatccggtggccacgcgcacggcggaacgggcctttctggccgaggcggcaaggcgcggcgtcggcggcccgatggcggcactcgacgtgctgctgcgcgacgaggccgggccgccggccgatctggttcaggccgcgcggcggctggcgatgtcggagcggtcgttgcgcaggcggctggccgcggccggaaccagcttccggcaacggcgggatgcagcactggccgaacgcgcccggcgactgctggtcgagggggtggcggtcgaacgggtggcgatagcgctgggttatgccgatgccgccgccttcacccgcgccttccggcgctggaccggagagacgccggggcgctttgcccggtctcagccgcgccggtcggcgatgacggcatcctcgacgacataatcggccacgacgcgcagatcgcgcagatggcggacgcgggcgatcgattcggcataaagcgggtcggccttataggcggcgagggccgcctcgtcgtcgaactcggcatagacgatcaggtcgacatccgacgacagcgcatcgcgcttggtattcgtgccgacctcgaagcggcgggcatggggaatgccgcccaggatcgcgaggccgtcgcgcaccgcagcgagatcggccggggtcttggcgctgaacatcacgatatgccggatcatcgggcttccttcacgaccggggggagggagggcggcgcggcagggcgccggcggaagctagacccgtcaccggaatccgggcaacaaaaaaccgccgctcgcggggagggcggtctttcgtaacggcaggtatgtcatgccgtgggccggttcggcttcagggcatgcatccggtcgtcggggcgcggaacgcgcctgctgctcagagcaggccctcgcgctgcgcacgcttcatcgcgagcttgcgggcgcgacgaacggcctccgcatcctcacgggcgcgcttctccgacggcttttcataatgccgacgcatcttcatctcgcggaagatgccttcacgctgcatcttcttcttcagcgcgcgaagcgcctggtcgacattgttgtcgcgaacgatgacctgcaccaagtctacacccgtcttgtcagtcgattgaaacccggtccggacgtcctccgtccgggcccgtcgcgacgcaccgcgacagatcacgaccaccgaaaccctcggcgaccatcggccgcctttggtaccggggcgacggatgaaagtcaaaccgattcgaccgttgcgaaacgaaagccggcacgagtggcctcccagcctctcgtcccgagatcccgacggcgtgcgtgtttgttcgaaaccgagtataggggaaggggcccacgccggcaagggcgtgtggccggatcagaagacccagggagatgccagatgtccgccagccccgccgaggcgcgtttcagcctcagcctgcgtgccgccgccgagcccgactggagcgcggtcaccggccaccgcttcaccgacgagctgatcgccggcacgctggatgatgcggtgctcgcccgctatctggttcaggatcaccggttcatcgacgcattcgtggccctgctgggagcggccatcgcctcggccgaccgcttcgaggcgcggatcccgctctgccgcttcgccgccatggtgaccagcgacgagaacgactatttcctccgggccttcaaggcattgggcgtggacgaggcgatgcgggcggacctgcccgaccatcccgcgaccgccaccttcaaggcgctgatggccgaggcgcggctgacggccgactatgcctgctgcctggcggtgctggtggtggcggaatggagctatctctcctgggccgagcgagccgggggccgcctgccgccacgtttcgagcacgccgaatggatcacactccacgataatccgttcttccgggagttcgtgggctggctggtctcggagctcgaccgggtgggggccatgctggatgatgcggcccgggcgcgggtcgaagatctgttccggcgcgcagtggcggcggagcgcgccttcttcgacgcggcctatgcggcggcatgacccgttgacggcgtagccttgcgacgctagctgatctggcatggtgccgcgacgaccatgccgatcctgagggagacggaagatgaccgcagacgacggacatacccgcgaccagacgggcgctgacgacgaggccggggttctgccgccctcagataccgaaaccggcggtgccgatgcgcctgaagccggcgtgccgcagcttctgcgcgatcgcgacgcggtgttggaacaggcactgcccgatgtgcccttcgacggctggacggacgacctggtccgccgcgccggccaggccgccggcttcgacgccgctgccacccgccggctgttcccgcgcgggcggatcgatctgatcgtgcatttctgcgactatgccgaccggcggatggcggcggagctggagcggatcgatctgccgtcgctgccgatccgcagccggatcaccaccgcggttctggtgcggctggagcagaacctgccccatcgcgaggcgatccggaccgcgctcggcctgctcgccctgccgcagaatgccgccctcggcctgaagacgctctatcgcacggtcgatgcgatgtggtgggcggcgggcgacaccgcgacggatttcagcttctacaccaagcgcgcaaccctggccgcggtctacagctcgacgctggcggtctggctggacgacaaaagcgagggcttcgccgatacccgcgccttcctggaccggcggatcgccgatgtgatgcgcatccagaaggtccgcggccgggtggaaaagatgctgcccgatccgcgccgcttcctgcccggcggcagccgcttcgccggccgcaattccctgcgcatgcgggggcgctgagcccctgcccgacgtatcagctgttgctgcgcgcggtgccgagccgggtgacatggcccatcttgcggcccggcttggcctcgctcttgccgtagagatgcagcttggcgcgcggctcggccaggatgtcgcgccagcggtcgatatcgtcgcccagcaggttttccatttcggcatcgaccagccgcgcggggtcgcccagcggcagatcggcgaccgcgcggatgaattgctcgaactggctggtcgcggcggcgtcgaacgaccagtgccccgaattatgcggccgcggcgccatctcgttgaccagtacccggccatcgcgggtgacgaacatctccaccgccagcagcccctccaggccgaaggcctcggccagcgccagcgcgatgcgttcggcctcggcggcgatggcggccggcacccgcgccggcacccggctcagatgcaggatgccgttgcggtgctcgttctcggccggctcgaagcagcgcacctcgcctgcgggcgtgcgggcgacgatcaccgagatctcgcagccgaaatcgaccatcccttcgaggatggccggccgactgccgatcgtcgcgaaggcggcttcggccgcggcgcggatgtcgccctcggccgcgatgcgggcctgacccttgccgtcatagccgagcgtgcgggtcttcaggatcgccggccggcccagcctctcgatcgcggccaccagcccgtcgacatcgtccacccgggcatagggcgccgtaccgatgcccagccggttgacgaaatccttctcggacaggcggtcctgggtggtctccagcaccgtccaggccggacgcaccgggcgcttcgccgccagccccgcgacgcttgccgctggcacgttctcgaattcgaaggtcaccacatccactgcggccgcgaaggcgtcgagggcggccgcgtcgtcccaggccgcgcgggtccaggcatcggccacctcggctgccgggctttccgcttcgggggcatagacatggaccttgtagcccatccgcgcggccgcgatcgcagccatccggccaagctgtccgccgcccatgatgccgatcaccgaaccgggggcgagcggggcgggggtggtggtgcgatcggtcatcggggtcgtccgtacagggtgagggaagatgagaaggcggctcaggcctggtcgtcgaccggttccagcgccacgccgtcggtctgctcggcgcggaaggcttccagcgcctccagcacggcggcatcgtggttggcgaccacggcggcggcgagcagggcggcattcttggcgcccgcctcgccgatcgccagcgtgccgacggggatgccggccggcatctgcacgatcgacagcaggctgtccatgccgttaagcgccttgctctgcaccggcacgccgaagaccggcacgctggtctgggcggcgatcatgcccggcagatgggcggcgccgccggcaccggcgatgatgacctgcaggccccggccgcgcgcggcggcagcgtaatcggccatgcgctgcggcgtgcgatgggccgagacgatgcgcacctcgtgcgggatgccgaaacgttccagcagcaccgcggcatggcgcatggtggcccagtcggattggctgcccatcacgatgccgaccaggggcgcggtggtggcgggtgttccggcgggcgttccggtcatgaagcctggtccttctgtctctggcggatcgggccggcgcggctgccggaccttcaggagggatcgggggccgcggatcatacaaacaccgcccggccgtgtatactcgcgccgacgcataagcccagcgcgccgccctccccagcacgctctctcccaagacattgccggaagatgcgcatcatgcccagccccgtgcctgcaccctccacgccgcagacccccctcggccgccatgcccatgcggtctatggccggccgtcggcgcgggaggtctgccttgaggcccaggacggccatggcgccgatgtggtgctgatcctggccttccaccatgccgctgcgaccggccgccggctggacgcgcatggcattgcggcgctggatgccgcagccgccggttggcgggccgaggtggtgcggccgctgcgcgccctgcgccgtcggctgcgcggcgatgccccggtcatggccggcatggcggcggatcgtgcccgggcgatcggcgacggcctgctcgcccaggagatcgcggcagagaccgccatgctcgatgccctggcgccggtgttggacggcctcgcccggccgctcggcgcgggggaagacggccgcaccgcctttgcccgcatgctgaatctgtatggggtgctgctggtggccctgcccgacggctggacccgggtgcgggacgggctggtggccagcatggggcccgccattccgcggggggagagcattccgcgggaggaggccggcgaccgcgcttgatcccggaccgggccggcccatcttcttccacttccgggcgttctgcctgccgctcgtgcctgccgcatccccgcctcccgtgctgacgaggatcgccccgaggtgagacagccccccacaagcttcgcagccggccttgcccgcctgctgctggtctggatcctggccggcctgctggtcaacatgccggcgcgcttcgatgcctggttcacgccggcccatttccgcctgtcggtcgaggtggcggcggtcatcctgctcgccctggccctgccggggggctttcccgtcagccgcggcagcaacctggcccgcagcccggcacaggccgaacgctggctgccgggtttcctgctccggctggcggcggccggtctggcggcgctggtgctgctgaggggcgccgatctggtcgcccatgccgccgcgggccggccgctcgatctcggtcgcgatctctatctgatgccggcgctctgggatgtgctggcgggtgatccggcgcggctcgccgtcgtgctcggcttctggatcctgccggcggtggcggtctatctgctggcgcggcgcggccagatcctggcccggcgccatctgaccggcggccgtcgccccgcgatgaccgtcgcggtgctgggcggcatgctggcgctgggccaggtggtcggggccgccagccagaccggcgggccggtgggggcgggggcgctgcggctcgccgccttccaggccgatgcgttgaaggcacgggcccggatcgaggcggagcttgccgcggcggtggcggatgatcccgcagctcacctgccggggccggccctgtttccgcggctgagcggccgcgacgtgaacctgttcttcatggaaagctatggctggtcggcccatcacgatccgcggatccgctatgcggtgggccggcggctggcggatctggggcacaggctcgatgccgcgggcttccgggtggtgagcggctggctggacagccccgtcgtcggcggccagtcctggctggcccatggcacgctgctttcgggcctgacgctcgaccggcagcgggcctatgactatgcgctctcggccgggcgcacgacgctggtcgacctgttcggccgtgccggctggcggacggtggcgctgatgccggccatccgcgaaacctggcccgaggcggccgccttcggctatgaccgggtgatggatgcggtggcactcgactatcgcggcccggctttcggctggccgacggtgccggatcagtatgcgctggaccgctatgccgccgaggagcaggcacccgtggatcggccgccgctcttcctcgaattcgccatgatcaccagccatcacccctgggggccgctgccgccgctgctcgacgactggtcgatggcgggcgccgccggcgggcagatcttcgagacagctgccccgcccgagggccagccctttgcccgcgacacggccgtctgggcggaacgctatgccaatgcgctggactacaccctggccctggtcggccgctgggccgtggagcgcatgccggaaaacgccctgctgatcgtggtcggcgatcaccagccgccgctggtcaccccggcggatgccccgcacagcgtgccgatccatgtgatcgcccgcgatgccggcctgatccgcgccttccaggccgaggggctgacccccggtctgacgcttgccgccgatgcgccggtccggccgatggcggcctggcgcgacctgatgatccgcgccacccgcgatgccgcgccgcccgtcgcgggcttgccttccgtcgcgcccggagatagcttcgaaaatcgaagctaaatgacacgggggccatcgaaggccccggtcctgaacgggaaggcaggaacgcctcatgaagacgcgcatcacggaactgctgggcatccggcatccgatcatccagggcggcatgcattatgtgggcttcgccgagcttgcggccgcggtgtcgaatgccggtgcgctcggcatcatcaccggcctgacccagaagacgcccgagcttctggcgcgcgagatcgcgcgggcccgcgagatgaccgaccagcccttcggcgtgaacctgaccttcctgccgaccttccaggcgccgccctatccggaatacatccaggcgatcgtcgagggcggtgtgaagatcgtcgagacggccggccgcagccccgaggcctatatgccggcgctgaaggcggcggggatcaaggtgatccataaatgcacctcggtccgccatgcgctgaaggccgagaagatcggctgcgatgcggtcagcgtcgacggtttcgaatgcggcggtcatccgggggaggacgacatccccaacatgatcctgctgccacgggcggcggaagagctgaccatccccttcgtcgcctcgggcggcatggccgatgcgcgcagtctggtcgcggcgctggctctgggtgccgacggcatgaacatgggcacccgcttcatcgcgaccaaagaggcgccggtccacgagaacgtcaagcaggcgatcgtggccgcgaccgaactcgatacccgcctggtcatgcgcccgctgcgcaataccgagcgcgtgctggccaatgccgcggtcgaccggctggtcgagatcgagcgcgaaaagggggccgacctcaagatcgacgacatccacgatctggtggccggcgtctatccgcgggtgatgatcgagggcgagatggatgccggcgcctggagctgcggcatggtcgccggcctgatccacgacgtgccgagctgtcaggagctgatcgaccggatcatgtccgaggcggaaggcctgatcaatcagcgcctcgccggcatgatcgccggctgatatccggccgggaggagagtacgcgggaggggagcacggtggcgcgggaaccgctcgatcggatgaattgcagcatcgcccatgcgctcgacgtggtgggatcgatcgacggtttcctgatcctgcgcaacgccttcaacggcatgcgcaccttcgacgccttccaggaccatctgggcctgtcgtcgagcgtgctctccacccgactgaagcagatgaccgaggcgggcatcctgcgcaagaccccgtcgcccaccgacggccggtcctatgaataccggctgaccgaacaggggctcggcctctatccggtgatggtggcgctgctccattggggcgagcgctggaccccggatcccggtggcgagcgcatgttcctgaccgaaaccgccaccggccgcccggtggcgcagatggcggtccgctccgaagacggccgccccctccgcccgcaggagatcaccgccgtggcgggaccgggggcggatgacaagatccggcagctggtggggtggcggcggagaccttgaccgtttctcagcgctcccttacatttcaaccatgtaatggaggcacgcgatgaagaattacgcctcagagttgcatgtgcgagataatcgcgggcgtgttcccacccatctgtctgaacgtccggcatcgattgccggccttcttcatgacatagggaagttcgactcggctttccagagagatttgaggcgacgtttgatcgccacccaaaagattgcgcgtgttttgggcgttccgatgccggatgtcgtggacatgcttggcgtggataaggacagcctgttgcagcgacggggaccgcgccacaccgtagcggccaggcgtctcaaggaaatgctggagatcctccagcgtgtcgaagcctgggccggaggcccacgtgccgccctttcgtggtatcgcgcctatcccattccggctctgggaaatcgtaccgccgagtctctggtcaagacaggcggggcgagcgccgtccgcgactatctcgatcatgtcgctctgggcggttatgcgtgaggttcgccggcgtctgctatcgggctcacgatccgaaatgggcgttcaggccactttcgggtgacggtgcggcggttcggggcggccggttcaatccgccaggcgtgcccgcgctctacctgtcgctcaggatcgaaaccactctccttgaagtgtccgcaggcctgcctgagcggatgtctccgtgcacgttgtgcgtttacgacgtcgattgtgaacccgtcgtcgatctgcggactgcaaaagactggcagaacgccgggattgattcgcaggacatggcgtgcgcgtggctcatgctggctctggccggcaaagaacctccgacctggagactggcgcggcggctgatcggggccggagctgcaggcgtcctggtcccgagtttcgcgacgggtgccgctgcggacgaccagaaccttgttctgtggcggtggggggccgatctgccgcatcgggtcgtggtgtacgaccccgaaggccgtctgccctcggatcaatcctcctggccctgaggcggcgtctccccccaccgcttcagccccggcgtgtcgatgtcgaagaggtccagcacccggccgagggtgtggtcgatcatcgcctgcaggctgtcgggctttgcatagaaggccgggaccggcggggcgatgatggcgccggcttccgcggcctgggtcatggcgcgcagatggcccagatgcagcggggtttcgcggaccatcagcaccagccggcggcgttccttcagcaccacatcggcggcacgggtcagcaggccggtggtgttgccataggcgatttccgacaggctgcggatcgagcagggggcgaccaccatgcccagcgtgcggaacgagccgctggagatcgcagcacccacatcgcgcggatcatggaccgtgtgggccagggccttcacctcggcgatgcgcagagcggtttcataggcgaccgtcatctcggccgccttgctcatcaccagatggctctcgatcccggccgatttcagcaactgcaacaggcggataccgtagacgacgcccgaggcgcccgagatgccgacgatcagacggcggggcccggggcggcccatgccattcattgccgtcatcgaaccgtcatcgggggggttgaagccgtccgtcgtcatatccacgtaactttctgaggggtcgccctgtgtaagggatcgggccgtgccacgggacgtggccgcctgtcccggtccaagatggtattgcgcaacggaggtgtccatgagcgttcaggcgcgtgtcgaagccttgaagcagaagcatgccgctctcgacgaggcgttgcacagtgaatacatccgcccgaagcccgacgaccacgcgatcgccgagctgaagcgcagcaagctgaaagtcaaggaagagatctcgcggctggagatcaactgaccggtagacctgcctgtccgaggccgtagtgcccgccggcgggatgccggcctgcactgcggcaatcaggccgcggccgcccagcgccgatacggccgatgaagacccccgcgatcccgcgaaacccctgccgcccggataggacggcaggggttttcgtatgtccgggccggctgtcggcgccttacagccctcgcgcgcgttcgcgcagcacgaatttctgcaccttgccggtcgaggtcttgggcaggtcggtgaagacgaaggtcttgggcagcttgaagcgggccaggtgctttgcacagtgctcgcggatctcggtctcggtgaccgtggagcccggcttcagggtgatgaaggcgcagggcgtctcgccccatttctcgtcgggccgggccacgaccgcggcttccatcaccgccggatggctgtagagcacctcttccacctcgatcgaggagatgttctcgccgccagagatgatgatgtccttcgagcggtccttgagttcgatatagccgtcggggtgcatcacccccagatcgccggaatggaaccagccgccggcgaaagccttgtcggtggccgacttgttcttgaggtagcccttcatggtgatgttgccgcgcatcatcacctcgcccatcgtctgcccgtcggccggtaccggttccagcgtttccggatcggcgaccgtcagcccctgctgcagggcgtagcgcacgccctggcgggccttgatccgggcgcgttcctccagcggcttcgcatcccattcgggcttccattcgcagaccaccaccgggccgtagacctcggtcaggccatagacatgggtgatctcgaagcccatcgcctccatgcccgcgatcaccgacgaaggcggggcggaggccgcggtcatcatctggatcttgtggtcgaaattccgcttcacctcggcgggcgcattgaccagcagcccgagcacggtgggcgcgccgcagagatgggtgacgccatgggtctcgatcgcatcgaagatcgccttggcttcaacccggcgcaggcagacctgggtgccggcggcggcgaccatggtgtaggggaagcaccagcccgagcagtggaacatcggcagggtccagagatagaccgaacccttgggcagatcccaggtcaggatgttgttgaccccgttcatccaggcgccgcgatggctgtagaccacgcccttgggatcgcccgtggtgcccgaggtgtagcccagcgaaatcgactgccattcgtcggccggcatctcccaggcatagtcggggtcgccttcagccagcagcgcctcgtattcgatctcacccaggaaatcgccatgggtgatcgccgggtcgtcgatgtcgatcaccagtggcttgtcgtccagaagctccagcgtggctttgatcacgccgctgaattcacggtcggtgaacaggaccttggtttcggcatgcttcaggatgaaggcgagtgcctccggatcgagccggatgttcagctcgttcagcaccgccccggtcatcggcacgccgtaatgggcttccagcatggcgggggtgttgggcgccatgatcgagaccgtgtcgccatagccgataccgcgcgccgccagcgccgaggccaggcgccggcagcgggcatagagttcgcgataggtccagcgctgatcgccatggatcaccgccacccggtcgggatggacgtcggccgtgcgctccagcagcgagagcggggtcagcggctgatagttcgccgggttgcgatcgaggttggtgtcgtatttcgacggggtgctctcggccgacatggggcggtctctccggatggtcctgaaaacctgaaggcgcgaccacccgaaaggcagtcgcgcccggatcgctataattccgcagagcggatcattcgtcgagggtcgaggtgtcgccctcgggcaggcccagttcgcgggccttgagcaggcgccgcatgatcttgcccgaccgggtcttgggcagcttgtcgacgatcaccagttccgaaggctgggcgatcgggcccagatcctcgcggacatgggcgaccagcttcgccaccagggcctgatcgccggtctcgccggcgcgcaccactacgaaggccttgatcttctcgcccttcagatcatcgggcaggccgacgacggcggcctcggcgacagccggatggccgaccagagagctttcgacatcggcggtgccgatgcggtggccggcgacattgatcacgtcgtcggaccggccgagcagggcgatatagccttcgtcgtcccgcaccgccagatcgccggtgacatagccgccaagacgctccgaccaatagctggcatagcgcttgggatcgccccagaccgtgcgcagcatgtagggcaggggcttctccaccacgaacagcccgccctggccgttgggaacgtccgccccggtctcggggtcgacgatgcgggcgagcagcgtgggcatggcgatgccggcgcggcccgggcggctggccatggccgggtaggtgccgagcatcgggctcgccacctcggtctggaagaagttgtcgacgcaatgcgcgaagggctcgccgtcatccgacaggatctcgcgctgcgcccaggaccaggcctcggggttcagcggctcacccgcacaggccatgaccttcaggctgcggcgggagtactttttcacgaaatcgctgccgaaccgcatccacatccgcaccgccgtgggtgccgtgaacatctcggtcacgccgaagcggtcgaccacgtcccaggtgacgccggcatccgggtagtcgggcgtgccttcgcggatgatctgatggcaaccgaccagcatcgggccataggcgatgtaggaatggccgacgatccagccgatatccgacagcgaccaccagaccgagtcctgcgtcacgccgaagaaggtgcggatcagcgtgtcgcagccgaccatgtagccgccatggacatggaccacgcccttgggcgcaccggtcgtgcccgaggtgtagaggatgaagaggggatcctccgcctccatctcctcggcctcgatgaaatcgggctgatgagcgatcagggccgcgaaatcgacctcgccggccgaggcctcgcgacccgtgcgcgagagcaccaccacatgatccagcttcggcgcatcgtcgcccgcaagcgcgcggtcgacgatgcccttcaggtcgacgatcttgccccgccgccaggtggcgtcggaaaccagcaccactttcgcgccgctgtcctggatgcgcttcttcagcgcaccttcgcccatgccggcatagaccatggaatgcaccgcgccgatgcgcgcgcaggcatgcatcgagaacacgccttccggggtcagcggcatgtagatgaccacccggtcgccgcgggcgacgcccaggcttttcagcccgttggcgatgcggcagacctcggccagcgcctcggcataggtgaagctgcgttcctcgccgttttccgagacgaaggtcatggcattcgcatcgccgcgccccgcctgcacatggcggtccaggcagttgatcgagatgttggtgcgcccaccggtgaaccactgatggtccggcatctcgaagcggcagacctcgtcccagggcttcgtccaggtcaggctctctgcccgctccgcccaataggccagcgggtcggcattggcggcggcgacataggccttgggatccttgaccgtcgcggcctcgacgacacgcgccggcggatcgaagcgttcggtgacggtcagcagcgcggcgatcttggcggcggcctgatcggacatggtcgtttccccctggctgcggacggcttgcgcctggatgcaataattatcgggatgcccgggccatcgtccgcgtaatttcccaccgggtcccgttgaaagagttgatcgggtaaaacatggttcaagtcaagggtgtggaccccctccgatggtcggggggccggccgcccctgcagacatgcgtccgcaggaggggccggatcacagcattcatacatcacatatcttgaaattaaattataacgaataagccaaagaaaaaatctacttgcgtgttcgcccatagaacgacatgatcattctgtcgcggccatctccttcgtccccgccgcggctcgtttccgggagttagccggccgatcagcggttgatcggccggccttttttgtgtgatgcggcgggccccgagggcaagttcggctttgccttgcccgaagatggacgggggtatgggatcgcggccgacattgagatgatgacgaagcttgcctgccgcggctaaatgccgcgcagtttcatctctcgcggagcctcccgccccatgtccgccgcctctccattgccgcgtcagcccggtttcggcctggctgcctggaccgtcgtgatcatcggcttcctgtctctcggcctcgccttctcgacccgcgcggcgctgggcctcgccatgccggtctgggaacaggcggaaggctggagccggaccgaggtgtccaatgccggcgcgctcgccctggtggtcatggccctgctggcgccgaccgccggccttctgaccgacagccatggcccccgccgcctgctgggtgccgggctggtgatggtggccgccgcggccgggctgatctcgctggccgacgggccggtgatgctgatcctggccttttcggtggtgggcggcatcggctttggcgcggtggcgacccatgtggtggcgaccgccgtggcgctgatggtgccggccgcccgtcgcggcttcgccaccggcattgcgaccgccggcgccacggccgggcagcttgccctggtgccgatcctgtcggtctggatgacggcggatgactggcgcaccggcttcatcggcctcgcccttgcggccggcgtggcggccgtggccgccctcgtgctgctgccccgcgcccgtgccgcggcggcggtcccggggggggcggcaccggctgccgagcccatgggccgacggatcggcttcctggccaccaacccggtctttcacgcgctgttctggagctttttcatctgcggcatcaccacctcgggcgtgatcgaggtgcatctgatgccctatgccgcgctttgcggctttccgccgctgccctcggccacggcctatggcgtgctttgcgcggtcaatctgggcggcatgatcctggcgggccatctgggggaccggatcgatcgcggccggctgctggcggtgatctatgccggccgggcggcggcgctggtgctgctggtattcatcggcgacgattacggcctgctgctgatcttcgcggtgctgttcggtctgttcgactattcgaccgtggcccccacggccgggctggtcgccgaccgcctggggctgcaccggatggggctggccatggggctgctttcggccggccattcgctcggcgccgcgctcggtgcctgggcgggcgggcgcatcttcgccgcaaccggcgactatgccgggctctggtatggggctgccgccctgtcgggtgtggctgtgctgatcgtgctcacccttgcgcggccacgcggccgggatctgcgcccggggcgcgcggcgctgccggcctgacgcgtggtcacctgccctcgatttcgtgtcacgcagcttccccgccgccctgtccggcgactatgctggggccgacgggaacgcgatgacaggcgagatgaccagaccgaacgatgtgacgcccatcaggccgacgccggatcaggcggcggcgctcgacgcgatcgagggcttcctgcgggatgacgggctggatgccttcatcctgcggggcggggccggcaccggcaagacggcgctgatcgcggccctggtcggccgtctgtcggcgcggaacctgtctccggccctcgtcgcccccacggggcgggcggcacggatccttacccataaggtcggccggatggccggtggtgaggcggccacggtggtgaccatccaccgcgcgatctatgccctcgaccggatcgaggtgaacgaggaggccgtctccgagaccgatcccggcctcaggatgatctttccgctgcggggcgaggaggcggtcgccccgctgatcgtggtcgacgaggcctcgatggtcggcgatcgcgagatgcagggcgatctgctgcgcttcggttcaggccggttgctggcggatctgattgccttctgccgcatgcggcgcccggggcgcgcgggggaccggctggcgaaactgctcttcgtcggcgaccccgcccagctgccgccggtgggggaggaaacctcgccggcgctcgatgccggttatctggccgtgaccttcgggctgaaggtcgccggcttcgacctcgcgacggtgctgcgccaggccgagggcagcgccatcctggaccgcgcgacccggatccgcgaggcgctggcggccgggcggttcgacaccctctcgctcaggcccgatgccacagatatcgtggaggtggatgccgccggtgccgtcgggctgatcgtcgacggcatccgcgcgcgcgaccaggtggtggccgtggttgcctccaacgccaccgcgctcgactataatcgcagtgttcgcgaacggctgtggggggatgccgccctgccggtgcagccgggcgacacgctgctggtcaaccgcaattcgcgccgctatggcctcagcaatggcgatgtggtgaaggtgctctcggtcgaccagccggccgagaccgtgccggtgccgctggccggcggccatctcgtcaccctgcgcttccggcatgcggtggtggcgcatcgcgagggcgacggcaccgtcgtccgcacccgctgcctgctgctcgaaaacctgctcgaccagccggggcgcgatctgaccccgctggaacagcgggccctgctggtccatttccgcatccgccatccggagctgtctccgaaatctgcggccttccggcaggcgatcgtcgaagacccctatgtcaacgcgctcctggtcaaatacggctatgccatgacctgccacaaggcgcagggcggggagtggcagacggtgctggtccatttcgcccccggccgtggccagcgcaacccggccttcttccgctgggcctataccgccgtcacccgggcggtgggccggttgatcctggtcaacccgcccgatttcagcccggcggatatctgggcgcccgatccggtaccggcggccacggtggacaacccggcggaggatccgcgggcggatcccgactggcatcgactgtcctttcccgcggccgccgccccgctgatgcaggtccaccgccggctgcgcgccctctgggcggcccggggcatcacgatcgaagacctgcggcatcttcaatattgcgagcgctacaccctggcccgcgagggccggcgggtcatggtgcagtatcattacaacggaaagttccggcccggccgggccggcatggcgccgggtggcggggatgcggccctggcagaggaggcgcttgcggccttccaaggctctgccgacggcgcggctgaagcggaacagccggccttcatccgggatttcctcgtcgagctggatgcggcgctggcggggacctccatccagcgtaccggccagacgccgatgccctatcgcttgcgcatcggtctcgccgaccggacccgcacgggcgaggtcgatgtcatccacgatgcccgccagaactggacggcggttcaggaagtgggcggcccgggtgcgaccggcgggctttgcgatgaactgcgccgcttgatgaccgaccggatcggacgcggcggatgagcgcgcgggagatttttgccctgcgccggcagggccgacatgccgaggcgctggatctggcgcgccgcgcccatgccggggcgggcgagggcgcccccgacatctggctgctgcgggcctatgcctgggtgctctacgaccggatccgacaggcggtggatgcgcacgaagccgggcgtctctcccccacggcgcttcatgcggagatttcgccggccttgcgcgaattctcacgcatggccgatccgctccggcgcgacagcgccttttcgcaggtcctgcgtctggccggcaaggtttcgggcgtctggcccgacttcctggccttcgcccactgggccggcatcgacgatttcacctgggacgaccacaagcccttcgtcgacgagaccggccgcaagctcgatgatctgcgcacccgcttcgtccgggcggtctgtcgtgccacggtggcgaaggccggcgccgaaggcccggaggcggcatccgtggcctgggggcgggaggtgctggaccgggcgctggagggcgcacccgacgatcaatggttgaattattaccgcagcaggttgcacctcgccgatggcgagaccgcaccggcgagccgccgcctgatcccggtgctgcgccgtcaggggcgggcggcctgggtctggggtctgctgggcgagatcctggaagaggcaggtgcgcggggcgatgccctgatctgcctgatccatgccacccgcctcgcccgcgaggaacaggagctgggccagctgcgcatccgcctggcccggcttctggccctcgacagtcgcttcgacgaggcggcggaacagctgcgccaggcgatgcggtatcgcgagcagcacggttatcgcatcccgccggacctggcggccctctgcgcggccaactggttcgccgccgcggtgccgcgtgcgccggccccggtcgatgccgaagccgaggcgctgctgcgcgggctggaacgggcaaatctcggctacagcccgggcgtgatcgaccatgtcaacacggccaaggcgttgagctatgtggcgaccggtgcgaccagcggtttcgttctgccccatggccggtttccggcgatcaggacgctgccgccgggcacggtggtggaggtgggccatgccgcggccgacgggccggcgatcgactggcgcccctctgcggccgacacgctgccgggcttgtgcgagcgcttcaccggtgtgctggaccgccaggaggatcaggccttcgcctttctgcgcggccccgggggcgatgtcttcgtaccgcccgatcttgctgccgggatcgcggtcggcagctggccgggccggaactgccttgcgatccggcgcaccgacaaaaagggccgcaccggctggcgggccgtgcggctgtcggagcccgacgcataaaccggatcggccacaaacgagacgggcggcacccgtgaaggtgccgcccgtctgaaaagcccggccgtcgacggctcaatagtcgtcgttgtagccgtgatcgtcatcctcgtcgaactgcatcggttcggggatctgctcgttggggtcgcggttcagccggcggatggccaactcgcggttcaggtcggtctgggtgcacaggcccagcagcacgggatcgcgcggcttgatgttggggctgttccagtgggtccggttgcggaccgcgttcaccgtctgcttggtcgtgcccagcagcttgcagacctgggcatcgtcgagctcgggatggttcttgagcaggaaggcgatcgcgtcgggccgctcctggcgcttggccacgggggtgtagcgcgggcccttggtccggcgcatcagcggcacggtcggctcgcgcagcttcagccgcgccgccgggttgcgctcgcagcgcgtcacctcttccggggtgagctgaccgttcttgatcggatcctgaccgacgatgccggtcgcgacgtcaccatcggcgatgccctgaacctccagcgggtgaaggctgcagaactcggcgatctggtcgaaggtgagggcggtgttctcgaccagccagacggcggtggccttcggcatcaggggaccagccatgtcgctcctcgttcgaactgttcaggctaccgcctggcaggcacccgctgggggctcggggatgggcccccggcggcggtcgtgccgatgactatagcgaagccccggctttaaacgaaagccgcgcgacaggcaagcaccgtcgcgcggccattttgtgtgacccgtggcccgggggtcagagatcggccaccttcagcacgatcttgccgacatgggtgctgccgtccagccgggcatgcgcctcggccgcccggtcgaagggcaccacgctgtcgatcaccgggccgacccggccggcttcgatcagcggccagaccttttccgccagcgcatcggcgatcgccgccttctcggccaccggccgggccctgagggtcgatccggtgaccgtcagccgcttcatcatgatcggccgcaggtcgacctcggtcttcggcccctgcaggaaggcgatatagaccagccggccgtcgcggcgcagcagttgcaggttgcggccgagataggggccgccgaccatgtccaggaccacgtcgacgccgggatcgccgacggtcgcagcctcgaccgcttccttgaaatcggccgtgcgataattgatcgcaagcgtcgcccccagctcttcgcaggcccggcacttgtcgtcggaccccgccgtggcatagacctcggcgccgagtgccgccgccagctgaatggcggtggtgccgatgccgctggatccgccatggaccagcagacgttcgcccgctttcagcgcgccgcgttcgaacacattggtccagacggtgaaataggtctcgggcagggcagccgccttcacaagatccagccccgccggcaccggcaggcactgttcctggggggccgccacatattccgcatagccgccgccggtgaccagcgcgcagacccggtcacccggtttcacccgggtgacgccgtcgccggccgccaccaccacgcccgccacctccaggcccggaatgtccgaggcgccgggcggcggggggtagttgccctggcgctgcagcgaatccggtttgttgacgccggcggcggcaacccggatcagcacctcgccatggcccggctgcgggacggggcgcgtgcagggcttcagcacctcgggaccaccgggggcggtgatctcgatcgcggtcatcgtgtcgggtagcgcggtctggggcagggcggtcatgcagggcgtctccggtcttgtcctgcggtggcggggcaccaccgcggccccggtcgggcggggaacggctgtcgggaatgatcattccggttcgcggccgagcatggacccaaagccggccggatggaaggggggaggatgggcagggcggaggctcagggctccagcaccatgccctcacgcgcgaccaccgtgcccggccgccgttcggccacctcggcggcgatgcggtccatctggtcgtcgtcatgggccgggtcgtggtgaaagacgacataggtcttcacgcccgccgcctcggccagacgcatgccggccgaccaggtggaatggccccagccgacccggctcggatattcctcgtcggtgaacatggcgtcgtagaccatgatgtcggcgccggccaccagctcggcgatgcgcggatcgacgccctcggccggatgctcggtatcggtgatgtagcagatggagcggccgtcgaattcgacccgatagcccaccgcccgctgcggatggttcagcagggcggtgcggatccggatccccggatgcggctccagcacgtcgccgggaacgaaatcacggaagctcatatccgccttcatgatctcgaccgggaccggaaagaccgggtcgctcatcagcgcgcacagcaggtcgcgcagattgcgctccggatgcaggtgcccggcccacatccgataggtattgcgcggatcgaaggcagtggagaagaacggaaacccgcagatatggtcgaaatgggtgtgggtcaggaacaggtccgcatccacgggaacccgggttctcaattcgtcgtccaggacgcgcagtcccgtgccggcatcgaagatcaggcgtctgtctccgcatcgcatctccagacacgacgtgttgccgccatagcgtaccgtcgacgggccggggcaggcgatgctgccgcgcacgccccagaacttcacccagaattcctgtgtctttgccaatcccttacccgccgtttcgagcggcctctcctgtccgaccccgcgtgctctacaggtatatggtgacagggatgcgacgacgccccctgcggttccggcatggccggcccgcatcggtgcctctccggcggtccctgtccgttcggccaccgctctcccggcggtgatccgtgcgtctcccgaacggcagtttgcctgcttcggtggcgtgatgcaaaccgcgcacatcttgcccggaacgccgccgcacactacggttctgaagacgacaggccgatcaccacgaacaggcgcatgatgaccttttcagtcgccttctggggggtacgcggcagcatcgcctgccccacaccccgtcatatgcgctatggcggcaacacgtcatgcgtggcggtgacctgtggggaccgccagctgatcttcgatgccggcaccggcatccgcgagctggggcaccacatgaatcttgcgggcgtgcgcacggctacgctgctgctgtcgcacacccattgggaccacatcgtgggcttccccttcttctcgcccgccttccgccgcggcaaccggttcgaagtgctggccggccatctgatcgcgtcgggcggcatccggcgggtcatcgaccgccagatgcaggccccgacctttccggtgccgctggaggcgatgaacgccgaaatgaccttcgacgatttcgccgccggcgatacgctgatgctgggccccgacatccgggtccggaccctgccgctcaaccaccccgacggtgctaccggttatcgcatcgaccatgccggccggtctgtagcctacatcaccgataccgaacatcgccccgacgggccggaccagaacgtgctggcgctgatggacggggtggacctcgccatctatgacagcacctataccgacgacgaatacccggccaaggccggctgggggcattccacctggcaggaaggggtgcgcctcgcccggatggccggggcgcgccggctcgccattttccatcacgacccggatcacgaggatgatttcatggaccgggtgggggcggcggccgcggtgatgtggcccggcgcgttcgtcgcccgcgagggcctggtggtcgatctgctgaccgacagtttccacgatctgccgcgctgacgatcacgccccgcccggcccaagccggacggggcgtcgtcgtcactgcgaagtgaagatggggcggcaccctgcgaagttaagaagatggggcggcgccctgcgccgggccgcaccggcaccgccccgagtggcacgggcaggcggggagacaggagggagcacccgcccatgccgcgtcgccgtcatgcctgctgcctcgtcgcatgacggccacgaaagcctcggccgccttcgctcagcgaatggcgaccgggttgatgatcgcctgcaccgcgccggtgtagcggggctggcccagcacgaacatgaactcgtaggccttgtccttcgcgagttcggccgtgttcatgttttcgaggatatagacgccgttctggggcagcaggatctggtgcacctcgaacacgccggcaccttcctcgaagggaatggcttccagcgcccagctgtcggcgccgatcgcgaccacgcccttttcggccaggtagcgcgcgccctcgcggccgagcccgggctcgccgctggaatagcgcttgtcgtccttgccgatcaggctgatccagccggtgttgaacagcaccacatcgcccttgcggatttcgacgccctgtttcttcgcgacctcgtcgatctcggccttgttgaaggcggtgccttccttgacgatgtcggtcccgtaatgggcggccatgtccagcagcacgccgcgggtggtgatcggcggcaccttttcgatgccgagcttggtgagcccggtcatcgcggcgaagtccttggcctgatggccgttgtaataggtgccgtcgatgccgatatggccaagcccgtcgatctggctgccgatgcccagccagccttcgatgatgtcgtcgttgtaggtggtcttggtcggccccaggctgccgccctgggtctggcccggctggacgacatagatcttgaagccgcgcggcgcataggccggcgtcttggaattggtctcgatacccagcggataggtcttgccggtcttgatcagctgggccgcctcgagaaccttctcggggctgagattgttggcggcgccgatctcgtcatccgggccccatttggacttggtccagtcgtcggcggccagtgcggcgccggcgatcagacagcccatggccgtggctgcggcggtgcgcgcaaggcgccggccgtgccggcggacggacgcacccgtcccctgacggttcgtggtcatacctggtcttctcctcccttcgcggtccggcaggtcgggccgggccgctgcctgacgtggccggccgctccgttgggcagaagtggcagccggtccacctgcagcccccgccatcgtcatcgtggcggggtgcatgccgtcgggacgtgtcgttcagtcccggagatagctccggatgccgtccctttgcttagatggttaactgaatgttatcgtcacgcaagctgattataaattggatgcgttgtaagaaatcttacgcatactttcttgatatttcggtcactttaaacatggtttgagaaaggtcggactgcgacagtatgcgtgtgaccatgttgcgatgcagcaggcggagcgggccttgatgctggcggcggcggggcgggcggggctagactgccacggcgctgcgggatcctccggaagggcttccgggggcgggcggcgccgtcaagttcagaggagccgtttcgtcatgaatctcaagggtaagaccgcgctcgtcaccgggtcgaccagcggtatcgggctggccatcgcccgcgcgctggccgcggccggcgccgatctggtcctgaacggtttcggcgacgcagcgcagatcgaggcgctggtggccgagatccaggccgaggccggggtgaaggtcgtctatgacggcgccgatatgagcaagcccgccgagatcgaggccctgttcgccaatgcggccccgaacgggatcgacattctggtcaacaatgccggcatccagcatgtggcgaagatcgaggatttcccggtcgagcagtgggaccggatcatcgccatcaacctgtcctccgccttccacaccagccggctggcactgccgggcatgaaggccaagggctggggccggatcctgaacatcgcgtccgctcatggtctggtcgcctcggccgagaagtcggcctatgtggcggccaagcacggcatcgtcggcctgaccaaggtcaccgcgcttgagaccgccgagaccggcgtcacctgcaatgcgatctgcccgggctgggtgcgtacgccgctggtcgagcgccagatcgaggccaagtccaaggagcacggcatttcgatcgaggaagccagccgcgacctgctggccgagaagcagccgaccctgcgcttcaccaccccggaacagctgggtggcgtggcggtcttcctgtgcagtgccgctgccgacaacatcaccggcatctcgctgccggtcgatggtgcctggaccgcccgctgatcccgtcttcatcatcaccaacaagaaccagccgaggaaacgccccccgatgaccgagagcccttccgccaccgatccgcgcgtctacatggtgcacggccagccggccaccgcccgggtgaagggcgatccggccgccggtgctgcaccggtgctggtgctgctgcatggcgccggtctcgaccgccgcttctggcgcccggttttcgacgatgccgcgatcaccaccccggtgatcgccttcgacctgccgggccgccagggcagcgaggggacggccttcacccgcatctccgacagtgccgcctggatcgcggcggcactgaaggcggcgggcgtgcgccgcgccgtgctggtcggccacagcatgggcaccgtgatcgcgatggagacggcgctgctgctccgcggcgatgacgcggtgacggttgaccgcctggttcttctggcgccggccgacgtgatggcggtgaacgatgcgctgctgcagcagaccctgaacgacccggctgccgcccaggcgatgatggataaatggtcctacggcatccccgacggcccgcattgcgccgaggctcgcgccaatgccgccgatgcgccggcgggcgtgctccatgccgacctcaccgcctgcaacgccttcggcagcgcgctcgaccttgccgccgcaatcgcggtgccggtcgatgttgtggtgggcgaggccgacaagatgacgcgggcaaagcagggccgcgccctcgccgccgccttccgccatgccgaggtcaccggtctcgacggcgtcggccacatgatgctgcacgaaaagcccgaaccggtgctggccgtgctccgccgtgcggtgggggtgatcagcccggtggtctgaagcggcagccggaactttcagttatttcagttattgacgcgaggcctgtccctcccaccttctcaacgaagggagggacccgcctcatgacgacacgtgttctgcactatgccggtctcccggcccgggagcgcgagggcgcggatacattgccgtcccttgtcggtgcggatcaggtcgaacttcgcgtccggcaggatgggcgcgagcacgtgctgatattgcccgagggggccgtgcgtgccgtaagcaccttgctgacctcgcttatcgaaggcgatcgggtcgccgttctggcggaggatcaggaactcatgcctgccgaagcggcagagatcctcggcatgtcacgaccgatggtcgttctgcggatggaccggggcgatttgcccttccgcatggtcggcagtcaccgacgcgtgcgtctggccgatgtcctcaagctccaggcagcaggcgaggcacgccagaaggcccttgatgcgctggcggcggacaccgaagacctgatctgccatcatgagctataggccgcccgtaccgctgttcgcccgcggccgcagcccgtcgagcagaagccgggtgagggcgtcggcggtggtggtggcgaaggcggggtcgtcgagggtgtggcccgagaccgcttcgacctggaccgcgaaatcggcatagtgctgggtggtcgcccagatcgcgaagatcagatggtgcgggtcgaccggggccaggcggccggcggcgatccagccccggatgatgtggctcttctcgtcgaccagatcgcgcagcgcgccctcgagcaggggtttgagcagcggcgcgccgcgcagcatctccatggcgaagagcctggacgccgcggggtcgcggcgcgaccagtcgagcttttcggcgatatagccgcggatcgcggccaccgggtcgtcctcgacatccatgtcgcgcagcggcaccagccagcggtcgagcacccggtcgagtgctgccgtataaagccgttccttggtcggaaaatagtagagcaggttggttttcgacatgcccgcctcgcgggcgatggcctcgatccgtgccccgtcgagcccgacgcgcgagaacaccgccactgccgcggtcaggatgcggtcgatccgctcgtccgaggcacggtggcggcgggggcggtggtcggggttgcccggcgggatcaggccatccatggggtcagcggctctcccgtcgatagaagctgcccgaggcctggggcggacggctgcggccgaccagcccgaccagggtgaggatggccgccagatagggcagcaccacgaagagctgatagggcacgtcgccattggcgaattgcagccggagctgaatggcatccgacaggccgaagagcaggcaggcgagggcggcgcccaccggcgaccagcgccccaggatcaccgcggcgacggcgatgaagcccttgcccgcggtcatgccctcggtgaacaggaaaacctgggagagcaccagcaccgcgccgcccagccccgccagcatgccgcagacgacgaccgcgcccagccggtagaggcggaccggcagcccggcgacatcggcggcgcgcgggttctcgcccatcgccttcagcctgaggccgataccggtgcgggcgaggatcagggcggcgagcggcacggccaggatggcggcccaggtcatcggatcggtcgagaacagggccttgccgacaatggggatgtcggcaagcccgggaatgctgacgtcgccgaagcccggcacgcggttttcggccgcgcggccggaggcgctcagccggtgcaggaaggcggcgaggccgagcccggccagattggcaccgatgccggcgacgatctggttggcgccggcatagatggtggcgatcccgaaggcggcccccagcatgccgcccgcaaatgccccggtcaccacgccccagccggcggagccgccggcgatggcgccccaggcggccccgaaggcacccaggatcatcgaaccttccaggctgatgttcacgacgccggcgcgttcggaaaacacgccccccagcgccgcgaagaccagtggcaccgacaggcgcagcatcgtggcgaagaggtcgcccagagcggtgggatcggtcagcatgtcgatcatgatgcggctccgctgcccgctgtggtgcctgcaggtcggcgtctgcgggcaagcagccggtcgaaggcgccatagcgctgaagggcgaggcccgaggctgcgaagagcacgatcagcccctgaacgatggtgacggcggtggcgtccagaccggcgcttttcagcgtggtgacggccgtgcgcagcagcgccatgaaggcggccgagatgatcgaccagaccggatcgccggcggccaggaaggcgaccaccagcccgtcatagccatagccggcggcgaaattggcatagagccggtgcttgaggccgatcacctcgaaggcacccgccagcccggccgcggcgccgcccagcgcgaaggcgatgacggtggtgcggccgacggcgatgccggcataggtggcggccccgggcgatttgcccgccacctctaccccatagccccaggcggtgcgacccagggcgaaccgggcgagcacggcgaccagcagacccacgatcacccccagatgggcctcggtatccgccatcagcagcggcaggaagctcgcttcgggaatttccggcgaatagggatagggggcacccggcgccttcagcggcccgcttgcggcatagctgaccaggttgagcgccacatagttcatgagcagcgtggtcaccacctcgtcgatgccgcgccgggccttgagcacgccggcgatcccggcccagagcgccccgcctgcggcacccgccaggctggcggccagcaccgccaccgacatcggcacaccctcgggcagattcagcgccaccacggttgcgaacaggccgcccatatagatctggccctcggcgccgacattgtagagcccggccctgagcgggatggccaccgcaatgccggccagcagcagcggcgacatccgcgacagcaggtcggagaggccccaatagtcgagcagcacccggtcgacgatctcgtggcccaggtgaaccggatcgccaccggtggttgcgaccagaacggcgcccacggcaagggcgagcaccaccgcaccgaccggcactgcggcaccgctgaggaggcgggagggcgtcatgctgcgtctccggttcgggtgtcggaggcagggcgcgcggtaccgccacccatcagccggcccagggtctgcgggtctgcctcggcgcgcgagacgatgccggtgatccggccgccgctcatcaccgcgatccggtcggcgaccgtgcgcagctcgtcgagttcggtcgagatgtagagcacggcggcaccgctgcgggtcagctccagcaccttgcgctggacgaaggcggtggcggcgacgtcgagccccttggtcggctgctcggcgatcagcagccggggcgcatggccgagttcgcgggccagaaccagcttctgctgattgccgccggacagcgcgcgggcggggccgtgggcggcgccgcggacatcgaattcggtgatcgcctgggtcagccggcgggcggcaagtgcgcgatcgatgaggccgaaccggcggcggaccggcgggcggtcgacatcgcgcaggatcaggttgcgggcgccgtccatgtccagcaccagcccggtatggtgacgatcgcgcgggacataggccacccgatggcgggtcagccgttcgcgcgcgcggccgggggcgaccgtcacgccgtcgaccagcacatcgcctgcaaccggccggcgcagccccgccagcgcctcggccagttcggcctggccgttgccgtcgacgccggcaatgcccagcacttcgcccggggcgatccggaacgaaaccccgcgcaccgccgaccggccggcatcatcgtcgatgtccaggccggcgacctccaggacgggtgtcgcatggctgtcgatcacggcagttgcagcaggcacggcggtgatcatatcggcttcgtcggccccgaccatcagcgccgccagcccatcggcatcgaccttgccgatcggcagggtggccaccagccggccgcggcggagcacggtgacctcgtcggctgccgcgaagacttcggccagtttgtgggtgaccagcagcacggtgcggccggcggcggccagccggcggagcgccgccatcaaccccgatgcttcggccggcgtcagcacgctggtcggctcgtccagcaccacgatccgggcgccgcggaccagaaccttcaggatctcgacccgctggcgcatgccgggcggcatgtcctccaccttcgcatccagatcgaccgtgaagccgagttccgcggcaagggcttcggcttccgcccgggcgcggaccagcccgcgatccagccggccgccggtcgccaacgcgacattctcggcaccggtgaagcggtcgaccagggtcagatgctggtggatcatgccgaagcccagatccagcgcccgtttcggatcgcccggcggcaccggccgaccgtcgagagccacctgacctgcatccggacggtagaggcccgagagaatgttcatcagcgtcgacttgccggcgccgttttcccccagcaccgcatgcacggtgccgggggcgatgtcgagggtgatgccgtcgagggcggacacaccgccgaagctcttggcgatgccgtcgagcgtgaggcgcggcatgggtcaggtatccggggtggttggcgggggaggggagacgaggtgggagaggctggtggtcagatctgcttgcggcccgcagccagatcggcgatgagcgcctcgacctcggccttcacctcggcgggcacggcctcgtggaagctgccgaaacgggcggcatcggaggtggcgagaccgtagacatattccttgccaccggccttgccggccctggcgtcttcgaggaaatgcaccagcgctgcattcacatccatgatcaccgactggatcacggtgtcgggccagtcgacgatggcgtcgtaatagatgccgaaggccttcacgccggcttccttcgccgcggtcagcgccccgttcgatgccagatccatggtcgggaacaggacgtccgcgccctgcgagatctgtgcggaagccgcctccttgcccttcgccacgtcgttccagtcgcccatataggtgaccaggaccttggtacccggcttgccggcctccgcacccttggtgtagccctcgaccagttcggtcgagaacttgatctcggtggcgcccagccagccgatggtgccggtcttcgacactttggcggccatatagcccagcacatagccgagctggcggtagtcgaaattgatcgtcgcgacattgccgccggcggtcgcacccgacgagaccacgaacagcgtgtccttgaactgcttggccagccggtcggccgggtcctggaactcgccgccatggccgatgacgatgccatagccgcggcgggcgaaatcgcgcatcgccgacatctggtcgggttcggcgacgccttcggcataggcgacgtcgatgcccatggtctctttggccttcatcagcccgtcataggcgctctgattccaggcctggtcgcggatgctgccgggcagcacggccgcgacgcgcagcgcctcgtcggcggcatgggcgcggggggccatggtgagcgaggtggcggcgatcagggcggcgaagccggcgatgccgagccggcgggcgaagcgcgaaagagacatccgggtgcggtcctcggaacagggtcaggggtgtccgctccgtcttagcaatccccgtgccgcatgctgccggccccggaatgcggggcgctccggtcggccacatcacatggtgtgcacaatttccgcacaggcactcgggtgctgtctaaattttgaccatccggtcgggatttgccggcaagagggcgtgcggtggcgtggccccgctggctggtccgcttcttgctgagccgtcagcggaccatctcccccaccgacatgccgaacggagacgacagatcatggccgtggttcagaccggcaacgggccgcgcgaacttgtcgacagcgggctcgatgcccgcagcctcgccttcaccgaaattccggtgatcgatttcggggcgctggtcgaccctgcttccacccaggccgagcgtatggcggtgggcgatgcggtgcgcgatgcctgcacgcgggtcggcttcttctatgtccgcaatcatggtgtcgatccggcggtcatctccggtacctacggggccgcgcgcgacttcttcgccctgccgatggacgagaagatgcgcatccatatccgcaaatccaccaaccatcgcggctatgtgccgctgctggaagagaacaccgacccgaccgcgaaaggcgacctgcacgaggccttcgacatggcgctggaagtgccggccgatgatgccgacgtgctggccggcaagaccatgtacggccccaatgtgtggccggagctggacgggttccgcccggcgatggaggggtattacgaggcggtctatcagctcggccggcggatcttccgcggcttcgccctggcgttgggcctgcccgaggatcatttcgagccgctgatccgcaagccgatggcgcagctgcgcgtggttcactacccgccgcagcaggggccgatcgacgagcgccagatcggcatcggcgcccattcggattacgagtgcttcaccatcctgaaccagatggagggggtatcggccctgcaggtgctgaacggtgcgggcgagtggatcgaggcgccgccgattccgggcaccttcatcatcaatgtcggtgaccagatggcgcgttggaccaatgacgtcttcgcctcgaccatccaccgcgccatcaaccgctccggtcgcgagcgctattcgattccgttctttttcggccccgattacgacacgccgatcgaggtgctggacacctgcaccaccccggagcgcccggcgcgctatcccaccgtcacctcgggcgactacatcctgtcgcgttttgacgaaaccttcgcctatcgcaaggcgggcgagcctgaacctgccggatgaggatctgggacgcctgcgagggtgtcccacattcccccggcgaaggccgaactacaaacctcttcgccgcatgaggaacaggatcgtttcgaccagcagggccgcgagcatcgtggcccccatcaccgggaagatgaccgccggcaccgccatcagcgccgccgcctgggcctggctgcgtccctcagtctgtcgtggcgccccgaaccggcctttggggcggcgcttccaccacatcaccggggcggccagacacatgacgatcagagcgaggcaggcgagcagcagtcccagccggttcagcgctccccattcctggcccatatggacgttgacgccccattcggtggcgcgggcgaccgggccgtaatcggcgtaagaggcatcgatcagcgtttcgccggtccagcggttcagatggatgatccgctggtgcgcaaggtcatgcgggaagaccatggcggtatagaccccgtcgggcgcctggggcagggcgagcttgtagccgggggcgatgcccagggtctcgacgatcatgcgggcacggtcgatgccgatatcgggcacggcactgcccgtggcgggggagcggggcaggggggcatcctccagggtccaggccgtctcccccagcaccgaggtcggcacggggctggtcggcaccgcttgccagaccccgagtggatagccgagcccggcatcggtcgcggccgatcgcatggccggcccccagacctgactccaggtcatgcccgagaccgccaggaacaggatcaccggtgccaccaggatgccggtaacggcatgcaggtcgcgccagaagaccctccccgccggcccgggacgcccgcgggaggccgtgcggatgcgcaggatgccgcccggctgcttcccctcgggcctgcgtccccgcggccaccacagccagatcccggtcaggatcagcgacaccgtccagccgccggcaatctcgatcagcagattgggcaccggccctgcgatgatcaggctgtgcagccggcgcaccaccatcatcggggcggcgagatcggcacggttgcccaggacctcggcgctgcgcgggtccaggaacacggtgagcgcagtgccgtcggccgtcttcatgccaacaccggcgctgcggtcggcggcggcgggggccagatacgagaccggacgggcctccggcatggcggcccgggcagctgcgatcagatccgagggcggcagggtcgtctcgcccggtgccaccggccggtccagcaccagcatatggccgtcgatcagccggtcgaaggtgtccttgtagagatagatcgccccggtcgaggccagcagcagcaggaagggcagggtcagcagcccggcgaagaaatgccagcgccagagcgcgcgatagagcgtgccggcaaggcttgccggccgcgccgccgtggcggcgggggtcgtgacggtcatgagtcggtatccggtccggtccgtgggatcctgtgatcaggcggagagcggaccgagaggtggcgcatgggcgccgagcggcgggccggcccgggccggcaccggtgccacggcagccagggccggcggatggtcgatcgccggcagggccatgggcagggcgaggcctgccggcgccggtggcagatccggcacgaccaccatggcgaaatcgcagacagatccgcgccggtcgtcggcgctgccgtcggtcgggccgtcggcgggtggatcgaaacgcagccccagacaggtgaccagatcgaagcggccttcggctgcggccgaaagatcgggcatcacgcctgccggcaacagcgcacgcagcagcagcgccagggcaagagcccaggcggcgagcgggtggcggtgatgcagagggcggcggtttctggtcatccggccagcatgcccggcgggcgccggttctgcacctgcgacggaatgtcgcggggcgtcagtgctcagggtagatgaaggccgatacgccgatcagcagatcgtcatagcggcggatccaggccatcttgggcagcacccggccgctcgcctcgtgggcatagctgtaccgggaccagccctggccttcgggggagcgggcaatgcggatccattcctcgatgaagcggttaccgtcgccgtcgctgatccggcggagattgatgccggtctgtccgggccggcgggcatgcgcccggcaggtgccgttcaggtcgtagacgaagacatagaggtcgcggtcatcgaattcgagcggcccgcgatttacctcggccagtcccaccgcccggccatgggcctcgaaataggcgaccgcccggtcggccatggcgcgggcctcttccgcggtctgcccggcctctcccggcagcaatgccgggccggctgccgcaatgcctggcacggccagcccggccgccagaatgcccgctttccatccacgtcgcatgtctgcctcccgatcataaacgttcaggtagaatatcggaggcgccttcaaacgaaaaggccgccgccggttgcccggcggcggccctgtcatgggggtgatcctgcgggatcagcccttgatctcgccggtgacccaatagttcacgcgggcgggatggtcttcgatgtacttggcgaccgcatcctcgtaggaggtcttctcggcctcggccatcaccgcctgcagctcttccagcggcagcgagaagcgggtcaggaaggcgaagagttccggatgctcacgatccaggcccatgcgcgcgatggcgtggacacgctccgaaccgcccagggcgccctcgggatcctccagatagcgcaggtcataggcgccgaacatccagtgcgggctccagccggtgaccacgatccactcgttgcgcttgatcgcgcggtcgagcgctgcggtcatcgccgcacccgaggccgagaccagttcgtaatcaaggccataggtcttgatcgcctcgtccgacaggcgcatcagcccggcgccggggtcgatgccctggatcttgttgtccagcttctcggccacctcgggcttcttcaggtcggcgatggtcttgacctgatcctcggggatgtagttgggcacgacccagccgagcttggcaccggtatacatcgggccgaggtcgatcaccttgccggcgaccttctcgtagtaatcggcatgggtgtcgggcagccaggccatcatcatcaggtccagatcgcccttctcgacgccctgatactggggcgcgatatcggcgagcgtcagctcgacgtcatagccgaggcggtcttccatgaccttggccgccatcttggtgaccgtctcggcatccgaccaggcggtccagccgatgttgatcttcttctcctcggcggccatggcggaggtggccatcgtgccgaccagggcggtggcggcgagggccgtgagggcacgcttcgggatgaagctcatgtcgatctcctcaagggaatggtttcgggtgcaggtgacttcagaaaggcgttggtgggtggcggggactggccgtgacggggactggccggcggcgtcagcgcctgcgtccgcggctccggccgaagctctgggtcaggcggtcgagcacgatggccagcaccaccacgcccagcccggcctcaaagcccaggccgatatccagccgctggatgccgcgcagcacttcgttgcccaggccgccggcgccgatcatcgaggcgatgaccaccatcgacagcgccagcatgatggtctggttcacgccggccatgatcgagggcagggcgctgggcagctggaccttgaccagcagctggccgccgctgcagccgaaggcacgtccggcctcgaccatttcggccggcacctgacggatgccgagattggtgagacgcaccgccggcggcatcgagaagatcaccgtggcgatggcgcccggcacctggcccaggccgaagaacatcaccgccgggatcaggtagacgaagggcggcatggtctgcatcaggtcgagcaccggccggatcgcggtttccaccttgtcggagcgggcggcggcgatgccgagcggcagaccgatcgccaggctgagcaatgtggaggcgatcaccagcgacaggctgcgcatggtggcgtcccacaggtccatgccgaccagggccagcagggcgaccaggacgaagaccgcgaagccgcggctgacccgccacagggcgatgccggtcagcgcgatcaccatcagccaccagggaatgaaggcgagcacgctggcgaaggccgaaaccacggtctcgaccacgtcggcgatcgcgtcgaaggcgggggaaaaattgtcgagcaggaagtcgaccaccgcctcgacgccatcgccgatcggaagggtaaatccaagatcgttcatcacgcggcctccccgctgccggttgccgaggcggcatcgaccgccgtctggtcgtcgctgccgcgatcgagcgcattcagcagcgcccggcggctgacgacaccgcgatagacgccttcggcgtcgatcaccggtaccggatagggggcggcggccacggggcccaggatgtccgacaatgcggcatcggcgggcaccgtcaccggatcgcgcagataggcggcccggatcacggcctcgtggtcgacgggcttgtcgccatgcttgcggtcgcgctccgcgatcgcggcttccaggctctcgaccgagatgacgccgcggaaatgtcggcgacggtcgtggaccacggcgaagtcgcgctcggcacggcggatacgttcaagcgccgcgcgcagatgactttcctgaagattgacgaccgtcaggccttcgcggcgggccacatcggcggcggtatagacctgggccacgtcgacgccgcggaagaaggcgcggacatagtcgtcggccgggtcgcgcaggatctcgtcgggcgtgccgacctggatcatccggccgccttccatgatcgcgatccggtcgccgatgcgcatcgcctcgtccagatcatggctgatgaagacgatggtccggctttcctcttcctggaggcggatcagctcgtcctgcatctcgctgcggatcagcgggtcgagggccgagaacgcctcgtccatcagcaggacggtcgggttctgggccagggcccgggcaaggccgacacgctgctgctggccgccggacagctcgttcggatagcggtcggccagatggccgaggccgactttctcgagcgcggcacgggcgcggtcgcggcgctccgacaccttcatcccggcgacatccagcccgaaggcggcgttgtcgagcgcggtcagatgcggcatcagtgcgaaactctggaacaccatggcgatatcccggcggcgcaggtcgcgcagcgtcctggtatccatggcggtcacgtcgaccccgtcgatcaggaccttgccgtcggtcgggtcgatcagccggttcagcatccgcaccaatgtgctcttgcccgaaccggacagccccatgatcacgaagatctcgcccgcgcggaccgtgaagtccacctcgcggaccgccacggtattcccggtggcttcgtgaatggcggcggaactttctcccttggcgatgcgtttcagcgcctgagaggggtggggcccgaaaaccttggtcagcccctggacgacgatcttttcgctgttgtcgctcatgctccgtcgatctgatcgggcgggcccaccgggcttgaggtgggggcggcgccgatgccgggcatcacggaagacaccagacaaaaaaggccccggacagtcgagcggaaccgcctgaccatcgggtgacaatcgcatcagagatgcgcatagccgttcgtaacgggcctatgggcgccgaccacgagtatccagacgacgcgtatgccgtttggacggatgggccgccggttatgtccggactgacttcatgtcatgcccggaaatctatgcgtgatctgtgtgtatcacattggggccggtttgaaaacccatggggttccacaaagtctgtgggtgatcacgatgctcacgtaaaacgagcgtggtggtctgaaatatgccgtcgggcgtgggggcgtcccagccttgccgctgcccggcgacggggccattatcaaggtgtgtatcgctcctgcttcacgtccggggatccgacacatggctgtcctgaaggtgcgcctgcccgatgcggcagaagactgggttcgcgagcaacttggccgcgggcggtttggtgatgtcgacagctacatcgctgatctgatcgcacgcgatcgcgacaccgagcgcagccgggatgcccttgtggcggccctgatcgagggcgaggagagcggaacgtccgatcaatcacttggcgacatccttcacgagatccgtggatcttgagctgccgcccgatcgacagacgccggagcccgaacgcaaaaagcccccgccggtggcgggggctttctggcaggcgagggcgggggccgttgggcgcggctcccgccttttgatgtgtcggtgtcaggggggcggggcgttatgccccggcgccttgccgatattcaggccctaccgatgatcacgcgttgccggcggcaccgatggcgatgcgcttcggctgacgctcctcggggagcttgcggatcagcgacacggtcagcacgccggcggcgagatcggccgcggccacctcgacatgctcggccagggtgaagcggcgctcgaacgaggcgggggcgaagccacggctcagataggtgacgccctcttcagccgcctcggccggcttggtgcccttcacggtgagcacgcggttgtcgacggtgatctcgatctcgttctcggcaaagcccgggacggcgagttcgatgcggaaggtgtcttcgccggtacgggcgatgttcacgccgtcggtgcggccgtcggccagacggtcgaccagatcgaacagcggcgcgcggaagggatcgaagccgcgggtggcacggaacgcgggggcaaactgcaggagaccagccatgggtcacatcctccgatagacgagcaatgtgtggatcgaccgacgccgctgcatccgttcatgcgcccgcttcggggccgcacagggtggtggtcggtcggtgccggtccgacgcttcggccccggcacgaccatgatgtaggaaggcccgaagcccgttcaagaggggggcagccacctcacagggcaatcgggtgaaacagtgcgtgacaggacggaaaaagtctgaatctctcgttgtcgacgttgctggcttgggagggatggatggaaccgtgtggggccttgggcgaagcgattgggtttcttgagcattttgaggagcttccggacgggcggcaagctggcaagattgtgtatccgcttgatgaggtgctgctcctgagccttctggcggtgctggcgggagcggagaccttcacggacatcgcgcgctttggccaaaagaagctcgatctgctgcggcgcttccggccattcgcggatggcacgccgccgcacgacacgctgggtgacatcttcgcgtcgctggacgcggagagctttcagcggtgcttcgtgtcgtgggtggcgtcggttaccgggacgcctgagggcgtgatcgccattgatggcaagaccgtgcggcgttcgggcgggaagaaggacgcgaaggcgcccatccacatggtctcggccttcgccgcccggcagcgtctggtgctgggtcaggtcaaggtggacgagaagtcgaacgagatcgtggccattcccaagctattggacctgctggcgatcgaaggggccatcgtgaccatcgacgccatgggatgccagcgcgacattgcggccaggatcaccgacaagaaggccgattacgtgttggccctcaaaggcaatcaaggatcgctgcgcgaggacgtcgccctgttcgtcgccgaacagcaggccaagggcttccaggatacgaccatcagccagcacgagaccgtcgacggcgatcatggccggatcgaaacccgcaagaccaccgtcatccatgatgtcgcctggctccgggcgcgacatgactggcccggcctcaaaagcatcgtcgtcgtggaaagcacgcgacggatcggcgacaaaatcgacagcgaaacccggctctacatcacatcattggcgctcatcgccgctctcgtcgggccgatcatcagaagtcattgggccatcgagaatagtctccactgggtcatggatatggtcttccgtgatgacgaatgccgggtgcgtacccaaaacgccccagccaacttcacaaccctgaagcacatggcacataacctgctgcgacaagcaccgggaaaggactccctacgcctccgacgcaaggtcgccgcctgggacgacgacttcctcgcaagcctcatcgcagtttaaaaactttcacccgattcccctgagccacctcaggccggtcgaatcctgacccccgccccgccctccatccgaaaacctgccccctcaacgctgaaacccggcatccgagcccctggacggggacgaatgccgggtttcagcgaggacgctccggagggcggcgctggccgcccggcggtcgttcagatgccgaagttcgcgaaacgcttcttgaacttcgcgacctggccggccttctcggacaggcggacggtgccgccggtccacaccgggtgggtcttgatgtcgacgtcaagctgcagcgtgtcgccgggcttgccataggtcgaacgggtctggaaggtggtgccgtcggtcatcaccacggtgatctcgtggtaatccggatggatgccctgcttcatggcgatgcctcctcgcggaaaattcgaggctgcgacataccatggacagggcaacccgtccagccgaataacgccgggcctggcggaatcgcctcacttgttggtcagcttcagctcgatccggcggttgcggcgataggcctcctgggtctcggcggtatcgatcggatgaaactcgccatagccggccgccgacagccgccagggcggcacaccctgcgagatcaggaacttgaccaccgaaatcgcccgcgccgccgacagttcccagttggaggcgaaggcgggggtggagatcggccggatgtcggtatggccgtcgacctgcagcacccagttgatgtcttccggaatttcgccggcgatctggttgagcgcgtccgccagccgggcgagctgggcgcggcccgggccggtgacatcggcagagccgctgtcgaacagaacttccgactggaagacgaagcggtcgccgacgatctggatgtcgtcgcgcccgcccagcacttcgcgcagccggccgaagaattccgagcggtagcgggccagttcctcgaccttggcggcgagcgcctggttcagctgctggcccagatcggcgatggtcgcctgctgttcctcgctgcgcttgcggctttcgtccagcagcccggcaagccgggccagttcctggttcagccgctccagctgtgcggccatgtcggcgacccgggcctcggcggcatccgcgcgctgtttctgccggtcggcgcgatccagtgccgcatcgacgctggaggcctgggcctcgatcgccgatttcgcgtcggccagctggtcgccggcgctctgcagcgccagcgcgcgctgatccgccgtctgctcgcttgccaccagccgctcgtccaggatgcgcagccgttcttccagctccgccacccggtcgttcaggctgcgtttgtcgctctcggcgctttccagcgcggttgcgatccgcgcccgctcggcctcggtggcctgctgggtctgggctgcctcgttcagcgcctgttcaagggcggtgatccgctggtcggcctcggacacccgcgccgccaggctgtcgcgctcggcggtggaccgttcgaggtcgctggagacccggtcgagcgtggtgcgcaattcatccgcaccggccttttccaggttcagaagcgccgtgatctcgttgagctgccgcgtcaactggtccagcttctcctcgcggcccgacagggcctggctcagatagaactgggccagcatgaagaccacgagcaggaagatgatgaccagcagcagcgacgacaaagcgtcgacgaagccgggccagatgtcgctgccgccctgtttgcggcgataacggcgcatgagcgtcgatccttggaaggctggcggggcatcgggtgggatgccggcaggggctgacgaagagggcgcccggctcagcgccgggcgtcgtcctcggcggcaagggccgcgatggtgcgggcaagcaggcggacctcggaccggatgtcctccaccgcctgctgccggccctggggaatgtcttcgaccatccgcgagagcaggatgtcgacattgcgcagatgcgcgcggctggcctcgtcgaagccgtcatcgcggttctgggcatccaccagggcggaaagcaggggtttcagatccttctgctgttcggccatcttcaccagcacggtctgttcgacgcgcatctgatcggtgagggtggcgagccgttcggtcagggccttcaggttctcgtcgccctgacggcgggcctcttcagagcgctgcagggtgcgcttcagatccgacaggttctcggcggtctgttcgaccagcgccgccagataggccccggcaccgggcgccccctcgatctcgatcgcaccggcaccgccgccgagcttggtgaggcgcgagaaccattcctcgacctcgttgaagaaccggccctgagcctggccggcctgaaggtccaggaagcccagaaccagagagctggcaaggccgaagagcgaggacgagaaggccgtgcccatgccggcgagcggtgcctccagcccggccttcaggtcgtcgaacagccgcccgacatcgcccgtgccgaccgagaggtcgccgatcaccgcggcgacggaggtaatggtctggatcagcccccagaaggtgccgagcagaccgaggaagatcagcaggccgatgatgtagcggctgatttcgcggctttcatccagccgcgagcccaggctgtcgagcagcgagcggctggcgagcggcgacagcttcgcgtcctcgcgggtctgcgacatcatgccggcgatcggcgccagcaggtcgggggtgggcgttgccgccatgcccggccggttctggcggaagccctccagccaggcgacctcgccgttcagccgccagacattgcgcagcgtgtaggcgcagcccagcaccgcggtgccgatgatcagcgcgttcaggaccgggttggtcatgaacgcgtcgatcagggtgggtccgagcagggcggccacggccagcgccaggacgaggaagatgatcatccgcaccagatagcgctgggggcgggtcagggtgtcggtcgtcgggcgggccatgcggatcaacccttgctcttcgatcggtgtctggcatgcggccgggcgatgccgacctgcgggcaggggaatatgtggtgggggaacggcggcggccggcccggaacgccaacaccgctcatcccgccccccggatgtcgagatcgacccggtcggccgggccgtcggtggcggcgccgtgaaccttcaactcgatacgtgtcggcccgatcccggcgcccgacaggatctcgcgcaccgccagcgcccggtcgagcgccagccgccgggcggcatggggcggcgcatcggcggcggcggtcgcataggcatcgaccagcacgcgcgtccggtcgggcaggccgcgggcgaaatcttcgaccgcgcgccgcccggaggtcgggatgtcggcgctgccggtctcgaagggaatggaaaggggggcctgcgatacggcctgctgggccgccgcggtggtggccgttccggccgccagcggcagcagggcggccagaccggtcatgacggcgaccagtgtgcggcgggccacggtgcggcggatccggcggcagcggtgggcgggcgcgacacgaacgccccggccatggggccggggggtgctgcgctgccgggcggtggatgtcggcgtcgacgcgggcgtcatggcatcctgatggctgatcgcctgcggccgtcatgcggccgcacggcaggaccggccggtgcaccggggtgcgccgacccgtccaaccatagcccacccgccgaagcagcggcaagcccggcgggtatgactgcgccccgccgtcgcaggatcgccggtcttacgccttggccggcgcctcgcccgggcggcgcggccgcttggccagcatcgtgctcagcaccttgtgggtctggccgtggacggtggtattgccggcgatgatatggccgctggtcagcatgccgtcgccgccggtcaggtcgctgacgaaaccgcctgcctcgcggaccaggatcacgccggccgccatgtcccagggctgcaggtccagctcgaagaaggcatcgaagcggccggccgcgacataggcgaggtcgagcgccgccgagccgaagcggcggatgccgccggtgttcttcatcatgccggccagcatcttcaggtattcggtgtggttgggcttgtcggcgcgcggaatgccggtggcgaccacgcagtcgatcagctgccgccgggcagcgacgcggatgcggcggtcgttgacgaaggtgccatagcccttttcggccgagaacatctcgtcgcgcagcggatcataggtcacgccggcgatgatctcgccctcgcgttccagcgccacggttacggcgaaatgcgggatgccgtgcaggaagttgtgggtcccgtccagcggatcgatgatccagcgatgcgacgggccgtcgcccgagcccttcacctcgccgccttcctccatcaggaagccgaaatcggggcgggccttggcgagttcggcgcgcagcaccttctcggacttcaggtcggcgctggacacgaaatcggccggccccttgcgggacacctggaggttctcgacctcgccgaaatcgcggatcaggccgcgggcggccttctgggcggcaccgatcatgacattgaggatgggggaacggatggccatcggtggcaactcccgggcacgaggtcgtcggacgaacagaaagaacggggcagggggccgcgcgggcgccgtcgtccaaggacgaagcgcccccgccggcgtggaaccgcctgcgggggcgcatcatgcccgaacggggcgcgggacggaactgcggatgccgcaggtcagtccttcgcgcgctccagataggtctggtcggcggtcatcaccaccacgcgggtgccggtctcgatatgcggcggcaccatgatgcgcacgccgttctccagcagggccggcttgtaggacgctgcggcggtctggcccttcacggtcggctcggtctcggtgacctcgaggatgaccgactcaggcagttccaccgacagcggctcttcctcgtaggacgagacggtgacggtcatgccgtcctgcaggaagaccgcggcgtcgccggccagatcccggggcacgttgatctgctcgtaggtctcctgatccatcagggtgagcatgtcgccgtcggcgtagaggtactggtattccttctcgtccagccgcacgcgctccaccgcttccgaggcgcggaagcgctcgttcagcttggtgccggtgcggatgtccttcagctccacctgcagatacgcaccacccttgccgggctgggtgtgcatggtgcgacgggcgacccagagccggttctgatgctcgatgatcatgcccgggcggatggcgttgccgttgatcttcatggcctgcggtccttcgtttccggccccgctcagccgccggacaggctgccggggcggggggctcgggacgggtcttcgggatggcgctggtcgaacgggggcgatgataaggggcgccgccatcccgtgaaatcgccgccgccccgggtctcgggggctgacggaacgccgcgggtccgcgcggccgctgccgcggagaggaaccctcgggccgtcagccccggtcggggacggggccttcgtcttcgagggcccgcgcaatctcgcggttgaagtcggcgaccgcctgggcggggccggcctcgtaattccacaccccggcggtgaccgccaggaaatcggcaccggcacggaccaggggcgcgcagttcgcaaccgtgatgccgccgatggcgacgcagggcacttccatcagctcctgccaccagtccagcagatccagcccggcggtcgccggcggcgtcttggtggtggaggggaagaaggcgccgaaggcgacgtaatccgccccctcttcggccgcgaccatggcgcggtgccgcgaggcataggcggaaatacccaggatggcgttgggccccaggatcttgcgggccttggcctgatccatgtcgtcctgaccgatatgggcgccgtcggcccccatttcggcggcgatgtcgggccggtcgttgaccagcacggcgacaccgcgcggctgggccaccggcagcagccgctccaccgcgcgccggacgtcgtcgtcggccgcatccttcagacggatctgcaggcaggcgacgtcaccgccgtcgagcgcgcgggcaagcgtatccgcgaacgccgccggcacgaaggccggcggcgtcagcagatagaggcggcaatcgcgggacgcgctcacgccttgccctgatagatcttgatgatctggtcgagcagggcgagggcctcctcacgcgggcgctggaaggtgttgcggccgatgatcgagccgttggcaccaccgtcgcgcagctgccggatctcgtccatcagctcgtcggtgcccttggcgttaccgcccgagaacaccacgatgcggcggccggcgaacgaggcctgcatgacgtgcgagatgcgctccgccagcgtcgagcgggcgatgtcgaacttctcgtagaccttcttggcctcgtcctgctccagatcggcggtcggcggcttcaccttgatgatgttcgcgccgagcagggccgcatgatgggcggcgtaggcgcagacgtcgagggcggtctcgcccttcttcgacagcatgccgccgcgcggatacgaccagacgaccacggcgacgcccttcgacttcgcctcgagggtcagctcgcgcagctcctcgatcatctcgaactggtattccgagcccggatagatggtgaagccgatggctgcgcagccgagacgcagggcgtcgtcgacggtcgcggtcacggcctggtccttctcggtcgccaggctgttggagctgttgaccttcaggatggtcgggatcgcaccggcaaaggtgtcggcaccggcttccagcatgccgagcggcgcggcataggccgacaggccggcatcgatcgccagctggtagtggtagtgggggtcgtaggccggcggattcggggcgaagctgcgcgcgggaccgtgctcgaagccctggtcgaccggcaggatgaccagacggccggtgccgcccagacggccttccatcaggatgcgggcgaggttcgccttcacacccgggttctcgccttcgtaattggcgaggatccgcttcacgcgctgagtgatcttcatccggtcgtcgttccctggctgatgcgccggtggccgtcgggacggccacctttgctgtaaactcctggtccggcgctgaaaagcagtaccggccgcggggtatgcccgtccgatgcgccttgtaaccgagacgtgcgtgatttgcaatcacccgaccacggtggggggcgcgacaacttcgtgtcagcggcctcgacagggcgtctcagagagggtctcggggcgttcgtaccctggtttcgggggcggcggcggcgcagagcgtcgtgaacaccgccggtgaggtctcgatcaccggatcggccagccccgaggccgccagcatatgggcgcgtgcggcatcgctgccgcagtcgaccaccagccggcaaccggcggtttcagggcgcgcggccagcgccgcggccagttcccggatccagccgatcccgcctgcggccatcaggccgggcggggtggtcaccacggcgggcaccgcccgtcgcccgtccctgatcgcatcggcgagggcagtgatgtcggcgagggccgccaccgccgccacgcgatcatccccgcctgcaccgaccgtcatcggtcaacgggaaagcgctgccacgccgggcagttccttgccctcgcaatattcgaggaaggcgccgccggcggtggagacataggtgagcgcgtcgaccaccccggcatgggcgagcgccgcgaccgtatcgccgccgcctgcgatcgaggccagcgtgccgccgctggtcagcttttcgaccgccttcgcgaccgccaccgtcgcggcgtcgaagggctggatctcgaaggcgccgaaggggccgttccagagcagggtcttcgagccggcgaggcaggcttcgatctcggcgacggtcttggggcccacatccaggatcatctcgtcggccgccacctcggccacatcgacggtgcggttgtcggccccggccttgaactcgcgcgccaccacggcatccaccggcagcacgaccttgcagccggcggcctcggccttggccaggatgccacgcgcggtctcggccaggtccgcctcgcagagcgacttgccgaccgcgatgccctgggcatgcaggaaggtgttggccatgccgccgccgatgatcaccgcatcgacccgcgcgaccagattgttgagcagatcgatcttggtcgagaccttggcgccgccgacgatcgcggccaccgggcgctgcggctcggcaagggccgcgcccagcgcctcaagctccgcctgcatcgacaggccggcggcggtgggcagacgctcggccagacccacggtcgaggcatgggcgcgatgggcgcaggagaaggcgtcggagatgaacacctggcccaggctcgccagcgcatcggcgaaaccggcctcgttcttctcttccccggcatggaagcgcaggttttcgagcagcgccacctcgccatcgccaagtcggcccaccacggccgcggcggtgtcgccgatgcaatcctcggcgaaggccaccggacggccgatcgcggcggcgagcggggccgccaccggcttcagcgacatcgacggcacgaccttgcccttgggccggtcgaaatgcgagagaaccaccacccgggcgccgcgttcggccagcgcgcgcaccgtcggggcctggcgctcgatgcgggtcgcgtcggtgacgacaccgtccttcatcggcacgttcaggtccaggcggacaaggacgaccttgccggcgacgtcgatctggtcgagggtcttgaagctggcgggcatgggggagcgttccgttctcgcgagggaagggccgtatgagaggcgatctgacgacgatctaaagaaacgggccccgcgcatcgctgcgcggggcccgcatcggacaagatcagagcttgccgagcgccacggccgtatcggccatgcggttcgagaagccccactcgttgtcataccacgacagaacacgcaccagcgtgccgtcgatcaccgcggtctgggtggtgtcgaagctcgacgaatgcgggtcgtggttgaagtcgatcgacaccagcggttcgctgaccacgcccagaacgcccttcatcgggccctcggcggcggcgcgcatcgcggcattgacctcgtcgaccgaggtcgcgcgcttggcgacgacggtcaggtcgatcatcgacacgttcggggtcggcacgcgcacggcgacgccgtccagcttgcccttcagttcaggcagcaccaggccgaccgcacgggcggcaccggtcgaagtcgggatgatcgactgcgcggcggcacgggcgcggcgcagatccttgtgggccacgtccagaaccggctggtcgccggtataggcgtggaccgtggtcatgtagccatgctcgatgccgatggtgtcgttcagcaccttggcgaccggggccaggcagttggtggtgcaggacgcgttcgacaccacggtgtgctcaggcgtaagcccggcctcgttcacgccgaacaccacggtgtaatcggcattgtccgccggggccgagaccagcaccttgcgggcgccggcttccaggtgcttggcggcggcatcacgcttggtgaagatgccggtgcactccagcgccacgtcgaccttcagctcgccccagggcagcttggccgggtcgcgttccgaagtcaccttgatcgggccggtgccgacgtcgatggtgtcgccctcgaccttgacctcgccgttgaaacggccatggaccgagtcgtacttgaacagatgggcgttggtctcggcaggcgcgagatcgttgatcccgacgacctggatgtcggtccggcccgactcgacgatcgcacgcagaacgccacggccgatgcggccgaagccgttgatcgccacccgaatggtcatgccttcctccgaactgtcttcgacgttgggaagccgaccgccatggcggctcccctggggggttgttacggtcgctgcggcaccgcgggccggccagcccctgaacggggggccggacccggatccatgatcagacgcgcgcgagtgctgcgtcgaccacagcctcggcggtgatgccgaagtgacggtagagttcgggcgccggcgcgctggcaccgaagccggtcatgccgatcacggcacccttggggccggtccagcgttcccagccgaagccgatgccggcctcgatcgcgatgcggacgacgtcgccgcccagcacccgggcctgataatcggccggctgggctgcgaacagctcccagcagggcatcgagaccacgcgggtcggcacgcctttggcttccagtacctcggccgcggcgaccgcgatctcgacttccgaaccggtggcgagcagcacggccttaggggcggccgatgcttcgcgcaggatataggcacccttggccgaaaggttctcggccgatgcctcgaggcgcagctgcttcaggttctggcggctgagcgccagcaccgacgggccgttggtccgctccagcgccgccgcccagcattccgccgtctcaaccacgtcggccggacgcatcaccgccacattcggcatcatgcgcaggctcatcagatgctcgaccggctgatgggtcgggccgtcctcacccaggccgatcgagtcgtgggtcatgacatagatgacccgctgctccatcagtgccgacagacggatagccggccggcaataatcggtgaagaccaggaaggttccgccataggggatcacgccgccatgcagcgccatgccgttcatggcggcggccatgccgtgctcgcggatgccccagaagacatagcggccgtcgaactcgcccggcgccaccggcttcatgcccttggtgcgggtgttgttcgatccggtgaggtcggcggagccgccgatcagctcaggaatggccggcaccagaacttccagcgccatttccgacgccttgcgggtggcgacggtcttgggcgaggcgatcaggccggcgatgtagtcgtcgagtgcctgcttccagcccgccggcagttcgcccgccatggcgcgggtgaagtcggcctgcacctctgcgtcgagcgcacccagacgcttctcccaggcttcccgttcggcggcgccgcgggcgccggcatgggcccaggcggtgcggatatcggccgggatctcgaagggcgcatgcggccaggccagcgcctcgcgggtgccggcgatctcttcggcgcccagcgccgcgccatgcacgcccgaggtgccggccttcttcggcgcgccatagccgatgaccgtgcggcaggcgatcatcaccggcttgtcggagctgcgtgcccggtcgagggcagcggcgacggcctcggcatcatggccgtcgaccgcatcggtcgcccagccggcggcctcgaagcgcgcccgctggtcttccgagctggacagcgagaccgggccgtcgatcgagatgccgttgtcatcccagagcacgatcagcttcgagagcttcagatggccggcgagcgagatcgcctcctggctgatgccctccatcaggcagccgtcaccggcgatgacataggtgtagtggtcgaccaccgacccgccgaagcgggcggcgagcagacgctcggccagtgccataccgaccgcattggcgataccctggccgagcgggccggtggtggtctcgatccccgaggcatggccgtattcggggtggccggcggtgcgggcgcccagctggcggaagttcttcacctcgtccagcgtcatgtcctcgtagccggtcagatgcagcagggcatagagcagcatcgagccgtggccggccgagagcacgaaacggtcgcgatcggcccatttcggggccttgggatcgaacttcaggaaacgggtgaacagcacggtggctgcgtcggccatgcccatcggcatgcccggatggccggaattcgcacgctcgacggcgtccatggcaagggcgcgcacggcattggccatgtcacgcggcgtggcggtcgaggtggcatcggtcgtctgagcggtcatgggccttcacgcaagcgttcgaagaggggcagcggccggcgcagggccgacaaggagcgccacgggcaaagcgggcctgcggtgcgcgcgggcaattgcacgcctcagcgaccgcgtcaaccacctttaacgagtgccgtgcggcgcaaagatggcggggtgtcatctctccgtcaaccgcctatttccgcagcgccttcccgttgcgggccaagggtcgccgcatccgggcccggcaggggccgcctgcggggcgccccggcatgactggttcaccctggtgcgtgaacagcaccaaactgcatcaggttgcagccaacagcggaatcctgcgctgcgcggggtctctctaccatgacgctcatccaaaacgggccggattacggccgtggggcaggagggagacgatggcgtttctgacggcgttcttcggagcgatcgacaatctgacctggggatgggcgctgatcccgatcctggtcgtgttcggcgtgttcctgacgatcatgtcgggcttcgtgcagttcgtgtttttccggcggatgttccgggtgctgggacgcggcgccaacaatgccgatccgaacgcgatctcggcgcgggaggcgctgctggtctcggtgggtgggcgtgtcgggggcggcaacatcgccggtgtcgcggtggccatcacgctcggtggcccgggtgcggtgttctggatgtgggcgatcgcgctctgcggcatggcgaccagcctgatcgaatgcacgctcgcccagctctataagacccgcgacggcgagggcgggttccggggcgggccggcctattacatccgccgcggtctcggcgggcgctacaactggctggccatcgtctatggcatctgcctgatggcctcgttcggcttcggcttcaatgcattccagggcaacaccatggccggcgccctgcatgacagcttcggcatcgatcgcctgtggtcgggcatcgtcatcgtcgccgtcaccgcgctggtcatcttcggcggcatcaagcgcatcgcccgggcggcggatgtggtggtgccggtcatggcgctcggctatatcgcggtcgccattctggtcatcggcctcaacatcgccgatgtgcccgacatgctggtgcggatcgtccgctcggccttcggcttcgatcaggcggtggccggcggcatgggcgcggccatcgcccagggcctgcgccggggtctgttctccaatgaagcgggcctgggctcggcgccgaatgtggccgccaccgcgctggtccgccatccggtcagccagggcatcacccagtcgctgtcggtcttcatcgacaccatgctgatctgcacctgcacggcgctgatcatccttttgggcgacgtctatgttccgggtgcccagggcatcgacggcgtggcgctgacccagcagtcgctggccagccatctgggcgatgccgcgcgctatctgctgacgctcgccatcctgctcttcgccttctcgtcgatcatctacaactactatctgggcgaaaacggcctggcggtgatgacccggtcgaagccggccgttctggcgctgcgcctcgccatcctggcgatggtcttcctgggcgccgccgccccgcaggccacctcggtgttcttcttctcggacccgatgatgggcctgctcgccctggtcaatctgatcgcgatcatcatgctcttccccgtggcgatgcgggtgatcgacgactaccgcacccagctgaaggccggcgtcgcccgcccggtgctcgatcccgcgcgcttccccgatctcgacatcgatcgcaaggcctgggatccgacggtctggaagtaacccggacccgactgccggggccgttctttccgggcggccccggtccacccccgcacatcacagcctggatcagaccgatgcaccacaccatgcgcatcgaagaggacggccttggccgcatgcctctgcccgaggattgcctctggggcatccacaccgcccgggccatcgccaatttcccgatcaccggcatcccgctgtcgctgtttccggaattcgtccgggcgctggcctgggtgaagatggcggcggcccgcgccaatctggcgctgggcgtgcttgcgcccgaaaagcacgacgtgatcgtggcggtcgcggccgaaatcatcgagggccgccatctggagcatttccgggtcgacatgatccagggcggtgccggcacctcgaccaacatgaacgtcaacgaggtgatcgccaatctgggcctgatccgcatgggccatcggccgggcgattacgaccatctgcatccgaatgacgacgtcaaccgctcgcagtcgaccaacgacgtctatccgacggcgctgaggctggcgatcgtcgaccagtgcgccgccttccgcgacgcccagctgcggctctgtgccgccttcgacgatcgcgcggcggcctttgcccatatccgcaagatcggccgcacccagcttcaggatgccgtgccgatgacactgggccaggaattcgccggcttcgccgccacgatccgcgaggacatcgcgatcatcgcccggttgtcggagctgctgctggaggtcaatctgggcggcaccgccatcggcacccgggtcaacacacccgacggttatgccgagcgcgcgatcgccgaactggccctggtctcggggctgaaggtgacgctcgccggcgatctggtcgaggcgtcgtcggacaccggcgcctatgtcaccttctcgggcgtgctcaaacggatcgcggtcaagctgtccaagatctgcaacgatctgcgcctgctgtcctcgggcccgcgatccggcttcaacgagatccggctgccggcgatgcaggccggcagttcgatcatgccgggcaaggtcaatccggtgatccccgaagtcgtcaaccaggtcgcctttcaggtgatcggcaacgacctgaccgtcaccatggccgcagaggcggggcagttgcagctcaacgccttcgagccggtcatcatcctcaacctgcttcagtccatgcgcatgctgatcagggccatggatacgctggccacgcgctgtgtggtcggcatcgaggcgaatgtcgcccaatgcgagggggcattggagaactcgctggtgctggccacgatgctcgtcccccatatcggctacacacgggccgcccgggtggcgaagacggcgctggcagacggggcaggggttgccgagaccgctcagcggctggggttcggcagtcatgaggagatcgctgcctggcttcgctgacgcggagccggcgcggcgacggatcgggggagattcggggggaggctcccccgatttcgttgtgcgggggctggggtcaggcgagccagagacggatcagggcggcttccggggtctcggtgccgccgttctctaccccgcaggaccagagaccggcgccggcggcatagctgccggggatcagtccgccctgttcgcactggctgaccgcgcggatgcgcttgccggcccgcacggcctcggacagggcggacagaacctcgggatcggccatcgccgtgcccgagccgaagaccctgagcaccgcgccgtccagttccgccagagaggcccgcagcatggcggccggcatgccgggcgagagggagaggaccgccagccgccggtcgccgaaccgccggcggcggggcgggcaggcgggggcctgggggatggcgcggaagctgtcggcgccctgcgaatcgtgtttgaccagcccttccgccggcatcagacggccggcgaaggccagcatcaccgcctcgccggggcggagggcggcatcgatcgccagatcgagattgtcttccgcatcgccgccgcggctgagcggctgcatggcgccgcaaagcacgacatggcggccaaggcctgccagcgcctgcgacagcgccgcaccggtgaaggccatggtgtcggtgccgtgggtgacgatcaccggcgtgcccggctggtcgtcgatcaggtcgagcatccggttccagtgcgccgggccgacatcggcgctgtcgagcaacggtgtgaagaccttcgtggtcagccggatgcccttgggcaggcgcccctcgaccgcggcttcgaccagcccgtcgacggggccgaggccatggggcgtgtcgcccatgccgatggtgccgccggtgtggatgagcagcaggcgcatcaggccgccttcatgccggcatgacccagcgccagcgccgccagacgggcggcgacggcatcggtcacgtcgatcagccgccgcccggcgacgggccgcgcgatcagcggcagttcggtgcaggcgagcaggatggtatcggcctccatctgtatgatgatctcctcaagccgcgggccaagcgacgcatgggcgccgcccagccgcttcacgtcgtggatgagcgtctgcagccggtcgggatcggccggggtttcgatcgcaacctgagccgccaggccagcataggcggagtggtcgtccagcgccacgaccggggccgcacccagcagcccgacccggccggcaccgctctgtcggatttcgtcgtgcagcacgccctggaaggagaccagctgcccggcgcccggcatgccggccagcagcgcgtcgatgcggggggcataccagttcagcgtgttgcaggcgatggcgaaggcatcgacccgggtggcgatctcgcgcaccgtccgctccatcgccgcccagaccgccgcctcgttcgccttcagatccatcgacaggccgagggcgggttctgacaccgccaccagccgcggcgcgtccagatctccgcggaagccgggccccatcagggcctgggtatggcgcaggatcttggcccagagatcgagcccggcttcgggacccgagccggtgatgatgccgagcgtataggcccgggagggatgggggcgcggtgtcatggcgtgggggtctttcccgcgaagatggcccaaaggcctggtccgaaggcatggtccgaagacgcagaagctgccatggaatggtgtcggcgggggcacggcttgacaatgcggcactcggtgctcaatctgatgcagatttatgctgttacggcaccgaagagcgcaaatgaccgagattgccgagaatcttcgcctgctctgctcgtaccggccgtcgatctctcaggtcggacgggatctcggcatcaaccgcagccagctcaaccgctatctggccggcagttccacgccgcggccggccttgctgcgcaagatctgtgactatttcggtgtcgagccctacgagatgatgctgccgccgcgcgatttcgccgagatcgtccgggtgcgcggtctggacgagggcaccaccaaccgtcggctgcgccagcatttcgaccgggtgatggcgctgggcgatgcccgggtgcgcaatctgaccggcatgttcttcgaatattactattcgatgtcgcagaaggggaaggtcatccgcgggttgatcgtgttctcggtcgaagacgggcgaaccttctaccggcgtctggaacgcatggggccgcacgaccggcccggccggcggcattaccgctatcagggggcggcgctggtcgctggggaccgggtgttcatgtccgattatgaatacggtgccgggatcgagttgacccagacggtgctttatccggattacgcgctccgctggacccggctgcatggggtgaagctgggcgtctcggccgatcaggcgcatatgccgtgttccgtccgggtctatctggagcggattccggcgcggctgtcgctgaccggcgcgctcagggcctgcggcctgttcgaccccggccatcccgaaatcccgtcccatgtgcccgagatgatcgacaacagcacctccggcccctatgccttcgacgcctatgcgcggcggtgagccgcaccgcagtgcggcatcgccccggcatcacgcattgacgcagggggcgcaggctccctatgttggcggggcgccgtcgaggtggggacaacccgcccgatccgaaggtgcgcgcccccgggcggccggtgacggtcttcgggggatgtcggctcagctcgtcagtcccggcctgccggatgggaaacgccggatgggaaacgaatgtgtcccgtaccgggcggtcatcgcgttccggcccggtgccgggccgtgctattctgacgaggttctcccggcttgggccgtgccgacgaacaagcgcaacctcctgtcttcatggtggccggatctatggcgaatatggaaatggcgtggcagaggctgtcgagcgcgctgacgcggctggatgccgcaagccgcaaggcggccgagcgggtgacccaggcacgggccgcgggcgaggcggcggcctctggcgcggccgatgtccggatcgacgcgctcaggtccgaaatcgagagcctggcggccgagcgggaccggctgaaggccgcgctcaccacggccgaagaggcccgcctgcgcgccgatgatcgcggccgccgggccggcgagcagatcgaccgggccatggatgccatcgggcgtgcgcttgatgaccgctgagccgaaccggatcggagacgagaaagccatggccgaagtcgaggtacgcatcctgggccgggcgttcacgctcgcctgcggcgagggacaggaggaaagcgtccgcaccctggcccggaaggtcgaggagcgggtgcagcaggcggccagcggccgcagcgtggcggtggatgcccgcgtgatgctgatggcggcgatcctgctggcggaacaggctaacgaggccgagcaggggctctaccgggcgcgtgtggaggtggaaaagatccgccgcaccgccgaccgctccgccgctgatgtcgatgcgacgctcgcccgggcgctggatgatttcgcggcgcgcatcgagactattgcaacccggctcgagaaactctaaatctcggggcaggacgggctctggcctttcggtgaggcaacctaaatcccagggaccgataccatctacatgagggagctgtccctccccgtgcgcgcggatagggcaccggccggttcgtccggaccggtacgcccggaccaagccacggggatcacggcgcccacctgcacacgcgggtccatgtggattttcaccgccaaccttcgtgccggtccccgtccgccagttttcgcacgaccccggccgcgtcttcgcggccggggcgtcgccgtttgcggccggcccggccgcttgccgccaaacccttacggccggccccatcccggcccgccttcggagcgccgtcgctgaccattccgctgcaggatcccgggctgccagacccggcacttgatgtccgcaaggccgccatgcgccgcgacttccggcgcctgcgccgtgcggctgcggcggccggtggtgccgatgccgcagccgctctggccgcggaggcgggtgctctggcgacccggctgccccggccgccgcagcacatcgcgggttatgtggcggcgggcggcgagatcgatgtgctgccgctgctggtggcccttggcgccgcaaccggcgccgggctctgtctgccggtggtgacggcgcccgatacggccctcgatttccgggtctggcagcctgacgcgccgctggtcgcgggtgccttcggcatcctgatgcccgaggaggcagcggggcgttgcctgcccgacctgctgctgatgccgttggtcgcggtcgatcgggccgggcgccggctggggcaggggggcggcttctacgaccgcacgctggcggcggccgatgcggccgggcagatgccgctcacgatcggcgtgtgctttgcagtccagctgacggacgaggtgccggccgggccgctcgaccggccgctggacctgatcctgaccgaacggggtctgctggtcccggtcaggtgagccgaaaaatcgctgggcgcggccacggctgcgcctcatatccaacagtggcgacacggcgaggcccgtgccgctcttgtccagacgcggcagagacgaaaggtcgaacggtgcggatactctttcttggtgacgtggtcggacggtccggccggcaggcggtgatcgatcatgcgtcgaccatccggtcggccctcggtgtcgacctgttgatcgtcaacggagagaatgccgcctcgggcttcggcatcacgcccaagatctgcgagagcttctatgccgccggcgtcgacatcctgaccaccggcaatcacatctgggaccagcgcgagatcctgggctggatcgatcaggaccagcggctggtgcggccgatcaacttccccccggcacccccggccgcggcgccaccatggcgaccctgcccgacggccgccgcgtggtggtgatcaacgtcatgtgcagcctgttcatggaatcgctcgacgatccgttccgggcgctggcgccggtgctgcgcgactatccgctgggcggtctggtctcgggcattttcgtcgatctgcatggcgaggcgaccagcgagaagatggcctatggccatttcctcgacggtcaggtgacggccgtggtcggcacccatacccatgtgcccaccgccgaccatcaggtcctgcccggcggcacggcgttccagtgcgatgccggcatgtgcggcgactatgacagcgtcatcggcatggacaagaacgcctcgctcgaccgcttcacccgcaagatgcgcggccagaagctgctgccggccaatggccccgccacaatctgcggcacgctgatcgagaccgatgatgcgaccggccttgcgaagtcgatcgcgccgctgcgcgtgggcggacggctcagcccggcctggcccggcgccgagccgatgcccgaaagcctgctgcagctgcatctgccccaggggcaggccgagacggtcggctgaggcgccggacgttcatgatttcgtctccggggatgcatccggcggcgagttctgttatcgaagcgtccggaagcacgggatggccgagcgccacctgtgtcagagatttcggctcttgagggttggcggcagagatggctggtcattcacagtttaagaacatcatgcaccgcaaggccgcgcaggataagaagcgcgccaaggtgtttacgaagctgctccgcgaactggtgatcgccgccaaggaaggcggcgccgatccgaccgccaatccgcggctgcgcagtgccgtggcggcagcccgcgtcgccaacatgcccaaggacaacatcgaacgcgcgatcaagcgcggcgccggtggtgccgatggcgacaattacgaagaggtgcggtacgagggctatggcccgggtggcgtggcgctgatcgtcgaggcgctgaccgacaaccgcaaccgcaccgcgtcggaagtgcggtcggccttcagcaagcatggcgggtcgctgggcgagaccaattcggtggcgttcaacttcaaccgcgtcggccgcatcacctatccgctcgcggtcgcagacggcgaggcgatgctggaagccgcgatcgaggccggcgccgacgatctggagagtgacgacgaaacccatgtcgtctacacccagcccgacgcgctgcaggaagtgcgcaccgcgctcgaaggcaattacggcgatccgcaggagttcaagctcggctgggtgccgctcagcaccatcgcgatcgacgaggaacaggctcagacgctgttcaagctgatcgaggtgctggaagacaatgacgacgtccaggaggtcatcgcgaatttcgaggtctccgacgaggtgatggcgaagctgaacggctgagccggacaagctgaacctgggtggggcggccgcctggcatgcgcatcatcggcatcgatccggggctccggatcaccggctggggcatcatcgataccgagggctccaggctgacccatgtcggccatggcgtggtgacctcggacgacaaggccgccctgtccgaccggctgcgcacgctctatgacggcctctacgaggtggtggagcgctaccagccggcaggggcagccgtcgaacagaccttcgtcaacgccaatgcgatgtcggcgctgaagctgggccatgcccgggcggtggcgctgctggtgccggcccagtcggggctggtggtggcggaatacgagccgagcctggtgaagaaggcgctgaccggcagcggccgggccgacaaggcccaggtcgccgccatggtcgcccgcctgctgccgggcatcgaccgcgatgcgcgcgccgatgcctatgacgcactcgccgtcgcgatctgtcacgcgcatcatgggggcacgcgggccggctggacggcccgggcccgctgaagggcggcccaacaggggagaccacacccggcatgttcgcgcggctcaagggcatcgtcgacgagatcggtgccgatcatgcggtgatcgacgtccatggcgtcggctatctggtgcaggcgtcgcgccgcaccctcggcgcactgggcggaaccggtgccgccgccacgctgcacgtggaaacccatgtgcgcgagaacgacattcatctctatggcttcatcgaccgggcagagcgcgactggttccgcctgctggtgacggtgcagggtgtcggcgccaaggtggcgctggcggtgctctcggtgctggatccgtcggccctggcggcggcgatcgcggcccaggacgcccgcgccccggcccgggccaccggcgtcggccccaagctcgccaaacgcatcgtgatggagctgaaagacaaggcggcgctggtcggcatcggtgccgccgatgtcgccgtgctggcgaagtcgatcaaaacgcccgaggccgccgctgcggtcagcaagccgcccgaggtcgcggccttcgatgatgccctctcggccctggtcaatctgggctatcgcgaggcagaggcggagccggcgctgcgccgggtggccgaggccgcgggcgaggcggcgggtgacgtgcaggtcctgctccgcggcgcgctcaaggagctggcgcgatgagcagcggcgacgagcgtctggtccagcccgcggcgctggccgaggatcggcaggatccggcgctgcgcccggaacggctggcggatttcgtgggccagcgccaggtgctgggcaatctggcggtgttcatcgccgccgcccgcgcgcgtggcgatgcgctcgaccatgtgctgctgcacgggcccccgggtctgggcaagaccacgctggcgcagatcgtggccaaggagctgggggtggggtttcgcgcgacctccggaccggtcatcgcgcgcgcgggcgacctggccgcgatcctcaccaacctcaacgaacacgacgtgctgttcatcgacgagatccaccgcctgaacccggcggtggaagagatcctttatccggcgatggaggattttcagctcgacctggtgatcggcgaggggccgtcggcgcgctcggtgcggatcgatctgccgcgcttcactctggtcgcggccaccacccgcgccgggctggtcacccggccgctgcgtgaacgcttcggcattccgctcaggctgaactattacgagatcgacgaactggcctcgatcgtccggcgcggcggtcgcctgctcggcgcgccgctcaccgaagagggggcgatggagatcgcccggcggtcgcgcggcacgccgcgtgtcgccggccggctgctccgccgggtgcgcgatttcgccgccgtggccgaggcggccgcgatcgatgccggggtcgccgaccgggcgctgaaccggctggaggtcgacgcccgcgggctcgatgccatggaccggcgctatctgggctgcatcgcccgccactatggcggcgggcctgtgggtgtggagaccctggcggcggcgctgtcggaaagccgcgatgcgatcgaggatgtgatcgaacccttcctgatccagcagggcttcctggcccgcacaccccgcggccgggtgctgacccgcggcggctggcagcatctggggctgatgccgccggcccgcgacggcgaggccgatctgttcgccggtgccgatatcgaccccgaccccgaagcctgaacggtcccaccctcggggcatcttgcgctgcggtagtgtcattccgcataatgcggcgcgcaggttgcatttcgcgagtcgcgaactttctggaggatccccatggacaccacgcccgccaccgtgcagcccgatgtcatccgggtgcgggtctattgggaagacaccgacgccgccgggatcgtctattacgccaattatctgaagttcatggagcgtggccgcaccgaatggctgcgccgccgcggcatcgaccagcggccgctgcttgagaatgacggcttcggctttgcggtgcgcgaggtggcgctggattaccaggctccggcacggcttgaggatctgctgaccgtctcgaccgtcgtcaccgggcggggcgcggcctgggttgagttcgagcaggtggtggcgcgcggcgatcaggtgctggtgcgtggccggatcaaatgcgtggcgctgaatccggcgagcggccagccgcggcgcctgcccaaggcgctgatcgcccttgccgatgccggggccgtcccgcgctgagcgggacggccccggcaggtcttcttcggggatccgatccggtcagtcgaagttcggccaggggcgctgctcgtcgcgcatgccctcccaggcggccgccacgcgcagtacgcccagatcgtcgaagcgccggccgacgatctgcaggccgatcggcaggcccttggcgtcgtagccgcaattgaccgagatcgccggctgttccgacatgttccagacgacggtgtagccgatatgctcgaacggccgctcgggatcgtccagcggcgaggcctggtcggcggggtaggtgacggtgggggccaccggcgacagcacgaaatcgtagccgccgccatggaacagccggccagcggccttgcgcatctcgaaaatgcggttcaggccgcgcaccgcctgcagggccgaccgggtctggccgctttcggcccaggcgcggatatagggcaggatcttcgcgcgggtcgcctcgggcaggcgctcgacgtcatcccaggcgcggacccgccagaaatcgtccagtccgtcgagcatctcgcgggtcagaaccgccggcacctcttccaccacggcgccggccgcttcgaagcgccgggcggcttcctgcaccgcagccagcacttccgcgttcggcgccatgccggcgccgatgtcgagcatcaggccgatgcggagcccgcggatctgaagcccgtccagatccatccagtcgatatcggccggcggcagggcgctgccgtcgcgccagtcggccttcgacagtaccgacatggcgagcgcggtatcggcgacggtgcgggtcatcggcccgaccacccggcccagataggccggatcgaccggcacccggccattggtccccttcatgccgacgataccgcaccagctggccggcaggcggatcgagccgccgatatcggtccccagatggatcgggccatagccggccgcggcggcactccccgcaccggccgaggagccgccgggattggtgttgaggtcccaggggttgcgcgccagcttgtgaaagctggaaagcccggatgagagcatgccgtaatcgggcatggtggtcttcgccaggatcacgctgccggcctcgcgcagccgggcggcggcgggggcgtcggcggcggccggggtcatgtccgatgcggcggtgccgacggggacggggcagcccttggttgcaatgttttccttgatcgtgaccggcacgccgtcgagcgggcccagcgcctcacccttcttccagcggctggtggcctcggcggcggcggtgcgcgcggcttccgggtcgaaggcccaggtcgcgttgagcttcggctcccacgcctcgatccgcgcgatgacggcttcggtcacctcggtgggcgaggtgtccccggcggcatagagccgccccagctcaacggcggacagatcggcgagcgacgtcatgggtacaggtgcctttcgtatgtacaggccgaaggcggggagggcaggggggcccggcctggatctgccggtttcgtcctgcagaggcaggcatcgggcggcgggaaatgccgggccggctgcccggtccgtgtgccttcggatcggaccggcccgattatggcgtccggcgcagggcagggtccaggcaaatgcattggcatgttgtgaatttcctctcgtaaatctttgtataatattgagaatattgcagtgcggcacgggcctcgatcggggatctgttgcgccgcgatgacattcgccacaacgaccgtatcgccgcctcacatggccccttcacaagtcacgcgggttggcatatctcgtggccggctcacggccggggatgatgtgtccgcacctcgtccgactgtcggagcttcggccgggcatcccgtgtcaaattcgtgaaacggcagcggtttcggccgaactctggtaatcaaacgggtcgatgaatgaggacggggcagcttcccgggcaatgccggggcccgtccgatccacggaggacgtgaatggagcaggaggtcgtgagccaggcggcgctcgccggatcggtggcagcgcacgatatgagcatcttcagcctggttatgaacgccgacatcatcgtgaaggcggtgatgctcatgctcgtcctggcctccgtctggtcctgggcgatcattttcgacaagttccggctgatgggccggctgaagcgccgcgccgacgatttcgagaaccggttctggtcggggggctcgctcgaagaactctacgacgccatttccgaacgggccgaccatcccatggcccaggtcttcgccgcggcaatgggcgaatggcggcgcgccaaggccaagggcacggcgctgaccgatgccacctcgcgggccaatctgcggcagcggatccagcaggtgatggagatcgcgctcaaccgcgaaatggcggggcttgaacgcaatctgggcttcctggcgacggtcggctccacggcgcccttcgtcggcctgttcggtaccgtctggggcatcatgaacagcttcacctcgatcgcgatgaccaagaacaccacgcttgccgtggtggcgccgggtatcgccgaggcgctgttcgcgaccgcgatcggccttgtcgccgcgatcccggcggtcatcttctacaacaagctgtcgagcgatgtcggccgctacggggcccggctcgagaatttcacgggcgagttcggtgcgctgatcgcccgccagatcgaagacaggcgctgacccatggccggtggcatccgaccttccaacgggcatggccgccgccggcgctggggcggcggtcagccgatgagcgagatcaacgtgacgccgctggtcgacgtcatgctggtgctgctgatcatcttcatggtgaccgcgccgctgctgacggcgggcgtcgaggtcgacctgccggaaagctcggcggcaccgctcgccggccaggacgaaccgctttcggtgtcggttgatgcagaggggcgggtcttcgttcaggacaaggaagtgacgctggaacagctgccggcgacgctgatggccgtggcgaagaacaagaccgacacccggatcttcgtgcgcggcgaccgcagcgtcgattacggccgggtgatgcaggcaatgggggccgtgaccggcgccggcttcaccaaggtctcgctggtcaccaccctgcagcagggcacgcccgcccggcgttgacggccccgcgcctgcgggaacctttcggccccgcgccggttgataccggccgggatcgtggctgcgggggagggtgttccccccggccggcattccatggagcttcggacctcaggtgaagcgcggtctgacatattcgctggcagcacatggcgccgtcgcggcgctgctgtggttcggcctgccgtcgctcagccgacccttgccgccggaggaacagacgatcgtgatcgacgtcgttccggtgagcgaggtgacgcgggcatcgcagctgcgcccgaagcccgatccgaagcccgagcccgaaaagcaggtggcgcaggccagcccgccgccaccaccgcctccgcctccgccgcccccacctccgccacccccgccgccggcggccccgccaccaccacctcctccgccaccacctcctccgcctccgccaccaccgcctccgcctccaccaccgccgcctccaccgccgccgcctccgcctccaccccctccacctccaccgccgcctccggcccccaagccgcagccggccccgccaccaccgccgcctcctcctcctccgccaccgccgcctcctccgcctccgcccccacctccgccgcccccgcccaaaaagccggagccggagaagaagccggagccgccgaagaagcccgagccggagaagaagccggaaccgccgaaaaagcctgagccggagaagaagcccgaacctgaaaagaagcccgaaccgccaaagcccgcaccgaagaagccggagccggagaaaaagccggaaccggaaaagaagcccgagccggatgatcctctggcgtcgctgcgtaagagtctggatcagctcaaatcgcaggcgaaagaggacgccccccgggaacagcaggttgcgcggtccagccagccgcaggcgccggtgatgcagcgcaatgcccagcagaccgaccaggtgtcgatcagcgacattgccttcatccggagccagatcgagcggcgctggtcggtgccggtcggtgcgccggaggctgagaatctcgtggtcgaggttcgcatccgtctggcgcccgatggtacggtgctttctgccgacgtggtcgaccgcgcacggatgtcgcggccgggcgaagaggcatatcgcgtggccgcggaaagcgcggtccgtgccgtgcgtgccgcaagtccgctggaattgccggcaggcaaatacgagcagctcaaggacattgtcctggcgttcaacccgaagaacatggtgggccgatgacagacacgatccgttccgcaaccgccggtcaggcgccgcgtcagaagatgcggccggtcctgcgggcattcgcggttgcggcagtcgggctggtcgtggggctgggcggggcgggattgcctcagccggcctcggcgcaggtgcgcatcgacatcacccgcggtgtcgtggagccgatgccgatcgcgatcagtcccttcctcgcggtcgatccctcggcggcacccttcgatgccgacattccgggtgtggtcgcgaacgatctcgcgagttcgggcctgttccggccgatcgaccgtgccgccttcctgcagggcccggccgagatgaacccgatgccggatttcgccgactggcggcagatcaatgcccaggcgctggtcaccggccaggtgcggcgcgaaggcgatcagatcgcggtcgaattccggctgtgggacgtgttcggccagacccagatggccggcgtggtctatcgcgtcgatcccaagctctggcgccgcgtcgcccatatgatcgccgatcagatctatgagcggatgaccggcgagggcggctatttcgatacccagatcgtttatgtcgcggaaagcggcccggccaacaagcgggtcaagcggctggcgatcatggaccaggacggcgccaacaaccgctatctcaccgatggggcggatcaggttctgaccccgcgtttctcgcccaactcgcgcgagatcacctatatggccttcaggggccggcaggcgcgggtgttcatctacgacctggataccggccgtcagcgggtgctgggcgacttcccgggcatgaccttcgccccgcgcttcacccccgacgggcgtggcgtggtgatgtcgatggcgcgcgacggcgtgacctcgatctatcgcctcgacaccaatggcgggtcggtgcagcggctgacctcgtcgcaggcgatcgatacctcgccgtcgctgtcgcccgacgggcggcagatgaccttcaattccgaccgctcgggcggtcagcagatctatgtgtccggtgccgacggctcgggtgcccagcgcatcagcttcggcaacggcacctatgcaacgccggtctggtcgccccgcggcgatctgatcgcgttcaccaagatgaaccgcggacggttctacatcggggtcatgcgccccgatggcagcgacgaaaggctgctgacggacggctatctggttgagggcccgacctgggcgcccaatggccgtgtcctcgccttcttccgtcaagaccgtcctggcggaccgaccagactgtattcgatcgatatcacgggatataacgagcggttgatcgtcactcccggcgaagcatcggatccggcgtggtcggccttgattcgatgaggtcaatagttatactttgactcgtcgtgtgcctggcgaccgggtaggtcatgaccctcgcgtgacctacgctggcgattggagcgaacgccggccaggactgcctctccgctttccggtgctccgacatgtctcggataccttaggtagaaaatgcgcaccaagatcctcactgctgtcgccgccctggctttcatggccgcctgctcgtccgcgccggaagataccggttcgaccggcgcctcgggtgcgacctcgtcgtcgtcctatggctcgggccagggcaccgtttccaccggcgcgcagcccggcagctgggaatacgtccagcagaccgccggcgaccgcgtcttcttcgagctggacagctcgtcgctgaccgccgagggtcgccagaccctgtcggttcaggccgatttcctccgcgccaacccggcgcagcggatcgtgatcgagggtcatgccgacgagcgcggcacccgcgagtacaacctggccctgggcgaccgtcgtgccaccgccgccaagaactacctcgttgcgctcggcatctcgccggaccgcatcgagaccatctcctacggcaaggagcgtccggccgtcctcggttccgacgaggccgcctgggcgcagaaccgtcgtgcggtgaccgtgctggtcaactgacgacggcatccggccaggccggattcctgcaaggtccgctccgacctcgatcggcggccggtgtttcccgcgaccaacgggaagcaccggccgtcggccgtttttgccgtttttactgcggcagtttccccgtggcagtctttctgacgccccacagcctgcgctataagggacgggctcgtccgtcttcttctccccatcgaggcatcgaccaccatgtccgttcccgcgacccggtcccgtccgtccggcctgaagcgccgcctcgtcggcggcaccgccctggtgatgacgaccctggctctgctggtggtcgaccggcccgatgccggcgcgcagcagcagggcagtctgccccccgccgcgctcggcgccttcgacggccggctgagcggggtggaagagacccagcgccgccataccgggcggatcgaggagctggaattccgcatgcgccggctggaagagcgggtcgacgggctggagcgcaatctgaacgaccgtctgggccgcatcgagcagatgcttcagaacggcgcggccgccggcgctgctgcgggtacgggcgatgcgaccggcatgaccccgggtgctgcggcaccggccgatgctgcgccggggcagggccaggcggcaggacagggccaggcagcagggcagggcgaggcgccgcgcagcggggccgtgcagccgctcggcaccatcaccacccggcgtgatgcggccggcaattccgtgaccaccaccgaggccgcgccctcgcagccgaccccgccgccggtcgcgggcggagaggcggccaagacccgggccgcgtcgatccagtccgagcaggaactctatcgctacggtctcgacctgctgctcaaggatcgcgactatgccggcgccgaggtggcgttcaacgagctgatccagcgcttcaagcagggtgagctggtcggcaatgcctattactggctgggtgagacctattacgcccagggccagtacgaccgggccgccctgaccttcggtgagggcgtcaccagccacgacaagagcagcaaggcccccgacatggtgctgaagctgggcatgagcttcgcggcgctgaaccgcaaggacgatgcctgcggcgcctattcgatcctgaaccgcaaattccccaacgcgccggccaatatcaaggtgctgaccgagcgtgagcagaagaagctcggctgcggctgagccggtggcggacgacgatatcggggcctgcttcgcccgggccatggcggcggccggctgcgcggaaccggcgccacatctggccgtggcgctttccggcgggcccgacagtctgggcctgaccctgcttgcccgcgactgggccgcggcacgcggcggacgggtcctggcccttgtggtcgaccacggcctccgtgccggcagtgccggggatgcccggcgggcggcggcgctggcggctgcggccggggtgccggcgcggatcctgaccttcgcccccggcgcgatcggcatgacggggattgaggccggggcacgcgccgcccgctatgccgccctcaccgatgcctgccgggcggcgggcatcctgcatctgttgaccggccacagcctggatgaccaggccgaaaccgtgctgatccgcctcggccgcggcagcggcgtcgacgggttggcggccatgccgccggtccggcccgaagacggcatccgcctgatccggccggtgctcggcatccgccgcgcaagccttgcggcggtggtggcggcggcagggctcacccccctgcacgatccgatgaatgatgacgaccgggtgcagcgcgtgcgtctgcgcgccgcggcgaccgccgccgcccttgaaggtgccgggctcgatcccgcccgggtggttcagtccgccgcccgtgccgcggcggccagggccgcccttgatgcgcagatgctcagggtcgccttccgcggcgggttgcgcctgcatgtctggggcggggcggaactgccgctggcgctgtttgccgaccccgatctttcggcgccggggctggaggatgacctgcccgaacggctggtcgggcggctggccatggtggtgggcgggcaggacctgccgccgcgtggcgccgccgcggcccggctcgccgccgatctggtggcgatggcgcgcagccgggcggggggcgaccatctgccgcagagcgggcggggacaaggcgggcgcacgctggggggctgccggtttctctggggcgggcgcaggcttctggtgctgcgggagccgcgggcgatcgaagcgccccgggcggtgaggccgggggaggtgctgcattgggatgggcgtttcatggttgtcgttcccgatacgccggcatgtcgcgccgccgccgatgacggccgcctgcggcttcgggcgatgggggaggatctggcccgacgcctgggcgaggcggcgccggccgcggcggcatggctgcgcgcccgtgtcgctccgcgggcgatcgcgtcgctgcccgtgctcacgcgacttgacgtacccctcgcgttcccccacttaacagagagcatccgcagggaggctgcggaggacgaaacccttgcccactccactttccgggcatggttcgcgccatcccgtccgctcgacggtgacggcgtcttctgggcgatggcgggcgaacattcggcaggaaagagacctcggtcgtgaacaacgttaagaacctcgcgctctgggtgatcatcgccctgctgctggtggctctgttcaatctgttccagagtccccagagtcagggcccgtcgcgccaggtcgcgtattcggacttcctcaatgccgtccaggaggggcgcgtcaccgacgtgaccatccagggcgacacgatccgcggtcatttcaatgacggcagcggtgtcgagttccgcaccatcgcgccgccgaacgacaacggcatggtcgagcgtctgcgcgagggcaatgtccgcatcaatgtcgcgccggtggaggacaacgttccctcgctgttcggcatcctgatctcctggttcccgatgctgctgctcatcggcgtgtggatattcttcatgcgtcagatgcagggcggcggcggaaaggccatgggcttcggcaagtccaaggcccggctgctcaccgaaaaggccggccgcgtgacgttcgaggacgtcgccggcatcgacgaggccaaggacgagctgcacgagatcgtcgaattcctgaaggccccgcagaagttccagcgcctgggcggccgcatccccaagggcgtgctgctggtgggtcctccgggtaccggtaagacgctgctggcgcgtgctatcgccggcgaggcgaatgtgccgttcttctcgatttcgggctcggacttcgtcgagatgttcgtgggcgtcggcgccagccgcgtgcgcgacatgttcgaacagggcaagaagaacgcgccctgcctgatcttcatcgacgagatcgacgccgtcggccgccatcgcggtgccggcctcggcggcggcaatgacgagcgcgagcagaccctgaaccagctgctggtcgagatggacggtttcgaggcgaatgagggcgtgatcatcatcgccgccaccaaccgccccgacgtgctcgacccggcgctgctgcgcccgggccgcttcgaccgccaggtcgtggtgccgaaccccgacgtgtcgggtcgcgagaagatcctgtcggtgcatatgcgcaaggtgccgatcggcccggatgtgaatgcccgcgtcatcgcccgcgccacccccggcttctcgggcgccgacctcgccaatctggtgaacgaggcggctctgctcgccgcccgccgcaacaagcgcgtggtcggcatggccgagttcgaggacgccaaggacaaggtcatgatgggtgccgagcgccgctcgatcgcgatgagcgaggacgagaagcggctgacggcctatcacgagggcggccatgccatcgtcgcgatgcattgcccggcttccgacccgattcacaaggcgaccatcatcccccgcggccgtgcgctcggcatggtgatgcgtctgcccgaacgcgaccggctgtcggtctcgcgtgagaagctggaagccgacctcgccgtggccatgggcggacgtctggcggaagagatcatcttcggccacgacaaggtgaccagcggcgcgtcgtcggacattcagatggcgaccaaactggccaagaacatggtcacccagtggggcatgagcgacaagctgggcccgctgaactatggcgagggcgacaacgagcccttcctcggctatgcggtcacccagtcgcgcggcatctcggaagccaccgccaacgtcatcgaccaggaagtccggcggatcgtggaaaccgcctatgaccgcgcccggacgatcctgactgaaaaccacgaccagctggagcgggtcgcccaggcgctgctcgaatacgagacgctctcgggtgacgagctgaaggcgatcgcggccggggagcagatcaagccgcgccggtccgacgacatgggcgatggcggttcggccacggtgtcggagccgcgcccgccgcgggcctctgttcccacggccggcggtgacgacggtcttcgtcccagcccgcagcccggcgcctgatcaaccgaccggaccaggacacgaccttggcccatgacctgcctgccaacgctgcggccgcatcttcggatgcggccgcagccgcgtctctggagacccgcatccgcgagggcgatgcgggtcttcgtctgtatgcccgccccttcggttttgcgccggtcgcggtcaccccgggggcggggcttctgaaacccgccacgcgcctgccggggccgggcttccggcgcctggcgggcggttggctcgccttcgacatggtggagctgctctggcggggcggggagggccgcccggggcgggtggtgctgccggtagaggcggcactcaggctcgccgaccgggtgatggaatatccgggtggccggcgtctggcccggcgtctgcgggcgctggaggccccccgccagcgctttgccgggctcgatctgcagcgccgcgcccgggtgatggcgatcgtgaacgtcacgcccgacagtttttcggatggcggcgacgcctttgcgcccgccgatgccgcagcggccgtccgccgggcgctggccgatggcgccgatctgctggatctgggcgccgaatcgacccgccccggcgccgccgatatcgacccggccgaagagatccggcggctggatccggcgctggacgaggcgtcggccgccggggccgtggtctcggtcgatacccgcaagggcgccgtgatgcaccatgccgccggccgcggtgccgccatcgccaacgatgtcagcggcttcacctacgaccccgcggcggcgggggtggtggcacagacggggctctcggccgttgccatgcatatgcgcggcacgccggaaaccatgcagcagctgaccggctatgacgatgtggtgctcgatgtcttcgacgaactcgaggatcggctggtcctgctcgacgaggcgggggtgtcgccggggcaggtggcggtcgatcccgggatcggattttcaaagacggtggaccagaatctcgctctgttgcataacctgtcgatctttcacggccttggccgccccctgctgatcggcgtgtcgcgcaagagcttcatcggccggatcaccggcgaagaggcgccccgggcgcgtgtgccgggctcgcttgccgccgctctgctcgcggtcggccagggcgcccagatcgtgagggtgcatgacgtggctgaaacggttcaggcgctggtggtcggccaggcaatcggccgcggccgggcgtagggccgcccgcgccgccgcccggcggcgcccggccgatgctgcggcatcggtcgtcgcaccaccatcgggcccctgtgcggggccaagccttgcccatccgcccgccggccagcccggcgcggagggccctcgggaccaggacattcgggtgatctgatcatggcgcgacgttatttcggcaccgacggcattcgtggccaggccaacgcctggccgatgacggccgaggtggcgctccgggtcggtgtcgccaccggcatgcatttccgctctgcccgcgcacgcacccgggtggtgatcggcaaggacacgcggctgtcgggctacatgatcgagccggcgctgaccgcgggcttcgtctcggccggctgcgatgtcttcctggtcggcccgatcccgacgccggcgatcgccatgctcacccggtcgatgcgctgcgatctgggggtgatgatttcggcctcgcacaaccccttcgccgataacggcatcaagctgttcggccccgacggctacaagctgtccgacgaggttcaggccgagatcgaggcgatgatggacgggccgcaggatggcgggctggcggcacccgagaaactcggccgcgcccgccggctcgataccgcccgcgaccgctatatcgaggcgatcaagggcacgctgccgcggggcctcaggctcgacgggctgaaggttgcggtcgattgcgccaatggtgccgcctatgccgtcgcccccaccatcctgtgggagctgggcgccgaggtcacggcgatcggcgtggagcccgacggcttcaacatcaatcgcgactgcggctccaccgcgccggaggcgctggcgcgaacggtggtggagaagggctgcgatatcggcattgcgctcgacggcgatgccgaccgggtgatcgtggtcgacgaggccggccatcaggtcgatggcgaccagctcatggcgttgatcgcctccagctgggcgaagcgcggccggctgaccggcggcgggatcgtggccacggtcatgtcgaatatggggctggagcgctatctggaggcccgcggcctcaccctggtgcgcacacaggtcggcgaccgctatgtgggcgagcgcatgcgcgccgacggctacaatgtcggtggcgagcagtcgggccacatgatcttcagcgactatgccaccacgggcgacgggctggtcgccgccttgcaggtgctggcggtgatggtggaggaggggatcagcgcctctgccgccacccgccgcttcgacccctggccgcagctgctgcgcaatgtccgctatgccggccaggcgccgacggtcgacgacgcggtggttcgggtgatcgcggaggaaaccgcgcggctggacggccatggccgcattctgatccgcccctcgggcaccgaaccgttgatccgggtcatggcggaagccgatgatcccgtcctggtggaacaggtcgtcggtcgcatcgtcgaagtgatggaacgggtggccacgcgacctgaatgatctgcatggaaggggtggaagcgttaactttcggcccgctaacatcatgccagacaaaggtggaggaacgcttccgccggatcatgtgaacgggcaccgccggccgggggctgtcggaccggaaccgtcagggtaggggaaagggcagtccgatgacgggtgcttcatctgcgacggcgatgccgcggctgctcagcgtggaccacggcgatcccgaaggccggggaggtatcgccttcgacctgaagctcgccaccgcctgcggggtctatgcggcgagcacggtgacggccatcgtcgccgatggcgaggcgatgccggtgccggccgacatcgtcggcggtcagctcagggcggtgatggaagatatcggcgccgatgccctgcgcatcggccgggtgaccgagaccgaccagctgctggcggtgtcggaagtggtggaacatctgggccatggcgtgccgctgatcctggatccggtgctggtcgatgccaccggccgccatctgatgaaccgcgatgcgctgcaggtgctgaaggcccgtctggtggtccgcgcccaggcgctgatcctggatctggccgcggccgaaatgatggtcgggcgcgaaatccgccatgtcgacgggctgatcgatgcggtggccacgctggcgagcctggggcccgagcaggtggtggtggccggcggtcccgccttcggcatcgccatgctcgccgatgacgatatcgacctgatcgccgatgaaggcctggcggccgggccgctgggcgggccgccgatcgggcttgcgaccgcggtcgccatgggcgcgatccgggggctcgacgcaaggcggtcgtggcggcatcatgccgagctgatccgggcgacggtggcagccgatccggctgcgcgcgccgcggccggctctcatcccttcaccgacctgcatgccgctttccgggcggtgacgcccgacgatcccgccggcgaggagacctgcccgtgaccaccagcctgccgcgtgtgcccagcttgccacgtgtgttgatcatcgccgggtctgattccggcggcggggccggcatccaggccgacgtcaagaccacgctggcactgggtgccgacggctgcccggcgatcaccgcgctcaccgttcagaacacgttgggggtgacgggtgtctgggaagtgccggccccggccctgatcgccgagatcgacgcggtgctggccggcggtgtcgccgcggccaagaccggcatgctccattcggccgaagtgatccggacggttgtcgagcggctggatccggcgctggcaggcggcctcgatctggtggtcgacccggtgatggtcgccaagggcggccaccggctgctgcgcgccgatgcggtagaggcgctgaaggccctgatgctgccgcgggcggccgtggtgaccccgaacctgcccgaggccgaggtgctgaccggccttgccgtcaccgacccggcctcgatgatccaggccggccgcagcctgatcgcccagggcgcccgcgccgcgctgatcaagggcggccatatggacgggccggtgctggtcgacatgctggtgacgcccgcccccgaaggcggcctcaaggtgctgcgcttcgaaagcgcccggatcgacagccgccatacccacggcaccggctgcaccaccgccagcgccattgccgccggccttgcccgcggccggcccatggccgaagccgtggcggtggcgcggtcctatgtccgccaggccatgctggcggcgcccggactgggccatggccatggcccgcttcgccacgactggaaccggatggtggcggctttgtgacagccgatcacccataacgacgttatggtgaaactgacggtgggggcgcgccaggttggcatccggcggccaaggcgtgtaaggtgaacgaatggggcacgggcatcgccgtccggcggcagcacgggccccgttattgttttgcctgtcgcctgcccttttacccatcgtctaccctttcccctgtcgtcgcggaaccttgccagatgtcgagcggtccgtcagagaagccggagcggggcgatccctcagcgccggttgaagccagcacactggtccggttcaccccgaccaggcctcccaccactgcgggaggggcctcgacgaccgccacccgatcccaacgttccgagacctccggccgccgcatgcagatccccatctgccatctcgacgtcttcgccgaccgtgtgttccgcggcgtgcccgctgtggtctgcccgctggacggctggctgcccgacgacatcctggccgatatcgccggcgagcatgccaaggccgaaaccgtgttcctggtgggctccgccggggtctacgaggttcgctggttctcgcgcgcggccgaggtgccgctctcggcaccgggcgcgctggcggcggcgcataccgtcttccattacctggagccgcagctccgccgcgtgcagctgctcaccccctcgggcatgatcatgggccagcgcgacacctcgtcggtgctggtcgatctgccgctgcgcccgccggtgaagatgctgggccgggtggacctcactgccgcgctgggcggcatcacgcccgagacggtgatgatgctcgacagctcgtgctatgtggcggtgctggccgacgaggcggcggtagaggcggtgcgcatcgaccgcgctgccatggacacgctcggccggccggtggtggtgctcacctctcccggcgatcagagcgatttcaccgctcgggtggtggcggcgaaatgggggcccgaggcacttgccgtccggtcctcggcgctgtgcaccctgctgccttattggcgccagcgtctggaccgcgacgacctcaccgtccgtgtggtcggtcagcgcggcggcagtgcctggtgcagcagcgggcgtgaccgggccgtggtggcagccctggttcagcgctacatggaaggcatcatctacctctaaggccgggcttcggttcccggccggaaaccgtgcttgtcggcatacatccgccggtcggccgccatgatcagcgcatccagcgtcgatccgtcggcgggcgccgcggcggcaccgatgctgacacgcgccggcaggggaaagccggccccgatggagatccggccattgatgtcggcatccagttcggccacccggccatccagatcgctgctgtcgcccgttccgtcgatgaacagcgcgaattcatcgccgcccagtcggatcggcgtctcgcccggcctgagcagcccgcgcagggtgtcggcaatccaggtcagcgccctgtcgccctgatcgtggccgaaactgtcattgatgtgcttgaacccgtccaggtcgatcagcaccaggccggcccggtcatgggccaggctgcgtgtcgccagacggtcgagcaggcggcggttgccgatgccggtcagcggatcgcgatcggccagatctgccagcgcgcgatgcactttcaggttcaccatcagcagcatgccgaaggtccagctcaggatgaacagcagcgagatgaagaacacataggcatgcgccggatcgcccggcgcgcggaaggtgccgcgcggcgcggcgagggctgcgtcgatccggaacagatagctgcagaccatcactgcggtaccggcggcgatcatcagatggatggtccgttcgtcgcggcgggcgcgatgcagcagggccgcgatcatcgcgaccaggatcatgctgttcagcatgtcgttcagcgtgatccgcagccagtcctggttcaggttcacgatcacctgaacggcttcgatcagcatggccgtcggcgtcatccagcgcagtctccccgccgggatcagcccacgaaaccggagcaccccgtccaggatcagcatcaggctgccggtcgagatcgtcatgttgagcggaatggcgatctcccgccccagccagggcatggatacccaggcgagaaacgacagcgtgccgccgaaggcggccagcatccacgagatgaggccggccatcggccggttgaggcgccagataacgatcgagaccatcgacgagatgacgcaggtcatgatgatcatgatcccgaccgtcctgaggtcgatgacgtccggccaggagagcattttgcagtcgtcgccgtaagcagcaggggcagaccagcactatgcgggctgcagggttaagaaatcatgtggacaatcggggtctggcgggtcatcgggggacaggccggcgtatgagccatgcgtccggtgcatggcttccgtcgggttcctgcccggctgacatgtgttgaccggtgggggcgacctcactatcgtcggcagcgggccgcgaccccccaacgggtcgccactcttcctgaggggaaggcacatgacgacgaaacccgccgcgaagccgctcgatccgcgcttctcgtccggcccctgcgccaagcgcccgggctggagcctcgatgccttgagcgacgctgcgctcggcatctcgcaccgcgcgaagcttggcaaggccaagctcaaggaagccatcgaccgcaccgcggcgatcctcggcgtcccggccgacttcaaggtcggcatcgttcccgcctccgataccggcgccttcgagatggccatgtggtcgatgctcggcgctcgtggcgtcgacatcctgtcgtgggaaagcttcggcgacggctggaagaccgacatcgtcaagcagctgaagctgccggatgtccgcagcttcaccgccggttacggccagctgccggatctgggtcaggtcgattttacccgcgacgtgatcttcacctggaacggcaccacctcgggcgtgcgggttccgaacggcgactggatcgcggccgatcgcgagggtctcaccttctgcgacgccacctccgccgccttcgcgatggacctgccctgggacaagctcgacgtcgtcaccttctcgtggcagaaggtgctgggctcggaaggccagcacggcatgctgatcctctcgccgcgcgcggtcgcccggctggagagctacaccccggcctggccgctgcccaagatcttccgcatgaccaagggcggcaagctgatcgacggcatcttcaagggtgagacgatcaacaccccctcgatgctggcgctggaagactatctcgacgccctgaaatgggccgagcagatcggcggcctcgaagccctgatcgcccgcaccgaaggcaatttcgcggtgctggccgactgggtcgcgaagaccgactgggtcgatttcctcgccaccgatgccgccacccgctcgccgacctccatctgcctcgcgatcgtcgacccctggttccagggtctcgatgccgccggccaggccaaggtccagaaggacctgaccggtctgctggatgccgagggggcggcgctggatatcggtgcctatcgcgatgccccggccggcctgcgcatctggggtggtgcgaccgtcgagcgcgccaatctggaagcgctgctgccctggctcgactgggcctgggatcaggtgaaggccaaggccgccgcggcctgagcttttcctgccctccatacgacccctgctttcccgtattcccggttcgaaaacggtgccccgcctttccgcgcaagactgcgtgggaaggcgtgcggcccgcgatggagacttcccatgcccaaggtcctgatttccgacaagatgagccccgccgccgccgagatcttcgcctcgcgcgggatcgaggtcgacgtgaagccgggcatgaccccggacgagctgcgcgcggtgatcggcgcatatgacggcctggccatccgctcggccaccaaggtcaccaaggacatcctggcggccgcaaccaatctgcgtgtcgtcggccgcgccggtatcggcgtcgacaatgtcgacatcccggccgcctccgcccatggcgtggtcgtgatgaacacgcccttcggcaactcgatcaccacggccgagcatgcgatctcgctgatgctgtcgatgctgcgccagattccggcggccaatgcctcgacccatgccggcaagtgggaaaagaaccgcttcatgggcgtggaagtgacgggtaagaccctcggtgtgatcggcgtcggcaatatcggcgccatcgtcgccgaccgcgcccagggcctgaagatgaaggtgatcggcttcgatcccttcctgtcgcccgagcgcgcgcaggatctgggcgtcgagaaggtggagctggacgagctgttccgtcgcgccgacgtcatcaccctgcacacgcccctgaccgacggcacccgcggcatcatcggcgccgacgccttcaccaagatgaaggacggcgtctatatcgtgaactgcgcccgcggcggcctggtggtcgaaaaggacctgaaggcggcgctcgactccggcaaggtggcgggggcggccctcgacgtcttcgccgaagagccggcgaaggagaatgcgctgttcggtgacgagcgcgtggtcgccaccccgcatctgggcgccagcaccgtcgaggcacaggagaacgtcgccctgcaggtggccgagcagatggccgactacctgctgaccggtgccatcaccaacgcgatcaacgtgccgtcggtgaccgcggaagaggcgccgaagctgaagccctatatgaagctggccgaacagctgggcagctttgcaggccagctggccgaaaccggcctgcgcggcgtgaccgtcgagtattcgggccaggttgccaccctcaacacccggccgatcaccgcggccctgctgaccggcctgctgcgcccgctgctcgacagcgtcaacatggtcaacgccccgatcgtcgccaaggagcgcaacatctcggtgaccgaggtgcgcagcgacaaggcgaccgatttccagacccagatcaagctgaccgtgtcggacgagcgcggcggccgcagcgtcgccggcaccctgatcgcgggcaaccgcccgcgtctggtttcggtcgaggatgtggcgatcgaagccgaactggccgagaacatgctgttcgtggtcaacaacgacaagccgggcttcatcggcggcgtcggccgcacgctcggcgaatcgggcatcaacatcgcgagcttccatctcggccgtcaggcgcccggcgcccgcgcgatctgcctgatcgaagtcgaccagcccctgcgcgaggcggtgctgaagcaggtccagggcctgccgaacgtgatcaccgccctgtcgctcagcttctgagcgactctcatcgaagggaccgcgctcagcttctgagtgactctcatcgaagggaccgcgctcagcttctgagcgactctcatcgaagggaccgcgctcagcttctgagcgcgagcggtctcaaaagtatcgaaaccggtcgtcccctccggggcggccggtttcgtgcgtttgcggttgagtgccgggccccgcggggctacactccgccccggccgtcggcgcccgggaaacggggtcgtgacggctttcgtgcgtcctgaaccggccgtggaaatgcgcggtccggatgttttccatgggttgagaccggggccgatgatcgacgaccgccagcgcgcgctcctgccgaacgggttgcaggacctcctgccgcccgatgccgccttcgaggcgcagacgatcgagcggctgatggctcatttcgcggccgaaggctatgcgcgggtgaagccgccgctcgtggaattcgaagacagcctgctgaccggcccgggccggctgctcgccgcccagatcttccgggtgatggatccggtgtcgcagcggatgatgggcgtgcgcgccgacatgacgccgcagctggcccgcatcgccgccacccgcctggcccatgccgcccggccgctgcgcctgtcctatgccggccaggtgctgcgcgtgcgcggcggcatgctgcggcccgaacgccagttcgctcaggtcggcatcgagctgatcggcgcgcccgaacccacggcggatgccgaggtggtgcggctggccgccgaggcactgaccggcatcggcgtgaaggggctgaccatcgacctcaacctgccgaccatggtcgatgtggtggccgaagccttcggcctgccgaccgatcagctgggcccgctgcgcgaggcgctggaccgcaaggatccgacggcggtggccgaactcgccggtgccgcagcaccgctctatgccgggctgctcgatgccgcgggcatcgccgccgaggcgctggcccggctggatgcgctggagctgccggccgaggcgcgccgtctggtcgccatggtcgccgatgtggtccgggtcatcgacctcgccgatctggatgcccaggtgacgatcgatccgatcgagcatcgcgggctcgactatcagaccggcgtcagcttctcgctgtttgcagccggcgttcgcggagagctgggcagcggcggccgctatgtcgccggtgccgatcagaacggcggcggcgagcccgccaccggcttcagtctttatatggacagcgtgctccgggcgatcgatgcgcccgtgcggccgcgtcatctctacctgccgttcggctgcggcccggttgcgggccgtaccttccgtgccgacggctggatcaccgtccagggccttgcgcccgagaccgaccctgtcgcggaggcgcgcgcgcagggctgttcccacatcctgcggggggctgatgccatcccgctcgacgccatcgatatccggggggcgtaagctcatgagcaacgtggtcgttgtcggctcccagtggggcgacgagggcaagggcaagatcgtcgactggctgtcgcaccgtgccgacgtggtggtgcggttccagggcggccataatgccggtcacacgctggttatcgacggcaagacctataagctcagcctgctgccgtcgggcgtggtgcggggcaagttgtcgctgatcggcaatggcgtggtcgtcgatccctgggccctgctcgacgagatcgaccggatcggcaagctgggggtcaagatcacccccgacacgctgcgcattgccgagaatgtctgcctgatcctgccgctgcatggcgtggtcgaccgcgcgcgtgaagcggcgcgcggcggcaacaagatcggcaccaccggccgcggcatcgggcctgcctacgaggacaaggtcgcccgccgggcgatccgcctctgcgacctgaccgatcgcgacctgctggcgaccaagctcgacgatctgctgctgcaccacaacgcgctgctcaccggcctcggcgccgaagagcggttctcgcgcgacgaggtgatggcgaagctcgacgagatcgcgccgaagctgctgccctatatggacccggtctggcggacgctcaacgaggcccgccgcgcccgcaagcgcatcctgttcgagggtgcccagggggcgatgctcgacatcgaccacggcacctatcccttcgtcacttcgtcgaatacggtggcggcgcaggcggcgaccggcagcggttttgcggtcggccagatcggctatgtgctgggcatcaccaaggcctacaccacccgcgtcggctcgggcccgttcccgagcgagctgcatgacgagatcggcaagctgctgggcgagcgcggccatgaattcggcaccgtcaccggccgtccgcgccgctgcggctggttcgatgcggtcgcggttcgccaggccatcaagaccggcggcatcgacggcatcgcgctgaccaagctcgacgtgctcgacgggctggagaagatcaaggtctgcaccggctatcgccacaagggcgcggtcatcgactatctgccgtcgagcccgcgggcccaggccgagatcgagccggtctacgagaccatcgagggctggagcgagagcacccagggcgcgcggtcctgggccgatctgccggcgaccgccatcaagtacatccgccgcgtggaagagctgatcgaggcgccggtggcgctgctgtcgaccagccccgagcgcgaggacaccatcctggtccacgatccgttcatcgactgaccggatcgtcgcaggacgggacgacatcagggccgccggtggatttctgccggcggcccttcgttcgggcacccccttcggccgtgcagcatcgtgtggaaccgggtatacagggggaggggaccgcgaccggacgggagcgggtaggggacggggcacgtctggatgtcggaagccgggcagaacgaacacaccatcatcggcggacgctaccggatgataccgggcgtgcggctggaggagttcgaccggccgcatgtcgaagctttcggggccgaggatctgcgcgagaaggaccggccgctgatcgccctggtcgcccggcgcggccggccggtgcgcgacgactggctgcgggtggtccgccggctcgaccagcccgggctgctgcggaccatcgaaggcggcgtgatcgatccgggcgacggcaagggccggcgcttcgcggtgatcctggaacgtccgctcggtggccgggtgatcgactggctgaagaccgacggccagaaccgcgacgatctggaactgtcgcggctgctgctccggccgttgatcgcggcgctgaaggcgctgcacgacgcgcgcatggcgcatcgggcgatcgcgctcgacaatctctatttcgccgatctggcccgcacccgcatcgcgctgggcgactgcctgtgcggcccgccgggcgaaggccagccgatcgccttcgaaagcgtcgaacgggcggccgccctgccggccgggcggggcgagggcggcccgcgcgaggatttctttgcgctgggtgcgcttttcgccgcggcgctggcccgccgggtgccggggctggaaagtgcggatgccgcggcagatctgatgcgccgtcggctggatcgcggatcctatgtggcgctgaccgatcgggcgcggttcggcaccgatgtcggcggcctgctgcgcgggctgttgagcgacaatgccgaggaacgctggggctatgaagaggtcagggcctggctggacggccggcgcagcatcggcgccatgcattccacccggccgcaggcggcgcgatccttcatcttcaagggcatcgagcacaccaatgccatgagtctcgccaccgcgctggccgagaactggcgggaagcgctcaggatcgtgatcgacgaaaagctcgacggctgggtcgcgcgggcgatcggcgacgagcggcgcggcaacatgatcacccaggcgatcgccgccggccgggtcgatgccgggccgggcggcgatgccacgctcgctcgtgtgctcgcggcgctcgatcccgaggggccgctgcggctgcgccatgtggcggtgatgaaggacgggctggggccgctgatcgcggtcgcctttctcgacgacgaccgcgacacccgccaggccatggccgaaatactgatggaaggcctgccgatgatcgggctcagtctggtcgatccgaacgatcagaccaagcggcgcctggcgcagagcgagatggccgatttcatgcggctgcgcggtttcgtggccgagccgatgatgggcttcgggctggagcgggtgctctacgacctgaacccgaccctgccatgcctgagcccgctggtcgccgacgcctatccgcagagcgtggccgacctgctgatggcgctggatcaccgcgcccgcggggcggggcggggcacggcaccggtcgaccgccatattgccgccttcatcgccaccaaactcagcatctcttatgccggggcgctgcgcggcgtggtggtgggcggcgacggcgaggcctcggaacggcttgcccagctcaacctgttgagcctcgcccaggaaacccagccccaggtgcgcgtgccgatgctggcccgctggctggtgcagcggctggggccggtggtgcagagctataacggcaagaccacgcgggaatggatggagaaagagctggagcgggtggcgccgctcggctccctgaacgcgcttcgggcgatcgtcgacaatcccgaacggcgcgaggccgacaaccgcggcatggccaatgcccaggcgctgcatgcccagctgtctttcggcatccgccgactgaacgagacccgggcggcccggcggctggaggcgcagcatttcggccggcaggtggcggcgatgctgggctatatgatcctgctcggggtgctggcggcgctcaccctgggcgacgtctgaccggcgggggcaaggatggcgaagaagaagaccgcggcccggcgcgcgccggccaaacagaagagcatgaccctgccgctgacctttctggcggtgctgggcacgctcgcgatcttcgcgacgccgaccgcgctggtgctggccatcggcatggcgccgtcgctggtggcggtgttcatggaaaaccggccgggcgcctataccgcaaaatgcatcaccgcctgcaatctggccggcgtgttgccggtgctgcgcgatctgtggctgaccggccatctgctctcgcaggcgcggatgatggtcggtgacccgatcgtctggctgcagatgtatggtgccgccggcgtcggctggtcgctggtctggctggcgccgctggtcgccggcgtcttcgccgatgccggccatgaccgctcggtcgcgaaactcgaagcccgtcaggaaaagctgcgcgaggaatggggcgacggcatcaccgggtgatgccgtcgtcgtcaggtccggccggtctcagatcgccagatattcgttgcgcagttccgcatcgtcgagcacggcctgcgccgagccgtcgaagacgatctcgcccatatgcaggatcagcgcgcggttggcgagctgaagcgccgcaaccgcgttctgttcgacgatgatggtggtgatgcccatctgcttgatctcggcgacgatgcgctcgatctcttccacgatcaccggcgccagcccttcatagggctcgtccagcagcagaagcttcaggtcgcgggcaagggcgcgcgccaccgccagcatctgctgttcgccgcccgacagcgtcaccccctcctggtggcgccgttcggcaagccgcgggaagcgttcatagatccgctccagcggccagcccttgggctcggcgatctgggccagttgcaggttctcttccactgtcaggccggggatgatccggcggtcttcctgcaccagctgcacgccgtgtttggccgcctcgaaatcgcgcattttgtggagcgcggcgccgttcagccagatctcgccgcttttgagttcagggtcggtggcccgggcaagggtgcgcagcgtcgaggtcttgccggcgccgttgcggccgagcagggcgacgacatcgccctcggccatgtcgaagctgaccccctggacgatgtagctttcgccgtaataggcgtgaatgttgcgcacgctgaaatagggggccttggcggaggcggcggccggcccggcggaaggcatcgcgttcatcagtggtttcctccgagataggcctcgcgcaccttcggattggcgcgcacctcgtcgggcgcgccatcggcgatgatccgcccctgggccagcacggtgatccggtcggccagagagaacaccacatgcatgtcgtgttcgatgatcaccttggtcatgccgcgctccttgatcttcttcagcagatcgatcgtggagttggtgtcgtggcgcgacatgccggcggtgggctcgtccagcagcagcaggcgcgggtgctggaccagcgccatggccagttccagccgccgcttgtcgccgcgcgacaggctgccggcggtgcggtgcatgtgctctttcagcccgacatcggtcagccagtgctccgcctcgtcgcggatcaccgcctgggccgacaccatctgcaacgggttgagcctgaacgatccgtcgcgcttcgcgaaggccggcaccatcacattctgcaagagggtgagatcgggaaagatttcgggcgtctggaagacgcgcgcgatgcccatctggttgatctcgtgcggcttcttgccggtgatgacctcgccgtcgaacaccacggcacccgaatccggcggcagccgcccgatgcagacattgagcaaagtggatttgccggcgccgttcgggccgatgatggcgtgggtggtgccctccatgacctggaggtcgatatccgacagcgccttcagaccccggaaattcttctgcacatcggcgacgtggaggactgcattctccatggccgtcatctcctattccgccttggccgggcgcaggccgcccgtggtctggtccgccgtcgcaggctgccggcgccgtgtccaggccgcccggatccgccgggcgccctccatcagcccgccgggcaggaagatcacgatcaccaggaagatcaggccgagcgtcaggtgccagccctcgcccacgaagggggagatgaccgttaccatggtgtgctgcagcccgtcgggcaggaaggagagcgcatcttccagcttggcatggtgataggccgagaagatgttctcgaaatacttgatgacggtcgccccgatcagcgggccgagcagggtgccggcgccgcccaggatggtcatcagcaccacctcgcccgaggcggtccactgcatgcgctcggcccccgccagcgggtcggtcaccaccagcagcgcgccggcgaggccggcatacatgcccgagatcacgaaggccgccatggtatagggccgggtgttgaagccggtataggccatgcgggtctggttggacttgatcgcccgcagcatcatgccgaagggcgaattgtcgatccggagcgtcagaaagaagcccaggatcagcagcaccgcgcagaaatagaagccgccgaagccgctcatatccatgccgaagatggtcggcaccggcaggcccacggtcggttcgacgcccagcgccgcatcgatgaccctggggtcgctctgcgacagctgcagcccggtctcgccattggtgatgggggtgagcaccgaataggccagattgtaggacatctgggcgaaggcgagcgtcaggatcgagaaatagatgccgctgcggcgcaggctgatgaagccgatcaccgcggcaaagatccctgagaccagcacgccgaagatcagtgccgggatggcgctcatggtcagcagcttgaacgaccacatcgcggcataggacccgacgcccaggaaggcggcatggccgaaggacagatagccggtcatgccgaacaggacgttgaagccgatggccagaatgccgtagatcgcgaaccgctggagcagatcgggataggcggcaccgaagggctgcatccacagcggcatggtcaggatgaccagggtgaagacggccatgtagatcaggtcgtggcgaagcgtgcgcatctcagttctccatcacgcccttgcgacccatcagcccgcgcggccggatcaggagcacggcgacggcgacgaggtagacgatcacctggtcgatgccggggatcacggccttgacctcggtcatcgaggcgaagctctgcaggatgccgagcaggaagccggcggcgaccgcaccgctgatcgatcccatgccgccgaccacgacgacgacgaaggagagcaccaggaattccatgccgatatggtagctgggcggcacgatcggcgtgtacatcacccccgccatgccggcgaccgcggccgcgatgccgaagacgatcgtgaagcggcgctggatgttgatgcccaggaaacccacggtctggcggtcctgcatgccggcccgcacgaccatgccgtaggtggtgaattgcaggaaggcgatcacgcccgcgatgatgaccagggcgaagcccagatagaccagccgccaccagggatagatcaccccggcgccgagcccgatccactcgccgatattggcgctgcccgaaaaggccggcggggcggccatcgagatcgggttggcgccgaaggcggccttgatcagctcctgcagcacgatggcgaggccgaaggtcaccaggatctgttcggcatgggtgcggcggtagaaatagcggatcagcccgcgttccatggcgacgcccagcagcagcatcaccggtatcgcgaccaggatcgacagcggcaccgaatactgcagcaggaagccgccgaaatcgcccagccaggcctggaccaggggcgtgcgcacctccatgggcgatccccagggggtcagcttggtgggatcgatggtcacggtttccaggcgcagcagcccgttcacgctgacggcgatgaaggcgccgatcatgaacagggcgccgtgggcgaaattcaccacaccgagcgtgccgaagaccagagtgaggcccagggcgatcagcgcataggcgccgcccttgtccagaccgttgagcagttggagagcgaatgcgtccatgggtttttcccagccccgcctgcgcgggccgcttccaagagggcaggagatacgcgcatgcgcgacgcgcgcatatgaggacgggccggtcccgtcgccggggccggccctggatccctcaacgggtcagcagcgggagttgaccgggccgagttcgccgccgaacatcgcggcgtcgtagatcacgtcctcggtgggcacctgcttgacgatgcgcatcaggtcgaacttgtcggacgggttctccttaccctgcacgaccagcaccggcttgaagcactggtggtcttcggcacgatagagagtggggccgttgccgagcccgtcgaacttgaagccctccagcgccttgaccacaccctcgggattgaaggtgccggccatttcgcaggcattggcgtagagcagggcctgcacatagcaggtgtgggcggcctgcgacggcggctggccgtattcctgaccgaaggatttggtgaaggccttggtgccttcgtcctccagcttccagtcccagttggcggtgccgtagatgcccttcacggcatcgcccgcaccctgggccatcagttccgagaacagcgggacgacgatctcgaaattcttgccgttcacctgcttgtcgcgcatgccgaactgcaccgcctgggtcagcgagttgatcatgtcgccgccatagtggttgaggatcagcacatccgcgcccgaactcagcaccggggtcagatactgcgagaaatccgccgcacccagcggggttctgacggtcgcgaccgtcttccagcccagtttctcggtggccgccttgatcgattcttcctgggtccagccccaggtatagtcggcggtcaggtgataggccttgcggtccttgccataggcttcgcccagcaccggccccagcgcctgacccgacatataggcgttgaagaagtgccggaacccgttgcggcgcttgtccttgccggtggtgtcgttggaatgggtcaggccggacatgaagatcacgccggcgtcctggcaaagcgactgcaccgccaccgccacacccgacgacgagccgccggtgatcatgatcgcgccgtcacgctcgatcatgcgggtggccgaggcgcgggccgcgtcggatttggtctgcgtgtcgccggtgacgaaggcgaccttcttgcccaggatgccgttgcccttcagctgcgagcccttgaacgtgttcagcatgccgccgtcgccctcgccgttgaggtgcttgacggccagctgataggcgcgcagttcgtccgcaccctcgtcggcatagggccccgtctggggcacgttgaagccgagggtcacggtgctgccggtcggtgcgttgcagaagtccgcggctctggaggcgctggtgaagatggtcggtacggcgagcccggcaccgacgagtgcactgctcctcaggaaggcacgtcggttcatccgaacgatgctcattatgtctcctcccgtatcttgatcgcgccgatccgcgggccggcgcgtcaggcgttcccgcctgggcactatccttccctcatttgtgacgtgtttcaataagtcattgttttggttatataattttgtaaatcttttgagtcgatatgtcatcagtttgtgattaatttacaagagggcgagacaggggaggggccgatgtcacgcacgctcaccggcatgaagatccggaccctgcgcaaggaggcggggttgacgcagggcgcgcttgcgcgtcgcgcagggatttctgcggcctatctcaacctgatagaacatgatcgccggccggtggcgggggagctgctggaccggatcgcccgcgggatcggcgtgccccgcggcctgctggatggcggtgccgagcgccggctggtcgacatgctgaacgagatcgccgccgatccggcggtgtccgatggcgcgccgcccgccgaagcggccgaggaactggttggccgtgccccgggctgggccgcgctgctgctgggggtctatcgggcctggatggatcagcgccaggtggtgctggccatggccgaccggctgaaccacgaccccttcctgggcgagagcgtccaccggatcctgacccgggcggcggcggtgtcgtcggcggccgaaatcctggaaggcggcgatctggaagaggcggaccgggcgcgcttcaccgccatcgtcgcctcggacagccaccgtctggcggaaaccgctcagcgtctggccgggtttttcgacagcgcccatatgcgggtccggtcctcgaccgtgatggagcatgtcgacacattcatctatgagaccggcaaccattttccgtttctcgaaacggcggccgaggggttccgcaccgggctgcggcggggagaaacgcccgaagccgccgctgccgcccggctggggatcgccctgcccgaggatgatccgctgacgcccgagcggcggcgcttcggcctgctgcgcgatcttgccgccgtgctggcgggggacgagatccaggccttcgtcgccgcccatccggcactcggcaccgacgaggcgcgggtgctggccgcggcagcgctgcaatcctacatggccgccgccatcgtcatgccctatgaccggtttcttgaggcggcggagcgccatcgctacgacctggaccgactgggccggatcttcggcatttcctatgaacaggctgcccaccgggccgccacgctccgccggccgggcgccgaaggggtgcgcttcgccttcatgcgttccgacagctccggctatgtcaccaagcgcatgtcgctgccgcggctgccgctgccgcgctatggcaatgcctgtccgctctggccgatctacggcgccttccagaccccgggggtgacggcgcgcgccttcggtgagctgccctcgggcgatgccttcctgttcttcgcccgcgcggtggaaaagcggccgcctgcggccgaccgaccccggcacctgctgtcggtgatgctggccgccgcggcaaccgatgccgaccggctggtgcagggcgacggcatcgaccggacgaccgccaccatacccctcggcacggtctgccggctctgtccgcgcaacggttgtgaccatcgccaggaagccccgttgatcacatgatccggaaaacccttgggggcgggtcggcgaaggctgtaggctggagaaaaaaccggggaggatagatgccttgtcaagggcgcgcatactcatcgccgaagatgagccgaatatcgcggagtcgctgagcttcatactcacgcgggcaggcttcgaggtcgataccatcgccaatggcgcggatgcgctggaccggctgcgacgacagccgtttcaagccgtgattctcgacgtcatgctgccgggcatgaacggtttcgacgtgctgcgggcgatccggaccgatcggacgatcggcgggctgccggtgatcgtcctcaccgccaaggggcaggcccatgaccgcgagatggccgagcagatcggcgccagcgccttcatcgtgaagcccttttccaacgcccatatcgtcgaacgggtcagccatttcgtcggggcctgatcttaccgaaagtccgcaggcatggagaccgatcccgtcgatgacggcggggggcacgagcaggggcaggggatccgcgacctggccggcgtgctgccctatgccgccatcctgctgctgatgccgccgatcatcctgatcttcaccgcaccggtgcagatcgccggcattccgctgatcgtggtctatctgttcggggtctgggcgctgatcgtggccggcgcctttatcgtggcagagcggctgcgccggcaggagacggcgactgggcccctggcgccgcgcagtcgggcagggcggggctgaaccgatgctccaggccaatctggtcatcaccgtctgtctgctctatgtcgcggtgctgttcaccgtggccttcatctgcgaccggcaggcccgggccgggcgtgcccgctggtcggcctctcccctgatcttcaccctgtcgatttcggtctactgcacctcctggacctttttcggagcggtgggctccgccgcgcgcagcgggctcgaattcgccaccatctatatcggccccaccatcgtctttaccggctggtgggtgttcctgcgcaagctggtcaccgtcggccgggtgcacaacaccacctcgatcgccgatctgatttcggccaggttcggcaagaatccggcgctgggggccgtggtcaccctggtggcgttggtggtgaccacgccctacatcgccctccagctgcaggcgctgaccgccagcttccaggtcattaccttcccggcgggcgccgtcaccgccaccaagatcgatctcgtgccagactactggtcgggtgcctgggtggcactcgggctcgcggtcttctcgatcatgttcggcgtgcgcaatatcgacgtgaacgaacgccatcacggcgtgatcgcggcgatcgcgctcgaagcggtggtcaagctggtggcgctgctcgcggtcgggctctgggtggtgttctggctggcgggctcccccgcggccgctcttgccgatgcgccggtcagcctcaccaatccgcagcagaccttcggcgtgcgctggatcacgctctgcatcctgtcgggggcggcgatcatctgcctgccgcgccagttccaggtgacggtggtcgagaattccaacgagcgccagctgcgcaccgcctcgtggctgtttccgctctatctcttcgtcttttgcctgctggtggtgccgatcgcggtcaccgggctcaaccgcctgccgcccgatgccaaccccgacctctatgtgctgaccctgccgctggatgccggccaggacgtgatcgcgctgatggccttcatcggcgggttttcctcggccacctcgatggtgatcgtgtcgtcgatcgcgctctcgaccatgatctccaaccacatcgtcacaccgctggcgctgcgcttctcgtcgctgtcggatgccaatgccgaaaccgtgcgcagtttcatcctgggctcgcgtcgggccagcatcctgttcatcatcctcctgggcttcctgtatttccgcctggccgccacggcgggtgcccttgccgatatcggcctgatctcgttctgcggcgcggcgcagttcctgccggcgctggtcggcgggctctattggcggcgggcaacccacaagggggccctcgccggcatgatcgccggcttcctggtctgggcctatatgctgttcctgcccagtttccaggaccatttcctgatctcgaccgcgctggtccagaacggccccttcggctgggcctggcttaagccgcgcacgctgttcgggttgagcgggctcgacccgctggtgcatgccgccttctggagcctgttcgtcaacaccgcgctcttcgtcgtggtctcgatgatgaccgagccgacgccgctcgcccggctgcaatcggcgctgttcatcgatgtcttccgccgccggaccgagagcgagcagcgggtgctgcgccgcacggccccgatcaccgaactgcgccagatcgccgaccgggtgctgggcccggcggaaaccgtgcagatcttcgtccgcgaccgccgggcgggccgtgcgacggtggcgagcgacgagctgatcacggcggtggaacagcggctcgccgcccatatcggtgcggcctcggcccggacgatgatctcgcgcatcgtctccagcgagacgatcagcgtcgaagagctgaagcggctggcgggagagaccgagcgtatccgcgcctattcggccgagctggaacggaaatcgcagcagatcgagagcacggcggcggaacttgcccgcgccaatgcccgcctgcgtgaggtcgacaagcagaaggacgattttctgagccagatcagccacgaattgcgcacacccatggcctcgatccgctcgttcagcgatatcctgctggagaatcaggatctggacgaggcgaagaagctccgctttctcggcatcatccagaacgaaagcctgcgcctgacccggctgctggacgggatcctggacatgaacctgctggagacccgcggcctctcgtggtcgccgggactgctcgatccggagatggcgctggatcaggcgatcgaaagctgcgaggcgctggccctgcgctcgggcgtggtgctgaaacggggcacgcggacccgtgatgtcctgattctgggcgatcgcgacaagctcgcccaggtgatggtcaacctgatcgccaatgcgatcaaatacaacaccgaccccacaccccaggtggtggtatccagccgggtgcgcggcgatctttacgaggcgagcgtgcgcgacaacggccgcggcgtgcccgaagaggatcgggagcggatcttcgaaaaatttgcccgcggctcagcccatcaacagaccggcgccgggctcggcctcgccatcagccgccagatcgtcgaaagcttcggcggccggctgggcctcggcaccggccgcagcggtgccgaattcgtcgtctcgctccccctccagcccctgccgggcaccggacgcgaaagggcggatctgccgaaagcttaggcagatccgcccgatggtgatcgttcagggcgcagtcgggatgggtacggcagtcactgcgaaagacggtgtagcgtgttgtggtagcgcttcatgatctccttggccttcgcaagtattctctcgcgatgaggatgatccggcaccagcacatatccgccatcctccgtttcggccagatagagcagggaaccttcgcggacgttcaggcgcgcaatcatctcctctggaagatccacgcacagcgacccgtcgatgttccggaccttcagctcgatcgtcattgcgttgcatcctgccgtgcatgtcgttccgggcaggtcagtctcccgaacataccgcatcttatacgaaaaaaggcggcctctcggccgccctttccgtctgatcttcagtgatgcatcgccactgccggcagcaccggggtgcggcccatttcgcggcgggtttcgcgtttgacccagcggctgaccttttccagcgcgcgggcctcgatctggcgcacccgttcgcggctgatgccgtagacctggctcagatcctccagtgttgccggcgcctcgacaaggcggcggcggctgaagatgtcgcgctcccgatcgccgaggctcgcgaccgcgccttcgatcagggtgcgggcgcggccggtttcctcggcttcggccagcatggtttcctggtcgtcctcagggctttccagccagtcctgccattcggtgtcggcttcctggcgcaccggctcgttcagcgagctggcgatgccgtccagatagcgttccatggccaccacgtccgaaggctcgacatccagcttttcggcgatgatcgccacctgatcgtcgttgagcccggcctcgcccatgatgtcgagttcgctcttcacccggcgcaggttgaagaacagccgcttctgcgaggcggtggtgcccatgcggaccaccgaccaggaccgcatgatgtattcctggatggccgcacggatccaccagatcgcataggtggcgagccggaagccgcgatcggggtcgaaacgatgcaccgcctgcatcatgccgagattgccttcggagatcagatcggccagcggcaaaccatagccgcgatagcccatcgcgatctttgcgaccaggcggagatggctgttgaccaactgatccgcagcgcgtacatcaccttcgtcgcgaaagcggcgggcaaggcgctgctcctgctcaagctcgagcacgggatagcggcggatctgctgcagataggggccgaggccggcatcgaacatgttgtcgcgtccggcggtgcggggcgtgcgtgaagccatggcacgtgcctcctctcgactgaccccaggggagtcaaggtcccggtggggtgggtccggccgcgcctctccctggtgcgaccggcagggttcgcccgcaccatgcggagcgaaggcccttgcgtcctgtcgcagggagatatgcaagcagtgcgccagtttccggcgcgcgtgacccgttgagttcatctcgggcggttttcgtccctcttctgaggcttatacgagccgccgcccaatatcctacgtttcaggttgcaccaatcttacgtcccggtcgtccatccggatgcggccgcaccaccttcttctgtggcgtcaggctctccggtttctcttgtccggccaaccgatatgatcaccccgaagttcccaagggacgacatgctcttttcgtgaccatgcgtcccctcgacgtcccgaggatgtcacgcctttcgttaccacgaccttaagagcccgcgagaatctacatcccccggatttcaccttccgggtgaggcgatctctcatctggtccgcccttggtcggggtagacaggcgcacccgttcccgggcacgcttgtcttgtagcccagactgacacagccggacgatgacgtccatcacactttagaagaattccaaactagccagcagctcccgcatgtcctgcggcagggggctttcgaatttcaggcgccgcccggtgaccgggtgtacgaagcccagccggcgggcatgcagggcctgccgcgggaagctgcacatggccttgatccgcggatcttccatccgctgcagccgggcggggctgcggccatagaccgggtcgcccaccagcgggtggccgacatgagagaggtggacgcggatctgatgggtccgccccgtctccagccggcaatccagcaccgaggccagaggcttttccgatacctccaccacgccgaccatattggcgatccggtaatgggtcaccgcaggcttgccgccgcgggtgaccacggccatgcgctggcgatcggtggcatggcggccgatattgccctcgatccggccgggatcgaccgccggcacgccccagacgatggcggtataggcgcggcggatggtgtggtcggcgaactgccgggccagggccagatgggcggcatcggtcttcgcgaacacgatcaggccgctggtgtccttgtcgatccggtgcaccacgcccgggcgggtgggggcgccgatcgaggacagccgcccgtcgccatgggccagcagccccgagaccagggtgccgcggtcgttgccggcgcccggatgcaccaccagcccggccggtttgtcgaccacgatcagccactcgtcctcgtaaacgatgtcgagcgccatgggctcgggctcaaggcggcgttcctcgggcaccggcacggtcacggtcagcttctggccgggctttacccgccgggaggcgtcggctatcgtcgcgccgtcgagcgtgacccggccgtcgcggatcagcgcctggacccgcccgcgcgatagcgagggcgcggcattggccagcagccgatccgcccgttcctccgcgaaaccggtcggcagggtgatgtcgaccgtgccgcccagcaccgccgcggcttcgagggccgacagctcgtcgtcgtcgaggccggcctcggcctccgcaaagggctcgtcctcctccgccccggcgtcgtcgtccgggatgaggcccgggtcttcgatgagctccgggtcttcgatgaggtcaggctcttcggtcggatcggaatgggccggcaccgccgtctcgcggggcaggtcgtcgtcgccgggccggcgggaatcgcgtccgctcaaaacatcaactcccttcgggggatcggggacttccagatgaacgacaaggcgcccgagacgatcgaacagcgcatgacccgcattctgaagcgggtgatcatcgggctcggcatcgccatcctggtggtcggtgccggtctaggcgtgctgatataccagcgggcgacgtctaacaaggaccagaagccggcagaggtcccggttgcgacggccccggcgacgccggaggccgccaccccggcgccgcagccggcggcgccgggccagatcgccggcgatttccgcaccgccaacccgcctgccgccccggcccggccgctccgcccggccggcagcgacgggccggcgctgatgccggatgagaaggtcgtcacgctggccgcggcgggcgaggacgtgatgatggtcgccgaaggggccgacggcgcgcaggtgctggtggtgatcgaccgggcctcgggcctgctgatccggcggatcccgctgaacgccgcggctgcggcggccgaggcgaaatgatccgggcgccgcgggtgacgatccgcccggcggcgatgcgggcggcggtcgatacggtcgaagccgcctatccggccgagggctgcggcctgctgctggggcatgtgcgggctgacctgatagaggtggcggaagcagtggcgtcgatcaacgttgccccggatccgcagcgcaatttcgagatcgacccggccctgcgcctgcgtctgcagcgccggtcgcgggaagacggggcggcgccggtgatcggcctctatcacggccatccggacatggcggcctcgccctcggcggccgatctggccggcgcctgggaggcagggctgatctgggtgatcttccgggtcgaggacggccagatgatcgaggcccgctgctggcaactggcggccgacggcagctgcttcatcgagtgcctgctgcgcgtgggcgagggaagacctgccgcctatgggccgccgcggccggtcgagccttgacctggcgccgcctgtaacgatgttcgaccaggggccggcggtatgatgggaccggctccgtcaaaaaacgagacgatgtgtggacgacgatcgcgacgacgaccgcgaggatgcggaactggacggcatcccgggtgacgaggatgacgcaggcggcttgcgcccgggcacccagatcgaggtgaggatcaccgatctgggcagccatggcgacggcatcggctcgtatgagggccagccggtcttcgtgtcccatgccctgccgggcgacctggtggcggcgaccgtggagacggtggaacgcgaccgcatccgtgcccgctggctggaactggtggagccgggccccgtacgggtggagccggcctgcccgcatttcggcccctgcggcggctgcgccctgcagcacatggcgctgcacgactatcgcggctggaagcgcggcctggtcgccgacatcctggcccgcaacggcttcgaagatgcgaaactggcgccgatgctgccggcggagccgcgtgagcgccggcggaccagctggaagctgcgtgccaccgcccgcaaggcggtggtcggctatatggaggccggcagccgccatgtggtcgatgtggagcattgcctgctgctggtgcccgaactcgatcggctgatcccgcagctgcgggccttcatgtccggccccgacggctatccccatccgacccatttccgggacgcccatgccgaggcgaccgaaggcggcgtcgatctggtgctgacgctgtcgcaggcgcccgacgccgaggggctgcaggcgctggcgcgcttcgccgaaaccgccggccttgcccggatctcgtggcggccggagcccgacccggtgcccgagccgcagcgtggcggccgtggccgcaatccgaagggccggcagagaagccccgcccgcgggggggcccgcgccggcaatgcgccggcgatcctggccgagcccgaggtggtggtgcgacgtcaggcgccggtggtccatcgcggcggtgtggcgctggaaccgcccccggccggcttcgcccaggcgaccgccgcgggcgaagaggcgctggtgagcttcgtcgccggcgtcttcggccatgtgatcgaagagggcggcacgatcggcgacttctttgccggctcgggcaccttcgcgctcgccctggcccatcgcggcgcgcgggtgatcgcggccgaggtggaagggccggcgctggacgccctctctcgcgccgctgccgcggccggattgtccgaccgggtgacggtggagccgcgcgacctgatgcgctggccgccctctgcccgcgatctcgccatcctggacgcagcggtgttcgatccgccgcgggcgggcgcgcgggcgctgacggaacagctggccgcctcgggcgttccgctgatcgccgcggtgtcgtgcaatccggtgaccttcgtgcgtgacgcgaagatcctggccgcggccggctaccggctggtccgggtgatgccggtcgaccagttcctgtggtcgcgccatgtggagcttgcggccgaattccggctggatccggcgttggcggcagcccgtggcggcaccgggcggcaggcgccgcgtgacgacccgcatgccccgccgcgtggccggggcgcggccaagaccgatcgtggtccgaagcagagggggatgcgatgaattttcacagcgatcatgtcgtgggcgcccatcccaaggtgatggaggcgctggtcgccgccaatcagggctctgtcccgtcctacggcaatgatccggtctcggcggcgctggaagaggatctggcggtgctgttcggccgcgaggtccgggtgttcatgacgcccaccggcaccgccgccaatgcgctgtcgctggcggcgctgaccccgcgctggggcacgatctatgcccatagcgaagcgcatgtggagatggatgaatgcgcggcgccggaattctataccggcggcgccaagctctcgctcgtgcccggtgatcacggccggatggatctggaccagctggcggcgcgactggccgcggcgccgcgcggcttcgttcatgccgcccagccggcggcgatcacgctgacccaggcgaccgaggccggtacggtctacacccccgatcaagtgcggcgggcgggcgcgatcgcccgcgagcagggcgtgcggctgcatatggatggcgcccgcttcgccaatgcctgcgtgcatctgggcgtggcgccggccgaaatcacctgggatgcgggtgtcgacgtgttgagcttcggctcggccaagaacggcacgctgggggccgaggcggtggtggtcttcgaccccgagcttgccgaggcgatgggctatctgcgcaagcgcgccggcctgctgatccccaagatgcgcttcctgtcggcccagttccgcgcctatctggcaggtgatctctggctgtcgctggccggccatgccaatgccatggccacccggctggcccatggcctgcagtcgttgcccggcgtttcgctcgcccatccggtggaggcgaacgagctgttcgtcgatctggccgaaccggccgtcgcggcgctggagaaggcaggcgccggcttctatcgctgggccgagcccgcgcccggcacggtgcgcatccgcttggtcacctcgtgggcgaccgatccggcggaggtcgaccgtttcctggatcatgcctcgatcgcggccgcccacggccggcgctgaggaggccgaggcgggccgggacggcgcgaagccgttgattttccggccccctgatcctcccggaaatatttcgtcatctgaccttcattttttctcttgcacggcctgactgctggctgtaaatatccgcccacacgacgacgcccccatcgtctagcggtccaggacgccgccctctcacggcggaaacaggggttcgattccccttgggggtgccaatcctcaagcgtcgtcagcgaaacgccgcgcggatctcacgatccagcgcggcgtttcgcatttctggacttggcttcattttccctgatcttcagcatacgccgccggatcttgccgggctgccgccgcgcttgtcctcttccccggccgggcctatcgtgcccgggcccaggatttctcagaccagaattgctcagagaggaggccccgcggtgagcgacaacctctacgcccgtatccgtgcccgtttcccggccgacccggcccggccgatgctctaccggcccgatggcagcgtgctcacctatggcgatgccgaccggatctcgggccaggtcgcggccctgctcgaccagatgggcgtcgcccccggcgatcgggtggcggtgcaggtcgacaaatcgccgatggcgctgatgctctatctgggctgcctgcggcgcggcgcggtctatctgccgctcaacaccgcctacaagccggccgagcttgaatacttcatcgacgatgccgagccgcggctggtggtttgccggcccgaagcggaaaccgcggtccggaccatgaccaatggccggccgatcgaggtggcgaccctggatgccaccggcgacggcgccttcgccgaccgggtccgcgccacggcgaccgtggccgagccggtcgcccgcagccgcgacgatcttgccgccatcctctattcctcgggcaccaccggccggcccaagggggtgatgctgtcgggcgagaacctctggagcaatgcagagacgctggtggatgcctggggcttcaccgatcgcgacgtgctgctgcacatgctgccgatcttccacacccacggcctgttcgtcgccacccattgcgtgctgctgtcgggcgccgccatgctgttcgagccgaaattcgatgcagcccgggcgctggcgctgatgcccagggcgaccgtgatgatgggcgtgccgaccttctatgtccgcctgctggccgaagccgggctcacccgcgacgccaccgcccatatgcgcctgttcgtctcgggctcggcaccgctgctgcccgaaaccttcgcccggttcgaagccgtcaccggccatcgcattcttgaacgctatggcatgacggaaaccaatatgaacacctccaacccctatgacggcgatcgccgccagggcacggtcggccggccgctgccgggggtggagctgcgcatcaccggcgaggatggcagcccggtggcggcgggcgaggcgggcatgatcgagctgaagggcccgaacgtgttcaagggctattggcgcaagcccgagaagaccgccgaggatttcaccgccgacggcttcttccgcagcggcgatatcggtaccatcgacggtgacggctatgtctcgatcgtcggccgggccaaggatctggtgatctcgggcgggttcaacgtctaccccaaggagatcgagctggtcatcgaccggatcccgggggtggacgaaagcgccgtgatcggcgtgccgcaccccgatttcggcgaggccgtggtggcggtggtggtgcgcgaggccggggccgatgcgcccgacgaggccggcgtgctggcggtcacccgcgatcagctggccaatttcaagcagcccaagcgggtgctgtttgcggccgaactgccgcgcaacgccatgggcaaggtgcagaagaacctgctgcgcgacgctcatcagggcctcttcgccggctgatcgcgccgcggcgcttgcatccgcccggaggcgggggcatgtgaagggagacgggggaaggcgcctcgttctcccgcgctcccgtccccgtgttttttcaaggtccgcaaccggaaggccggcaccatgcgtatcgacgtgatttccgacaccgtctgcccctggtgcttcatcggcaagcgccggcttgaagaggcactggagatgttcgcggagcacccggctgcccagccggtggaggtgcgctggcatcccttccagctgaacccggccatgccgcgcgagggcaccgaccgggccggctatctggcggccaagttcggcgggcccgagcgtgccgcccagatctatggccgcatccgtgccgccggcgccgaagcgggcatcgacatcgatcccgagcgcgcggcggtgatgccgaacacgctcgacagccaccgcctgatccaccgcatgcagctgcgcgatctggcggcggccgatggcggcaatcgcggcgaccgggtggtcgaggcgctgttcaccgcctttttcgagcagggccgcaatatcggcgatgcggcggtgctgaccgagatcggcctggcggtcgaccccgaggacaccgatctcggcgcatggctcgcctctgacgaagaccgcgacatgatggccgaggccgatgcccaggcgcggcggatcggcgtcgacggcgtgccctgtttcatcatcgacggccgctgggcggtgatgggcgcgcaggcgcccgagcagatgatgatggccctggtccgcgccgccaccaacccggccggcggcggcgtcgccgatgacggcgagggcgagatgtcggacgacgacgctgatggcgacggctgctcgcccgaggatggctgcgcagtgccgccgcgctgatcccggcttccgtcggggtcagctgccgagcaaagtgagggcgagagagacggtcgcgaccgagcccagggtcgagaccaggatcgcggccgaaatccggctggtatccatccggtactgatcggccagtacgaaaaccgacaccgcgatcggcagcgacgcctccagcaccaggatccggaccagcagcgggtcgagcgcgaagacgatggtggccatccccagcaccagcagggggtggaccacgatcttgagcagagccagccccgagacctcgatcatgccgcgggcgagcgagcagccggcgaggttggcgcccagcgcgaacagcgcgcaaggggccgccgccaggccgacgaggttgccataggccgcaaccggcttgggcagcggcagccccgagacgccgtaaagcgcgccggccacgatggtcaggatcagcgggttgaaggccagcccgcgggcgatcttgatcagggcccgcttcagcccgccgccggccgcgcgctcgctttcgatcagcagcacggtcagccccatcatcagcacatggtcgagcacgatgatggtcatcgccggggcggcggcttccgggccgaaggcgaagatcaccagcggcaggcccatatagccgacattcgaaaaggtggcgcccagcccgcggatccctgagatcgcaggacccccgccgaacagccggcgcccgcccacaaccgcgatcgcatagacgatcagcccggcgccgtaataggcaccgatcagcttgggatcgagcagccggtcgagcgggatttccgcgaccttcacgaacaggaagggcggcagcgccacccaataggtgaaccggttgagcccggccagcccgcccgcatcgatgaatcgccgccggccgacgatccagccggtcagaatcaccgcgaagaacggcaggcatacatcgatcaggatctgcatatctcggtctgtctcgggatagggacttccaggcggccgaaggcagcggccgatcctgaccggggggcccgcacattgcaagcccaccacaccttaagcgataacatgtggaccataactcgccataagcttgacagcgggggcgggaagggtcgattatcacgaacaggttgaatggtcctgtcaccggatcgatcaggcggggacgcgatgggggatcgctacccgtcaggccgccggtgagcctggtggtccgtcttctgtaccggacaatggtacgcgcatggcccttgtccggccttccgttcacgagcaaattccgggcggacttcggtccgcccgctttttttgtctgccgcggcacggcgagtgctgcgtggcagccttgcaggcgcgactgctcgcaagcccgcaccggctgcgctatagtgcgccgcgccggcccgggccggcacacccatgcgacccacgcccatgcgactcttcgaggagcggcccttcccatgagcggcaagcccaccgtattcatcgacggcgaggccgggaccaccggcctgcagatccgggcacgtctggccgggcgcgaggatctcgcgctggtctcgattgcccccgagcgtcgcaaggatccggctgagcgtcgacgcctgctgaacgaggtcgacctcgcgatcctctgcctgcccgatgcggcggcggtcgaaagcgtctcgatgatcgagaatccggccgtgaaggtgctcgacgcctccaccgcccacagggtcaaggatggctggagctacggcttcgccgagctgctgcccggccagcgggcggccatcgccgccgccacccgtgtcgccaatcccggctgctatccgaccggtttcaccgccctggtgcggccgctggtcgatgccgggatcatcgcggccgatgcggcgctgtcggtcaatgccgtctcgggcttttcgggcggtggccggcagatggtggaagattacgaggcagctgccccggtcggacgcgaggcggcctatccctatggtgactacgccctggggctggagcacaagcacctgcccgaaatggcggtctatggcggccttgccgccgcaccgctgttcgtgccggcggtcggccacttcaaatgcggcatgctggtgcatgtgccactgacccgggcccagctggcgaaggcggcgacggtggcggatgtgcaggcgctgctggccgaacgctataccggcgagcgcttcgtcagcgtcgcccccttgggcggcggcgaccgtctgcgcgacggcaagttcctggacccgcgcgagctgaacggcaccaatcggctggagctgttcgtgttcggcaacgatgctgccggccagatcctgctggccgcccggctggacaatctgggcaagggcgcctcgggtgccgcggtccagaacctcaacctgatgctgggcctcgacgaggcggcgggtctggagaccacgctgccgctctccgagacgacgatgtaagcccgtcctttcaggctcagaacgacaaagacggctgttccgcatcggcggaacagccgtcagttcgttcatcgcggggtcggcccgcgcaggatccgtgccggtccgggaccagagaccggggaacgggcgggatggcgggctgggctcaggcgccaggatcgggggacgatccgccatcccttcgggccgacggtgcacgatcgacatagccggagcctaggatgaaggcgcggcgtcgtcaatcctcttgcgacatcatcaaaattgctatgcgcgccatagtggcaatgtgttcttagaagcttggcggcgtgcaggcggagacgatttcggcttcctcctcgccgacattgcggaagcggtggggcaggcggctgtcgaagtaatagccgtcgccggcttccagcacgcagctttcgccgccgaccgtcagttcgatccggccgcggaccacgatcccaccttcttccgattcatggcgcagcaactgcttgccggtatcggccccgggggcgtagcgctcgtgcaggatctgcatccgccgccggctcagattctcgccgatctgggcataggcgaccgagccgcgggcaatctgggtcagttcatcggcccgatagaaggcccgctgccgggtggtgaggtcgagcgagaagaactccgacagcgagatcggaatcccctccagcaccttcttcagcgatccgaccgaggggctgaccttgtcctgctcgatcagcgagatggtcgcattggtcaccccggcccgcttggccagttcgcgctgcgacagaccgtagatctgtcggatggtcttgaggcgcgtgcccagatcgccgctcatcgtcccgcttctccctgttccttgccggccgccctgccggttcctgttcaagatatttgacattccatgggttccgcaacgcaaaatcaatagcttgcatctcccatggaaatcactttgtcgagtttaattgtcaatgctaggctgtttcacaggatgagaggcacggccagacggctgccgccgctcatctccccagccgccattgcggcggcggccaagggcgcggcagcgcccgcccggcgagggactaacaaccactcccagccgccattgcggcggcggccaagggcgcggcagcgcccgcccggcgaggggctgacaaaccaacaggagcgacgcggtcatggcgcgcatcacggttccgaacgatctggacgcgcattggatgccgttcacggccaatcgccagttcaaggcggcgccccgcctgctggtcggggcgaaggacatgtactacacctcgcatgacggccgtcaggtgctggacggctgcgcgggtctgtggtgcgtgaatgccggccatggccgggacaagatttccgaggcggtcgcccgtcagatctcggagatggattattcgccctcgttccagatgggccatccgctgagcttcgagctggcgagccgcctggtcgagctggcgcccgacggcatcgaccatgtgttctactgcaattccggctcggaagcggtcgacacggcgctgaagatggcgctcgcctatcaccgcatccgcggcgagggcagccgcacccgtctgatcggccgtgagcgcggctatcacggtgtcggcttcggcggcatttcggtgggcggcatcgtctccaaccgcaagcatttcggcacgcttctgtcgggcgtcgaccatctgcgtcacacccatgatccggcccgcaacgccttctcgtggggccagcccgagcatggggcggagctggccgacgatctggagcggctggtggcactgcacgatgcctcgaccattgcggcggtgatcgtggagccgatcgcgggctcgaccggcgtgctgatcccgccgaagggctacctcaagcgcctgcgcgagatctgcgaccgtcacggcatcctgctgatcttcgacgaggtcatctgcggcttcggccggaccggcaaggccttcggcgccgacagcttcgaggtgacgccggatctgatgaccaccgccaagggcatcaccaatggtgcggtgccgatgggcgcggtcttcgcgaagaaggaaatctacgacaccttcatgaccgggcccgagcacctgatcgagttcttccacggctacacctattcgggccatccgctggcctgtgcggcggcgctcgccacgctcgacatctatgccgaggagaagctgttcgatcgggcggcgaacctgtcggagtatttcggcaaggcggcgcatgcgctgcgcgatctgccgaacgtcatcgacatccgcaattacggcatggtcgccgcggtcgagctgtcgccgcgggcgggtgagccgaccaagcgggcctatgagatcttcgtgcgcgcctatgagcagggcgtgctgctgcgcttcaccggcgacatcatcgccatctcgccgccgctgatcatcgacgaagcccagatcgaccatctttatgcggtcctggccgaggccatcaaggcgaccgcctgatccgccgtcatccgaccggcgttgtcgtcgccgatccgcatcccccgcccgggtattccccgggcggtctggcccaggccggcacaagacccggcggcccggagatgcggaggcggcgctgcgtctttcctggggaggaaacaccatgcttctgggcgtgcccaaagagattaagaccgacgaataccgcgtcggcctgacccccgccgccgtgcgcgaactggtccatcacggccataacgtgctggtggagcagggggcggggctcggcgccgggctcgacgatgcggcctacgaggcggccggcgccaccatcgccgccgatgccgaagaggtcttcgcccgcggcgagatgatcgtgaaggtcaaggagccgcagccggtggaatgccgcaggctccgccccggccagctgctgttcacctatctgcatctggcgcccgatcccgaacagacccggctgctgctggcaagcggcgccaccgccatcgcctacgagaccgtcaccgacgcggccggccgcctgccgctgctggcgccgatgagcgaggtcgccggccgcatgtcggttcaggccgctgcccatgcgctggaaaagacccagggcgggcgcggcgtgctgatgggcggcgtgccgggcgtgcgcccggcgcgggtggtggtgctgggcggcggcgttgtcggcaccaatgccgcccgcctcgccatcgggcttggtgccgaggtggtggtgatcgaccgctcgctcggccggctgaaggaactggatgcgctttacggcccggccatgcgcaccctttatgccacccgcgagaccatcgaagaggccgtgacaacggccgatgcggtgatcggtgcggtgctggtgccgggggcggcggcgcccaaactcatcgaccggccgctcctggggcgcatgcagccgggggcggtgctggtcgacgtcgccatcgaccaggggggctgtttcgaaacctcgcgcgccaccacccatcgccagccgacctacgaggtggacggcatcgtccattactgcgtcgctaacatgccgggcggtgttgcccgcacctcgaccttcgcgctcaacaacgcgaccctgcctttcgtgctggccctcgccgacaagggcgccgcccgggcactggccgaggatccgcatctgatgaacggtctgaacgtccatgccggacagctgaccatcgaggccgtggccgaggcccagaacctgaccgccgtcacccccgccgacgcgctctcgcgcgccgcctgacggccggccgggttgctcccgcctggacctcgccaccgtccgacgcccgcaggcctggcctgcgggcgtcggttcttttcggggccgtccggcaaggctattctgaaatgcaccagttcagccaaggggtgcatcatgagcacggccgaaccgcagctgcctccgccccggaaggagcccaacgaagccacgatgcaggccatggccgagctgaaggcgggcaagggcgtgagattcgacacggttgcagatcttatggcggatctgacggcggaggactgaccgtccgagacggcagacgctctgctcctcacaccccccgccgcgtcaacctgatcgccgcgatgatgccgatcagcccgaccggcaggaaggcggcgaagacccagaagccgacggtctctgccgtggcggggtcgggcagggcgccaccatgggcgccgccgaagcccgagaggttggcggcgataccggcggcggcggcgccgagcgcatagcccaggatctgcatggtcggcacggccgaggaggcgctttcacggacctcgtcgggcacggcggagacgatccggcggaccaggaaggcccagcacatgccgaagcctgcgccctgggctgccgcgaagggtgccaccatccacagctcgccatggggcacgaccaccgcgaagccggcgacgcccgccacgatcaccagggcgccggcgcggatcagccagggctccagccgggcgccggcgcctgagagggtgatcgcggccagcgtccaggcgacgctttcgatcgcgaccagatagcccgcggtcagggcatcggccccatgcagcaccacgaacaggatcggcccgtagacggtgaagggcacggttgcggccgagagggtcagcaccatggcgagccccatgccctggcggcggcgcaggtcgagcgcacccggcggcagcaggccctggcccagcggcgcccggccgtcccggcggaagaacagggtgagcagggcaaggccggccaggcccgagagggcagcggtcagggcgtcgccggtgacgccggcggtcgccactgccagcaccgccacgatcagcagggcgagccggccggtcggaaccgcggccgagggcagggcatgggctgcgcccgatgtggcggcggcttcggcggctgccgtcacccggcggagcagcagcccgccggccacggccaccagggcggcctgagcgccgaaggcccagaaggcgccgcgccagtggccggcatcggcgaacagcccgccgaccagtggcccggcgagcgcggaggccccccacagccccgacatgatcgcatagagcctgggccagagcctgggttcgtaaagccgcgacaccgagacatgggccagcgccaccagcatgccgccgcccagcccctgcaccagccggccggcaagcagcgtgcccatatcgggggcgacggcgctgacgacgcagccgaccgcgaaggcggtggccgccatggtggtggcccggcccagcccggccgcgcgggcggcaagcccggtgcaggccccggccacgatcgaccccagctcgtagagcgccagcgcccagttcacccaggcgagcccgccgatttccgccgtcaccgccggcatgaccgtggtggtcagcaggctgtcggcggcgtgcagccagatgcccaggcacagcaccatgaaggcgccgaaacgtccgccgcggcggatctcggcccattcactggccgggcggggggtgcgggcatggcctgcggggggcatggtacttcctttttccaagttcttacttgttttaattcaggagggccggcacggcaagggtgaaagccgggggcttcaagccctgcctgtggtgcaggtcggcctgtatttcaagcattcctcaccggtggatatctcggctaatcttctttaaatcaaaaacacacaatagtcttgatgcatctggagaaaatcgcctcctcatgaaaaaattgaagctttatgccgcgctcgatcacttgggattgcgccggtcttatgtcggtaaaatgctggcgatcagctttgtcggcgtccatgtgcctcttatttgtcttgtcatctatctcatgcttgccggggatctgccctggaaccaggcgcagccggtgctggcggtggtgctgctggcgacgctcgccgggacaggggcgacgctctgggcgcttcattgtctgctcgatccggtgcgactggcctcgcgtgccctgcatgactatatgcgcggcggtcgggttccctcgctgccgaccggccatgttgacgaggccggccggctgatggccgatgtgcaggaggcggtgacccggctggccgccgcgctggatgccgtccatgccgaacgcggccggctgatcgacgagcgtcaggcgcatttcgaaatgctctcgcggatgagccacgagctgcgcaccccgctgaatgccattctgggtttcgccgaggtgatccagggcgagatgatggggccggtgggggcgcgggcctattccgattatgccgggctgatccacagcagcggcggcgatctgctccatatggtcgacgggctgctgaagatgagcgaggccaaggccggcccggtccgcggcggtcctgcccgcgacgggttggagccggtggatctgcatcagctgctgggcgaggtcgccaatctgcagctggtccatgccgggcggcgcgaggtggtggtgaccgtggtgccccagatggcgccggggggagccgctccggcaccgggcctggttatggaagacccgcggatcctgaaacagctgctgatgttcaccctgtcgggcctgatcgccggcacggagcggggccgggaggttcggatcgaactgcggcaggcacccggcggccggccggaagtcgccgtctcggccccgggtggatttaccggccacgatctgccccggtcgattgcccctgccattaccggcgatctgccgcccgagatggccggcgccgatgatttcggccacgtctcggtccagggcttcaccctggcggtcgcccatgccatcgcggtggcggagcggatcggcatgaccatcgcgccgggcagccatggtcgacgggtcgccttggattttgcgccggcggcctgagatgtggccagatcagatccggaaccggtcgagcgtcaacccctcggtcgaaatctcgggcgtgcggcccgagaccagatcggcgaccaggcggcccgatccggcggccatcgtccagcccagcgtgccatggccggtgttgaggaacaggttgcggaagcgggtcgggccgatcaccggcacgccgtcggggctggccggcctgagcccgcaccagtagtccggcaccgcgtcgcgcgcaatctcagggaacaccgcctgcacgcccttcaggatcgcctgcgagcgtacccggttgaggctgagatcatagccggcaagctctgccgtgccggcggcgcgcagccggtcgcccagccgggtgaagacgatccggcgggcatcgtcggtcaggctgccctggggcgcgtcgttgcggccggcgacgttcagcgtgaccgaatagcccttcagcggatagaccggcaggcggatgccgatccggcgcagcagcagcggcgtgaaactgcccatggcggcgaccagggcatcggcctcgatccgcgtgcccatgtcgagccgcacggcggtgacccggtcgccgctggtttccagggcctcgacactccggccatagagcaggcggccgcctttggccgcgaccctctcggccaggtttgcggtgaacagccgggcatcgccctgctcgtcgatcgggctcaacacgccgccggccagccgggtctgcaccggtgccagggcgggttcatgggcgacgcactcggccgggctcatcacccggtgggggatgccgagcgtgcggtccagctcggccgcatggcggccggcggcgtcgaagcccttcgggtcttcgaaaacatgcaggatgccgcggctcgcctcgtcatacgcgaagccttcggcggcgcggatcgccttcatgccgtcgagggaatagcgggccagccgccaggcgcgttcggtgttgcggcgcgcggccgcccgggtgcaattggccaggaaccgcaggccgaagcgccagagatccggatcggcgcgccagcggaacaccagcggcgcatcctcgcgcagcagccagccgggcaacgatttcagcgtggcggggttggcccagggctcggcatggctggggctgatctggccgccattggcgaagctcgtttccagcccggggcccatcctgcggtctatgaccgtgacctcgtgcccctgatcggcaaggtgccaggcggtggcgatgcccaccaccccggcgcccagaaccaccaccttcacgaacgcacccctccgatggcagcggatatgccggcagacctgcgaccgcgcgccgccttgtccggcgcaggcgccccaggatataagcccctctggcgttcgggccaagctttccgccaggatcgacccatgatacggacctcaaccggaagggaagacggatgacgcggacgatctggatcatcggcacgctgggcgcgctgatcgccgtggcggcaggcgccttcgccacccacgggctggaacaggcaggcgatctgcacaccgcgcagatcgtgcgcaccggcgcgctttacggcctggtccattccctggtgctgatgctgctcgcggtgctgcggccgctggtcgatcgcgggctggtggcgctcgacgtccggttgctgatggccgcggccggcgcgctggcggccggcgcgatcctgtttcccggcagcctgtatctctatgccgccaccggctggcggccgctggtcttcgtgacgccggtgggcggcaccgcctttctgatcggctgggtgctggcgacgctggcggcgctgaagcggccccggaagcgctgatccatcgacgccgatatatcgatatcgatgtatcgggcgcggggtaacttcatcgacgtcgatgtatcgatgtcgatgcatccgatcgaccttcgggcgtgcgcccgtgtgtgcgatgcaacttttgcgcggtcgaacatcgcttgaaattttgcttaatggtttaatgccttgaacccgtcggtcgcgatgctaccctctggccagagatgaggctttcacgggaccagacgggccatggaccagaccacgcagccggccaaattcacgggcaccgacagctacgttgcgaccgaggacctgatgatggcggtcaatgccgcactcaccctcggccgtccgctgctgatcaagggtgaacccggcaccggcaagaccatgctggcggaagaggtggcgcgcgcccttggccggcagcttcaccagtggcatgtgaagtcgaccagcaaggcgcagcagggcctgtacgaatacgatgccgtttcgcgcctgcgcgacagccagctgggcgacgaccgggtcaaggacgtcagcaactacatcctgcgcggcgcgctgtgggaggccttcgccagcgaagagccctcggtcgtgctgatcgacgagatcgacaaggccgatatcgagttcccgaatgacctgcttcgcgaactcgaccggatggagttctacgtttacgaaacccgcgagaccgtgcgcgccgtgcaccggccgctggtgatcatcacctcgaacaacgagaaggagctgcccgacgccttcctgcgccgctgcttcttccacttcatctccttccccgatgccgacaccatgcgcgccatcgtcgacgtgcattatccgggcatcaagcagctgctggtcaaggaagcgctggagatcttcttcagcgtgcgcgagatgccggggctgaagaagaagccgtcgacctcggaactgctcgactggctgaagctgctgctggccgaggatctggacgctgagacgctgcgcgagtccaaggacaaggccctgccgccgctctatggcgcgctgatcaagaacgagcaggacgtgtcgctggcccagcgcctggtgttcatggcccgccgccgggccgaaggccccggccgtccgggctgaggccgggggcagagggcaggcattggtgcacaggtcgaggcgagagggcgggtccggatgctgatcgatttcttcttcaagcttcgcgaggcgaagctgccggtcacgatcaaggaatatctggtcctgatcgagggcatgaaggccgggctcgcccagttctcccctgaggagttctactatctcgcccgcacctcgctggtgaagaacgagaagcatttcgaccgcttcgaccaggtcttcgccgcctattacaagggcgcccaggcgcatttcgcggccatcgaggggcagatccccgaggaatggctgcgcaagctggccgaaaagcatctcacccccgaagagatggccgagatcgaggccctgggcggctgggaaaagctgatggagacgctgaagcagcgtctggaagagcagaaggggcgccatcagggcggcaataaatggatcggcacggccggtaccagccccttcggcgcctatggctacaacccggaaggcgtgcgcatcggccaggaccggtcgcgccaccgccgggcggtgaaggtctgggatcagcgggctttcaagaattacgacgacgatgtcgagctgggcacgcgcaacatcaaggtggcgctgaagcggctgcgcgccttcgtgcgcgaaggctccgatctggaactggatctcgacgacacgatccgctccacggcgcgcaatgccggctggctggacctgaagctggtgccggaaaagcgcaacaaggtgaaggtgctgctgttcctggatgtcggcggatcgatggacgatcacgtcaagatctgcgaagagctgttcagtgccgcgcgcaccgagctgaagcacctggaatattattacttccacaacttcatttacgagaatgtgtggaaggacaattatcgccgcttctcggaacgcacgccgaccatggacgtgctgaacaagttcggccccgactacaaggtgatcttcgtcggcgatgcgaccatgagcgcctatgagatcgtgatgccgggcggatcggtcgaacactggaacgaggaatcgggccaggtctggctgaagcgcttcaccgaccatttcccgaagatggtctggctgaaccccgaaccccagcagcgctggcgctataccgaaagcgccaagatcacccagaagctgatggaggaccggatgtatccgctgaccctgcgcggcctggacgaggcgttgcgctatctgagccgttgatgcgtgcgtcaccgggcttgatggttgcgcttgagcggctttcgacgttatagttgcgtccaacgaactgcgagaacgacggttcgagaatcgtgccacgaaaatcaaacggccaggggcttcccaggcctgtcggaacacgctgccggcctgaccggacggtggtgtccgcgtttttcgaatggtggcacgatggtgtcttctacatcagacagggacccgatgcggttcctcaggtcaaggacggcaccgtcggcgtggagcgatccgccgacggtgcccaggcatgtgtccgacgcgaccatcgaacgcctgaaggccgcggccatcgccgggcccgaggcaggtggcggcggccgtttcggcatcggcggcgccgcagcttcgaccagtcttccccttctctacacggcatcagccgatcgcgcgtcggatgtgtccgatcaggacgatccctttctggccggcctgcgcgatctgcgcgcggcacttgcagccctgtttcgcctgatgggcatgagccctgccgaggcggcaggtgtcgcagacaaggccgtggcaggcgaagacctccccaaggggcagagcgaccgcgtcccggcgacgggcggtacggcagcggcctcgttcgggcttgcgggcgtcgctgtcgaggacggcgcggctgcccggcttggagaggccatggccaagggtgcccaggcactgcacggagagctgatcgccctgctgatgcggctggggctcgatccctcggcggcacggatcgcagcctcgcggctgcttgccggcatcgcggcatcgggcggtaccggcggcgcctctccgtcgagcctgcttgcggatatccgcaggggcgtgccgccagccgcaggggcggtcggactggccgtcggggtgaaggatctcagcctcgcccgggatgcgacccatgtgcatcttcatctgggcagccttgtcctgcgcggcttcccgcttgcctccgacggggtgcggcttgtccggtccgacgcctcgggcctgcgtcttaccgcggatctggtgataccgaccggtgtgccgctggagggcgaggccggcgtcattcggccgcaagtgcgctgaccgggtccatgccggccgccttgcgggccggcagccagccgaagatcacaccggtcagaaaggcgcagccgaaggctgcgaccgccgggccgggccggatgacgacgtcgaagccgttgcgggcaaggatgagggccgcaccggtgcccagtgccacgccgatgatcccgcccaggccgcaaaccacgacggcttcgacgttgaactgggtgagcacgtcgcggcggcgggcgccggtggccatgcggatgccgatttcgcgggtgcgctcggtgacgccgaccagcatgatgttcatgacgccgatgccgccgaccagcagggaaattgcggccacggctccgaggagcatcgcgaaactgcgctgactttccgacagggcctgctgggccgcggcgctgtcagcgatctggaaattccggatgccgtgccgcgccatcatcagacggtcgatatccgcggcggccgtggccatacgatcggcctgatcgaccttcacggtgacggagctcagataaggtttgccgaggatccgcaggaagcccgccgagagcggaatgagcgcgagatcatcgagatcgttgccccattggtcggcaccgcgggtgctcaggataccgatgacctgaaagggcatgttccggatcaccagcaagcgcccggtgggatcgggggtgtcggggaacaggttgtgggcgaccgtccggcccagcatcacgaccgcaccgtagtcggcgacatcttcggcagtgatgaagcggcccgtgaccgcccgccaattgcgaaccattgcgacatccggccagacaccgtggaccatggtgatatagtcggtagcgcctgcgcgcagcgtggtccgcagacttcggaccggcgagaccgcggtcaatccttcgatgccccgtatggcctggacatcttcgaccgtcagcgacgtgagatcggcggtgctgcgcacgccgggcgcgcccggcctgaccgtcagcagatttgtccccatcttctccagtcgggcgagggttgcctctgcgccaccttcaccgaccgcaagcattgcgatcaccgaggcgacgccgatcatcacaccaaagagggtgagcagggtgcggaacgggtcacgccacagcgaccttaatgccgtgcgggcagccgcaatcgacatgtccagatggcggcgtcctggctgcggtggcggggacgcagatgttccggtgcgtatgtggtctggcgggttttccgggcaccgcgtctcgtggcgggctatccgtccgtcggccatgtggatcagccgccgggctctcgcggccacctgcggatcatgcgtcacgatgatgatcgtccgaccttcgcggttcagctcttccaactggcggagcacgtcctcgctgctggcggcatcgagtgctcccgtcggctcgtctgccaggatgacctcggcatcgttgatcaaagcgcgggcaatcgagacacgctgttgctggcccccagacagctccgcggggcggtggtagagacgatcgcccagcccgagccgggagagcagttccgatgcccgtgcccgccgccattccgccggaaccccggcataaagtgccgggagttcggcattttcgatggcagtcgcatcggagagcaggttgtaacgctgaaagatgaagccgaagaggcgattgcgcagggctgcaagctcgtcaggctccagagtcgccgtatcccgcccgtcgaccaggcattgtccgctgcttggctggtcgaggcaaccgaggatgttcatcagcgtgctcttgccagagccggagacacctgtgatcgcgatcatctcgccgcgatggatgtcgagggaaatgtcgtcgagggcgacgacgccaccgatggcggtaaagcgccgcgagacgctgcgcagcctgaagaggggcggggtggtggtcatcttggcgctgccgcggccggtgcccggccgcttgcgccccagtcgccgacccgggcggtcagcgtcccgggatcgtgggcattgatcggcaggacggtgtcgccgacgttgagccccgacgtgatcgcggccagaccctgagcgacgacgtccaccgccaccctgcggctttcgatccggccatccgccagacgcacatgcacgcggtcgccgtcttccctgcgatcgagtgccgtcagtgggatgagcggctgatcgacggcctgatccagaacgaagaagacctgggcggtcatgctggtcatcagcgcaccatcgggattggcgacgtcgaccagcacgtcatagagtacgacgtcgttcagggtctgcggggtcgggaggatctggcgaacccggctgtgccagacgcggtcgggccggccgagggtcgagaagcggaccggctgaccgggggcaagacgtaccacatctgcctcgaccacctgtgccctgaccgtcatcgtcgcaagatcggccagtctcaggatgatcggggatgtctggttggcattgagcgtctggccgaccacagaggtctgagagacgacggtcccgtcgatgggggccagaatgcgggtgtaggacaggttggtgcggtcgccgtcgagggtggatcgcgcctcgccgatctgggcttcgatggctgcgatcgcagcctcggcgatgatgagattggccgcgctggtatcggcgtcctcgcggctggcggcacggccttcgaacagccgacggatccgcgcctcacgcaagcgtgccagatcacgttcggcctttgcctggcggagctgggcttccagattgagcagccgcgcctcgtcgccggtcacccgggtctcgtagattctgggatcgatctcggcgagcagcgtacctcgggtgaccgcgtcgccgacacccacatggaccgcgcgcagctgtcccgatacctgggtgccgacgtcgacgaaaacccggggctccacgacgccaagggccgagatcgtccgttcgatggtgccgcggacgaccttcagcccggccggggcttcgtcagcggccgtggcaggcaggggcgggatcagccggtccgaccagtggccgatgccgaccccggccgaaaacagaacgaggcccgcgacaaggacggccgggcgtcgtcgggaaggggctgaaggatgcgacatcgggtccggtgctgtccgtggctctcggcggcagggtccggaacatgatatgcagctggatgccggtcgccagggtggaaatcgcgaggtcgcggattgatcgccgcgccggccggcgtttcaatgagagcatcccggttcgccggcccatccccgcgcaaggattgctgcccatgggcaagaaggacaagaagcagaagaaggccgaagaggccgagcgcaaggccaaggccgaggcggcggactggcgcgaagatgcgcaggttgcagagccggagctggagaagggtgaagggcccgaggcggcgctgaagcggctgcaggatcagcttatcatgctgcagcatgcctatgtcatccacggccatcgcggtatcgtggtgctggaggggtgggatgccgccggcaagggcgggttgatccgccggatcggctggtgcctggacccgaggcatctgcgggtgcattcgatcggtgcgccgagccagggcgagaagcgccagcactggatgcagcgcttctggacgcgggtgccggaaagcggccgcatggcgatcttcgaccggtcgtggtacggccgggtgctggtagagcggatcgagggcttcgccaccgaatccgaatggacccgggcctatgacgaaatccgcgctttcgagacaacgctgctggacgagggtatccacatcgtcaagctgctgctcgacatcacgcccgaaacccagctcgaccggctgcaatcgcgctacgacaacccggaaaagcgctggaagctgaccgaagacgatctgcgcaaccgcgcccgctggcgcgattacgagatcgcctatggtgagatggtggagcggacctcgctgccccgggcgccctggcagcgcatcgacgccaacgacaaggacatggcccgggtcgccgccttcgaggcgatcatcaagggcctgggcgacggcgtggatgtcagcgagccgacggtgccgccgttgatccgcgccttcttcggcgacccctcctgacccggcggccgcttccatgccggaaattgcctggccgacgccctatctcgacgtggctagcgcgctggccatcggcgcgctgatcggcttcgagcgcgagaagcacaaggccgacgaacatctccagggcgcgctcggcctcaggagtttcatcatcgcggcgctggccggtgccgtcggcgcgctgatgacccgcgcgatcgacagcccctggccgctggtggcggtgctgctggcggtctcgggcgtggtggtcgcctcctatgtggtggaggtttcgctcgatccgcgcaaatcgggggcgaccaccgaactcgccgccgtcgcgaccacggctctcgcggcactggcggtgctggggcatcgcgacatggcggtgccgctggcggtggcctgtgcggcggcgctggcgttcaagaagccgctccgccgggtggtgaagggcttcgacaaggccgatctgctgggcatgatgaagctgctgatcgcaagcttcatcgtgctgccgttgctgcccgaccgcacgctcgacccgttcgacgcgctcaacccctaccggctgtggctgctggtgatcctgatcaccgcactcgggctggtgggctatgtggcggtgcgccgtttcggcgcccgtaccggcacgctgatgactgccgttgcaggcgcgctcgtgtcgtccaccgcggtgacgctgtcgctggcccgccatgccgcggcggtcgacggcaacgccgtgcgccccgcggccggcggcatcctgatcggctggtcggtgatggccgggcgcatcgcggtgctgctggtggccgtcaacccgtcgctgctggtgctgctctggccggtgctgctggcgctgatcctgccggccatggccggggcggcgtggctgctgctgcgaccgacgggcgcggccgctccggctgccgccccggttggcgacggtatggggagcgagggtgtggcgagcgatgggggggcgggcgacgggggggcgggcgatggggcggccagggtgtcggccgcggtcgccaacccgttcagcctgggcccggcgatccgcttcgcagggctgatggcggtgatcatgttcgcctccgccctggccgaacgctatctggcgcccgaggcgctggttgcggtgggggcattgtcgggcctggcggatgtggatgcgatcaccgtctccatggccgaacgcagcctggccgaagccgcccggctggatgtggccgcggccgcgatcgtcgcggccgccctggtcaataccggggtcaaatacgggctggccgccaccgccggcggcagggtgatggccgggctgctggcgccggcgacggcggtgtcgcttctggccgcgctggcggcggcctggctcaggctctgacgatggccgcgggctgcggagcgcaggccacgcggcgtggggggatcagtcctcccgcgccgtgccttcgatgctgcgcaacagcggctccaccagatagtccagcgccgtgcgctcgcgcagcggcaccatcacctcggccggcatgcccggggtcaggccggcatcgggcaggcggtgcagctcggtggtcggcacctcgatgcgcatgtcgtaataggcgacgccggtgcgctcgtcggtgaagcggtcggccgagatctgcgcgacattgccgttcaggatcggcgtggtgcgatagggataggcggtcagacgcacctcggcgaccatgccccggtggacatcgtcgatctggtcggggcggagctgggcccgcaccaccagcggcgtgtcgctgggcacgatctccatcaccatctcccccgggccggatcacgccgcccaccgtgaaggccgtcaggccgaccaccgagcccgaggccggggcgcggatctcggtccggcccagctgggcgcggacggcttccagcctgggcgtcaggtcgaagagctgttcctgggtctggcgcagctgctcggccacttcggtctggcgctcgcgctcgatctgatcgatctgcaggcgggcctcgccgatcgcctggcgggcgcgggcggcattggcctcgttctctccccgctcgccgtcgagcgaggcggcggcacgctccagcgccagcacccgggtcttgggcgtgaggcccttttcgtagagcgaccgggtgcccttcaattcgtcgcggatcagcgccagctgacgggcattggccgcggcctgggcctcgaagcccttgatctgggcgcccagctgcacgatgcgctgttgcaggatgtcgacctggttaccgcgcgaactggtccgggtggcgaaaacccgttcctgaccatgaaccagttggtcgatttcttcgcccttgcccagccgtgcggtgatgtcggcgggaaagacgatcgcgtccagcccgtcgcgctcggcgacgagccgggcttccaggatcttcagtgcgtcgatctgcttggacaggatcgagacctgggccgcgagttcggtgtcgtccaggcggagcagcaactgacccgcctccacccgatcgccttcacgcaccggcagttcggcgacgatgccgccatcgcggtgctgcacggcctggcggttgttttccaccaccaccacgccgggggcgaccgcggcgctgtcgagcggggcgaaagcggcccagccgcccagcacgccgaagaacagcaccgagatgatcagcccggtacgcagcggccggccggcgccgtcatcgatgcggggagcgatcgtcgtcgcggtcatgccgtgcctccgcgcggggatgtatcggggccgggaccggtttcatgtcccgccttgtgcccctgatgggtgggggcgggcgggcggccgccctgggatgcgctcaacgccttcacgacctcggcggtggggccgtacatctgcacccggccgtcgcgcatcaccagcagccggtcggccaggcccagaatgccggtgcggtgggcgacgatcagcacggtgcgaccctcggcgcgcaggcgcttcagcgcgatgaccagcgcctgctcgccctcgttgtcgaggctggaattgggttcgtccagtgccacgatcgcagggtcgccgtaaagagcgcgcgccaggccgatgcgctggcgctggccgcccgacaggccgagaccgccatcgccgacccgggtgtcgtagccctggggcaggcccagtatcatatcatgtgccccggcgcgttcggccgcctggatcaccgccgcatcatcggcctcgccgaagcgggcgatgttgtcgcggaccgatcccgccagcagcacgacatcctgcggcagataaccgatcgccgggccgagcgtctcgcgcggccagcgcgccgcatcggccccatccagccgcacactgcccgacagcggcacccagagcccgatcatcaggcgcaggagcgtggacttgccggcggccgacgggcccagaatgccgatggtctctcccggccggacatccagatccacaccgccgattgcggcgcggtcggtgccgggcatgcggaagacgaccttgtcgagggtgatcgcacccttgggccgcggcagcttcgtctcccccgggcgcggcggcggggtggcggccagcgccttggtgacccggccccaggcgtcgcgggcagaggtcatctgccgccacatgccgacgatctgctcgatgggggccagcgcccggccgatcaggatcgagcccgcgaacatggcgccgggggtgaccagccgttcgatggcgagataagcgccgatcgccagcaccaggatctgcagcgacaggcgcacgcccttggtggtggcggaccagaaggcaccgcgttcggccgcgcgggcatggccggccagggcctcgccccgcgcgtcgttccagcgcgaaaccagggccggggccagacccatggcctcgatcggctccgcctcgcggatcagggcgtcgctggcggcatgggcgcgcagctgtgcctggccggccgtggtcgtggccttgcgcatgctgtattcgccggcgacggccagcgccatcagcagaagcgcaccgcccagcgccagcatgccgagccagggatggatgacccacatgatcgccacatagaccggcatccagggcaggtcgaacaccgcccccggcgccgggccggccaggaagacccgcaccgtttccagatcgcgcagcggctgtgccgccggcggctggccgggcagggccgactggcggatcagccgggcaagcagcggccccgccagggcccggtcgaccctgagcccggcacggcccatcaggatgccgcgcacccgatcgagtgccgccatggtggcaagggcgaccagcgcgatgatgctgacgaagatcagcgtttcctcgctgccgctggacagcacgcggtcatacacctgcagcatgtagagcgacggcgtcaggtagagcaggttcaccgcggcgctgaacgccgccgtaccgcccagatgccggcggatcgaggcgcgggcttcggcgatcaggcggttgccgtcggcggcatcgaccgggtcgggctttcgttcaacggcctggcgggcggcgggcagggtcgcgttcatcgggaggtcggcttccgtggggtgcggccgtgactcatggcatgaggatctgacaacgaatcgggctggatcggcaaaggaccggcgacggaacctgtgagcgagccccgctggtctcttttatcaatatcgacgaaaccgcaagctgtcatccggcttccggtggcacgctgctgatgcgccgccgccaccggaagaagaccggtgcgaacatgatgacgtaaaccacccgcatcacatggaaaaccgccacgacggcggcatccagccccagcgacagggcgatcagccccatttcggtaaagccgcccggcaccaggctgagcagcatcgccaggcgtggcgcaccggtcagcgaggtgaagaccggggcaagcaggacggcagttcccagcatgatcgcggccgagagcagggcgaggatcaccacccgcgccagatgatgcagcgacagcccggcgaaacgtgcccccatcatcgcaccggccaccagctgggcgagagcgattccccagaccgggatctgcacggtgacggtacccgaaagatgaaggccgcccgagacgatcagcccgcccacgaagctggcccccggcaggcggaaccgttccgccagccgccagccggcaaggccgcctgcgatcagcaccagatattccagcacccggccggtatcgccgccgcctgcccaggtcgagatgatgccggtatgtgccgcaattgccgggcggatggtcgcggccaccccgtggccttcgacataggcgaggtagagcggcacggtgaagaccaccgcatagatccggacggcatgggtgagggcgacggtggcgatgtcggcgcggtattcctcggcgacgcgggtcatttcgttgatcccgccgggcatggcagcgaaaaaggccgtggcccggtcgacccggccgaaggcgatcatcagcccgtagcccagggcgaagagcagcagaatataaagggtgagggcggcgagccccagcggccagcccgcggcattggcaaaggtgtcgggccggaaactgccgcccagcacgatgccgagcgccaccaccgtccagatcctgagccggcggttggtgccgagcggcgcccccagaatcccggcggcggcggtcagactcattgcccccagcatccaggcgagcgggaggtgcaaccaggcgaagagggcaccgccgagtgcgccggtcgcgagggtgagggcgatcctgaggggcatcacgtccgagggtatcctgctcgccttcgggttgtagtgcggtcgatatagcgccagatggtataccagtttggccgcggctttcccatcctgtccccatgctgctgcccgtgcatgtatcggtacttgcctctggcgcgcctgcgcgggagagtagggcgactgtggaagttcgatgccgatccggcgacgccgcctgcgcttgaaacaagagcggcggccaacgccggacagttcgtcccgctcgacccgcgggacatgcgaggaaacgctgaacctgatgtcggtgctgttgctgacccacccggcctgtctcgatcacgagacaggatcctggcacccggaatcgcccgatcgcctgcgggcggtgctgaaggcgctggacgcccccgaattcgcggccctggtgcgcgaagaggcgccgctcgcctcggacgagacgttgtccctcgcccatgatgccgcctatgtgaaaagcgtgctcgccgccattccggcaaccggtgcgcaggccctgcatctggacccggataccgtggtctcgcccggatcgggagaggcggcacgccgcgccgcgggcgccgttgtggcggcggtggatgcggtgatgggcgggcgtttcgatcgggccttctgcgccatccgcccgcccggacatcatgccgagccggcgcggccgatgggcttctgcctgttcaacaacgtcgcggtcggtgccctgcatgcgcggaccgtgcataaggtgaaccggatcgcggtggtggatttcgacgtccatcacggcaacggcacccaggcgatcttcgaaaacgacccggacctgttctacggctcgatccatcaggcgccgttctatcccggcaccgggcggatttcggagcggggtgttgccggcaacatcatgaacatccccttcggtgccggatcgggcgggatcatggtccgccgggccttcatcgaacggctgatcccggcgctggatgaattcatgcccgacctgctgctggtctcggccggtttcgatgcccatcaccgcgacccggtgggcggcatggacctcggcaccgaggatttcgcctggatgaccaaggagctgatcgaggttgcccggcgtcattgcggtggccggatcatctccacgcttgaaggtggttacgatctgagggcgctggccgatgccaccgcttcgcatgtccatgtgctgatgacggcgccctgatcctgcagtctgatcctggtctgccttgcccggcggcgcagggccggcttacactccgccctcattcgatccgcccgccccagacagaccgaggaggttccgaggccatggccgccgccgacaccctgccgccggagatcgcggagctgagcttcgaggatgcgctgaagcagcttgaacagatcgtgcgcaagctggaaagcggcgaggcacggctggaagaggcgatcgaggactacgagcgcggggccctgctgcgccggcattgcgaacgcaagctggccgaggccaaggccaaggtggagcgcatcgtgctgggtggcgacggccgccccgccgggcttgagccggtggatcccgaatgagcaccggcccccgggatcccgttgcccaagaccccttcgccagtgacgagaccgtgatgccgctgccggtgttcgatgcggcggcgcgcgcggcgctgaatgaccggctgaccgaagtggcggcgggcgtcgatgcggcgatggaccgtctgctgccccccgaaggcggcggtgcctctccccggctgaccgaggcgctgcgctatgcggtctttgccggcggcaagcggctgcggcccttcctgatcgcggcatcgggggcgctgttcgacgtgccggcggaccggctctaccgcgccggggcggcggccgagttcctgcacacttattcgttggtccatgacgatctgccggcgatggacgatgacgatctgcgccgcggccgcccgaccacccatcgccgcttcgacgaggcgaccgcgatcctggtgggcgatgctctgctgacgctggccttccaggtgctgggcgagcccgagacccatcccgatggcacggtccgcgccgatctggtggtggcactggccgaggccggcggtgccggcggcatggtgggcgggcagatgctggacatcgaggccgaaacccgcggcgaggcgcaggatctggggaccatcggccggatgcagcggctgaagaccggcgcgctgatcgaattctgctgccgggccggcgcgatcctcggcggtgccggcatggaggcccgcaccagcctgcgcgactatgcccgcgcggtggggctggcctatcagatcgccgacgacctgatcgacgtgaccggcgatgccgcggccgcgggcaaggcggtgggcaaggatgccgcccgcggcaaggcaaccttcgtggggctgatgggagtcgacggcgcacgggccgaggccgcacggctgatggacatggcgctggccgcccttcagggcttcgacggccgggccgacgacctgcgccggctggcggttcatgtcgtgacgcgtgaccgctgagtgcaacctttctgcaatgatgacggttgaccggtacgtggccgcgggctgtgcaagtcccatggctgtcgttatattggcgggattccgccgatcccccgttcggcgggtttcattgccggtgacgggatgccatatcaccggtaatgcctgatcccctcggcgaaatccgtcgttgcgggttgcaagggcaggccgagagccctaagaaacggggctcccgatgcggcagggtcgttttctgccgggtcggtcaacaaaacatcgcgtgcgcgaggagaggtcgcaagtgtccgatcgcccgtccaccccgctgctcgacaccgttcgggtgccggccgatatccgcggcttcaaccgcgaccagctgcgccagctggccgacgagctgcgggctgaaaccgtctccgcggtctcggtcaccggtggccatctgggcgcagggctcggtgtggtcgaactgagcgttgcgatccaccatgtcttcgacacgccgcgcgaccggctgatctgggatgtcggccatcagtgctacccgcacaagatcctgaccgggcggcgcgagcgcatccgcacgctgcgccagaaggacgggctgtcgggcttcaccaagcgcgacgaaagcgaatacgaccctttcggtgccgcgcacagctccacctccatctccgccggcctgggcatggcggtggcgagccggttgaagggtgaggaggagcggcgggtgatcgccgtgatcggcgacggcgcgatgagcgccggcatggcgtatgaggccatgaacaatgccggcgccatgcccgaccggctgatcgtgattctgaacgacaacgacatgtcgatcgcgccgccgaccggcgcgatgagcgcctatctctcgcggctgatctcgtcgcgctcctaccgctcgctccgcgacatcgccaaacagatggcccgggtcttccccaagccgctggagcaggcggcccggcgggccgaggaattcgcccgcggcctggtcaccggcggcacgctgttcgaagagctgggcttttattatgtcggcccgatcgacggccacaatctggatcacctgctgccggtgctgctgaatgtgcgcgacgccgaccaggacgggccggtgctgatccacatcgtcacccagaagggcaagggctatccgccggccgaaaaggctgcggacaagtatcacggcgtggcgaagttcgacgtggtgaccggcgcccaggtcaagccggcggccggcgcgcccagctataccaatgtctacgccgatgcgctgattgcggaagccgaacatgatccgcgggtgctggcggtgaccgccgccatgccgacgggcacggggctcgaccgcttcggccggcgcttccccgaccgggtgttcgatgtcggcatcgccgaacagcatgccgtgacctttgccgccggcctggcggccgaggggatgaaacccttcgccaccatctattcgactttcctgcagcgcgcctatgaccaggtggtgcacgacgtcgccatccagcgtctgccggtgcgtttcgccatcgaccgggccggactggtcggcgccgacggcgccacgcatatgggctcgttcgacctgacctatctgtgctgcctgcccgatttcgtggtgatggcgccggccgacgaggccgagctgatgcatatggtggcgaccgccgcccagatcgacgaccggccgagcgccgtgcgctatccgcgcggcgaggggctgggcgtgcccctgccggcgcgcggcaccccgctcgaaatcggccgcggccgcatcctgcgcgagggcaccaaggtcgcgatcctggccctgggcagccgggtcgccgatgcgctgaaggcgggcgaggaactcaccgcccgcggctattcgaccaccgttgccgatgcccgtttcgcgaagcccatcgatgccgatctggtccgccgcctggcctctgaacacgaggtgctgatcaccatcgaggagaacgccatcggcggcttcgcgagccaggtgacccagctgctgtgcgacggtgcgctgatcgagcgcgggctgaagctgcgcccgatgatgctgccggatctgttcatcgaccatgccagcccgcgcgatcaggtggagatggcgggcctcggcgtgcaggcgatcgtggccaaagcgctggaagcgctgggccataacgatgtcgacgtggtgctgaccaccaacagccgcgcctgatccggaccgctgccccatggccaccgcaaccacccgtctggaccaggccctcgtcgatcgggggctggtggagacgcgcagccgcgcccaggcgctgatcatggccggccacgtcttcgtcgacgaccgcaaggagaccaagcccggcacgaaagtgaagcccggggcggccctgctggtgaaaggggccgaccatccctgggtgtcgcggggcgggcttaagcttcagggtgccatcgaccagttcgggctggatcccacgggtgcggtcgccatcgatgtcggcgcatcgaccggcggcttcaccgacgtgctgctgacccgcggcgccgcaagggtttatgcggtcgatgtgggacatggccagctggcctggaagctgcgtcaggatgagcgcgtggtggtgcttgagaaactgaatgcccgctatctgaccgaagagcatgtgcccgagccggtcgactgggtggtctgcgacgcaagcttcatcggcctgcgcacggttctgccggccgcgctttcgcggcttaagcccggggggctggcggtggcgctgatcaagccgcaattcgaggtcggcaagggccgggtcggcaagggcggcatcgtgcgcgagcccgaactgcatgccgaggtggtggagacgatttccggctggttcgcaggcctgcccggtgtcgaggtgaccggcgtgacccagagtccgatcaagggcccggacggcaatgtcgaattcctgatcgtggcccgcttcaccaccggcggcgcagggcttttcacgccgcgcgatccgggcgaagctgaagcggatgccgccggcgcctgaccggtggcctgcacagcccgagaggttccgcccctcaccgagaggtcccgcccgtgcagccaacccggatcgccgccgcctggaagggtctcgccgcgtgccagagctgcggcatccgccggcttgcgctcttcgccgatctggaggcggaggatttcgcccatatccatctgccgatcgaggaacgcagcataccagccggggccagtctttatgggctggacgatccggcagaggcggtgttcaccgtgcgcgccggcttggtgaagctggtccatatccagcccgatggcggccagcgcatcgtgcggctggtgcgggcgggcggggtggccgggatcgaggcgctggtccggccgacctatccccatgctgcgatggccctgcagccggtggaactctgccggatcccgacctcggtggtgacccgcctgcagaccgaaacgccccggctgcatcagcggctgatggagaagtggtacgaggcgttgagcgtcgccgatgatttcctgaccgagcttgcgaccggccatgcccgccagcgcctggcccggctgctgctgtggctgagcgaggatgcccccgatcagccggtgcggctgttcagccgcgaggatctgggggcgatcctgggggtgacgctggagacgaccagccggacgatttccgagtttcgccgcagcggcgtgctgaccacgctgtcgcataatctggtgcgctgcgaccgcgccgcgcttgcagacatcgccggctgatccacaaattcaattctggctggcaatccagcgcgcaatgcccggccagtattccttgagcgtgcgtgcgcccatgaacaggccgatatgtccgccgggcacggtctgctgcacgatgtcggctgcgggcgtgccgatatatttcgccgcgtccagcacctgttccggcgtggtgatgtcgtcgccggcaccggccagaagataggtcgggcaggtgatcgtcttcaggtccagccggcggccgagcgcgatgaaatcgcccttcgccagacggttttccttgaacagcagccggatcgcctgcaggtaccagcgcccgggcaggtcgagcgggttttcgtaccagctttcgaagacctcttccttggccagataggccgggtcgtcgatatgctcgtagaggtcgatatgggactggatgtaatgctgctcgggatgcatgttcttccagccctgcagcatgaacttgccgcgcatcagcccgccgcccagcttcaccagatcctcgtaaaaggccaatggcgaggcatgggccatgcgcttgatcggcccgtcgccggcatcggtatcgatcggcgcgccggccagcaccagtgaattcaccttctcggggaaacgggcggcgatcatcgccgaggtccagccgccctggcagaggcccaccagattgacccggccgcccagatcgtcgatcgcgaccaccagctgggccagatagtcgtcgatctccagatccttcatatcggcggtggcgcttttccagtcggtcagcgcgacatgatcgatgccgttggcgagcagggtttcaaccaggctctggccctggtgataatccgcgatcatcgcggtatggccggcatagggggcgttcaccagcgtcgggatgcccttgccctgctggccatactcgcgcagggccatggtccgcaggtcgaggcgcagccggctgggcgtggcgagtttcggccgcagatcatcgtggatgcggatctcttcctcgacgaatttcgcgttgcgggcgtacagctccagcccctgctgcagcatgtcgttcgccatggcgagcggccagaaggcggggacggcgctgggggtggcggtgctggcggatccggcggatttcgatgacatgagcgacttcctttgcgtggcgtcgccgggtctccggctgcgcgtgcaagcggggcagccgttcggagcggaggctcgacgatctcatcgacgggtcgagtctatgccgcaatgcagcatggcaaaaatgaattccctgtcaggatgcggcagccggggcagggcagccatgcatttccgcccaatgaagcagggccggcagctgaacatggctgagcgcatcatggaggcgcatcagcacgggcccggcctcggcatcgccctgcaccgccggcagcagccggccttcatagcagccgatcgccgccacggcgttgtcggccgccatccggcaggcggcccgcagatcatcgggcagggccggcggggcggcaaccgggcgcgccggggcagggaggccgcgggcggtgagcaggcggatcagggtggcggcatgcagataatccgacatcagcaggttgcgaaagggcatgaccggcccgaaacgcgcgatcaccgcctcggcgatggccgccgcccgccaggcttcgtccagcgccgcccggatcgcggcatcggtggtgacgggcatgacgaacctccctcgggccaggcgggatcgggacatcgccgatcctggcggggaaggtgggcgcgcgctttgagattccgcaaggacaggacggcggatctgaagatgatcagggccagccaatcgcagcaaggaaaggtccgatcccatgccgatccgcgagattctgggcatcaccgaattcgatgcctacacccctgaagaaacccgcgccgccttggcggcgggggaaatcgtgctgatcgatgttcgcaccccgcaggaatatgcggtggaacatatcgagggcgccctgctgatgcccatggcgtttttcgacccgcgcttcctgccaccccaggacagccgccgcatcgtgctgcattgcggatcgggcatgcgctccacccgcatggccgaacgctgcgccgccgcgggcttcgaccgcatcgcccatatggctggcggcatgagcgcctggaaggagcggggcctgccctatatcgccaccgaccctgcgacgggcgggccggtcaggaagtgagaggggcgggtgatgccggtgccgggtcgtcatcggccagagatatgtcccggccggtatcccggtcacggtgcaggtcgaagctgtccgtcttcgggccgctcagcaggtaatccctgaaggtcatgcggtcctgatctgaacgcgacaccatcctgtcctcccgccgctggctgaccaggtatatgatctccggcggcgggaggcacaagtgatgtgatcgacctcagttcacccgccggtcccggtcttcccaatagggcttgcgcagatcccgcttcaggatcttgccggcaccggacatgggcagcggttcgtcgcggatttcgacgctgcgcgggcatttgtagccggcgatgtgctgcttgcagaaggcgatgatctcttcggccgtggggcgggcgtcggacttcggcaccaccacggcatggacgatttcgccccaatgctcgtcggggatgccgatcaccgcgcattgggcgacgtccggatggcgggcgacgacgttttcgacctccagcgaatagacgttctcgccaccggagatgatcatgtccttcacccggtcgacgatgtagatgaaaccgtcctcgtccatgcgcgcgccgtcgccggtgtgcatccagccgtcgacgatcgccttggcggtttcttccgggcgttcccaatagcccatcatcacattgcggccgcgcacgaccacctcgccgacctcgcccaccggcaccggccggtcgtcggcatcgacgatgcgcacctcgcagccgatcaccgcccggccggccgagcgatggcggcctttggcccggctttcgcccacatgttcctgcgggtggagcagggtagcgacgggggaaagctcggtcatgccataggcctgcatgaactcgaccccgggcagcttcgccgtggcgcggtcgagcacggcttcggtgatcggggcggcgccgtagatgatccgcttcatcgacgagaggtcgtaattgccgatcgccggatggtcgaccagcatctggatcatggtcggcaccagcagggccgaggtcaccttgtgctcctggatcgccttcatcacgccttcgggcgtgaaggaggggacgatcacatgcggttcccccttcatcagcagggagaaggtcgcagctccgtcggccagatggaacatgggcgcgctgtgcagatagaccgtgccgtcgggaaacagaccttcggccagggaatgcaggctgttggagatgatgttctcgtgcgacagcatcacccccttcgaccggccggtggtgccgccggtgtagaagatgccgaacagatcgtcgccactgcgctcggcatcggggatcggatcatggttccggatcagatcctcgatatggggcatgtcttcaggcgccgggccgtcgccggcatagatcagggcgaattgcgagcccgaggccgccgcgatcgcccggcccatttcggcgaaggcgtcgtcgacgatcagcaggctggcgccgcaatcctcgatcgcgtcggcattctcggcgcggctccagcggatgttcagcggtacgatcaccgcgcccgcccagggggtggcgaggtagaattcgatatagcggtcggagttcagcgtcagcagcgcgacgcggtcgccatcctccacccccagcgcccggaaggcgccggcgatgcgggcgacgcggtcggcggtttcgccccagctgcgggtgcggccggcgcagatcgtcgaggtccgatcgcgggcaatggcgatcgtccgtcggagccctgatgtgatgcccatatatcctcccagtgggtttgagcgttgcctccggtatgccgtccgcacttctttatcgggcggatcgggcaggaacgccggcacgggagggagggcagggcggcgggccgccgcccgggccctagcgtgccagcgcgtgccgcgccatgtctgccatgacgtcggcgatctcttcggccgtgcgcgggccgccttcacggaaccactggccgacccagttgaccgcaccggccagcaggaaggcggcgatgcggatatcgacctcgcggatggagccgtcggcgacaccctgggcgatatagccgcgcagcctggtatcgatcgaccgcttccagtcgcggaccttgcgccggctgtcgggcgccaggtcgcgatcgtcgacgctgaccagacacatgccgaaatcggcggtcatgttcagcgtataggccctgaggaaggcgaccgcccggtccagcccgcgcttgcccgcatcatcgacaccggcaagctcggcttcgatcagctccccacccagctgatagcaggcgtagaggatgtcttccttgttgcggaaatagtggtagagcgcgggcttggtgatgtgcagctgctcggccacgtccgccatcttggtccggtggaagccgttctcgacgaacagccgcgccgccgtgcgcagcaccgcatcacgcttggcatcgcggtcgcgctggcgttcggcggcgggcttccagggggaggcgggaatctcgatctgcacggggggtctgatctctctgctgcacgggcctcgggtcgccgccctccggtaaccgccggagcgggccggtgggcagatccgggggatgatcgcacgaccggccccggatcggaacggccgcgcatcacaatccggacgattgacggcccgacttcgtattcggtatcttacccatgggtaaaagaaaatgtccatgcccgtcgcggcgaccggccgccgggcctgtccacaagtccagtcaagggcccagtcatcccaaggacggcgagccttgagggcagtcgttccccccaacaggcgaggaaagctcattatggtcgagagcgtgaggatcgcgggcgtcggcatgatcccgttcgtgaagccgggcaccagcgcgccctatagcgatatgggggccgaagccgcccgtcaggccctggccgatgccggcatcggctacgaccagatccagcaggcctatgtcggctatgtctatggcgacagcacctgcggtcaggcggcgctctacgaggtcggcatgtccggcatcccggtggtgaacgtcaacaacaactgctcgaccggctcgtcggcgctgttcctggcgcggcaggccgtggcctcgggggcggcggattgcgtgctggcgctgggcttcgagcagatggttccgggtgcgctcgccgacgtctatcaggaccggcccagcccgatggcgaagttcatcgaggtcgccaaggaattcgaccccgccgccgaggcgccgatggccatccgcctgttcggcggtgccggcaaggaataccagcagaaatacggcgcgagcgacgcggctttcgcgatgatctcggtgaaggcgcgccgccatgccgagcataacgagcgggcgatcttccgcacgccgacctcggtggaagaggtgctggcgtcgaagcacatgtacgggccgctcacccgcctgcagtgctgcccgccgacctgcggtgccgcggcggcggtggtcgtctccgaagccttcgcccgcaagcacggcctgaccgacgcgatccgcctgcgcgcccaggtgatgaccaccgacttcccgtccagcttcggcgagaagagtatgatgaaggcagtgggctacgacatggcccgcgccgcggccgatgcggtctacgagcagaccggcgtcgacccgatggatgtgagcgtggtggagatgcatgactgcttcaccgccaacgagctgatctcctacgaggcgctccggctgacgcccgagggcacggccgagaagttcatcatggacggcgacaacacctatggcggccgcgtcgtcaccaacccctcgggcgggttgatctccaagggccatccgctgggcgcgaccggccttgcccagtgcgccgaacttgtctggcagctgcgcggccaggccggtccgcgccaggtggagggcgcgaagatcgcgcttcagcacaatctgggtctgggcggcgcctgcgtcatctcgctctacgaccgcgcctgaccggcatcgagcaggagaggatgatcatccatgctcgatagagcggcgatcgggcgggttctcccgcccgtcaccgcgacggtcgaacgcggccgtctgcggttctttctgaatgcgatcggcgagaccagcccgatccaccacgatacggccgcggcgcaggccgccggctatcgcgactgtcccatcccgcccacctatctgttctgcctgcgcatgctggatgcgcccgagccctatgccctgctcgacgagctgggggtcgatctcggcaccgtgctgcatggcgagcagagcttcacctatcaccagccggtggtggcgggcgacgagatccgcttcatcggccggatcgccgacatcttcgaccgcaagggcggggcgctcgaattcctggtcgaggagatccgggttgagcgcgtgtcggacggtgcccatgtcgccgatgtgcggcaggtgaccgtgatccgcaatcccgtggccggaggtgcggcatgagcggtgaaccgatccgggtggtggccgagatgccgccgatcacccgcacgcagctggcgctctatggcggtgcctcgggcgaccacaacccgatccatatcgatatcgacttcgccaaggccgccggtttccccgacgtcttcgcccacggcatgctggtcatggggctcgccgcccgggccgtgaccggggccgtgccgctctcgcgccttaagtcctatggcgtgcgtttcaccgccatcacccaggtccacgaccggctgacggtcgaagcggtggagaccggcgtcaccgaggccggcgaccgccggctggacgtgaccgtccgcgaccagaacggccaggtgaaggtgcagggcgaagcgctgatcgccgccggctgatccggcccgggcctgtctgcccttttcaaaaaacctcagaaaatatcgggagtgacgtcaagatgggcaagctcgacggcaaggtcgcgctggtttccggatccggccgcggcatcggccgctccatcgccctcaagctggcgagcgagggtgcgaaggtcgtgatcaacgatctcgacgaggcaccggccgaggcggtggccgctgaaatccgcgagatgggcggcgaagccctgatctgcgccggcaatgtggcggccgaggatttcggcacccgcttcgtgaacaccgcagtcgagggcttcggcggtctcgacatcatcgtcaacaatgccggttatacctgggactcgaccatccagaagatgaccgacgagcagttccaggcgatgatcgacgtccatctgacggcaccgttccggatcctgcgggctgctgccgaaccgatccgcatcttctccaagcgcgaggcgcaggaggggcgcgaggtcttccgcaaggtggtcaacatctcgtcgatcgcgggcctctacggcaatgccggccaggtcagctattcctcggccaaggcggcgctggtcggcatgacccgcacgctgtgcaaggaatggggccgctacaaggtcaacgtgaactgcgtcgccttcggactgatcgccacccgtctgacccaggcgatcgagaaggaacaggcgaccatcgatgtcgacggccgcgagatcaaggtcggcgtgcagcatcagctgctcgacaccatggcccagctgatcccgctcggtcgtgccggcacgccggacgaggcggcggatgcggtctatctgttctgtgcacccgagagcaattacgtcagcggccaggttctggtctgcggcggcggcatcctgctctgatacctgtcggcggcggcgggccccgcggcgtgaccgccgggcccgccgccgcacacgatccgacggagacatccccatgaccgcttctgccccccggacgacctcttcctggatgacgccggagcttgaaagccttcgcgaccagttcggccgctttctggacgccgaactgaagccccatgccgcgcgctggcgccggcagcggatgatcgaccgctcggcctggacggcgctgggggggatgggcgcgctgggtgctgcgatccccgaggaatggggcggcagcggcggcgatgtctatcaggagatggtgctgctcgacaccatcaaccggcgctgttccgacctcgccaacggctatagcgtgcattcgggcatcgtgacccattacgtgctgacctatggcaccgaggatcagaagcggcgctggctgccgaagctgtgctcgggtgagtggatcggtgcgatcgcgatgacggagccgggcggcgggtccgaccttcaggcgctgaccacccgcggccggcgcgacggcgacgactatgtcatcgacggccagaagaccttcatcaccaacggcatcgccgccgatctggtgctggtggcggtgcgcatcgacggcacgccgggggccaagggcatctcgctgatcggtgtggagaagggcgcgcccggtttccagcccggccggccgctggaaaagatcggcctgcatgcggccgataccgccgagctgttcttcgacggcgcccgtgcgccggtcgacaaccttctgggcggcatcgagggtcgcggcttctatcagatgatggagcagctgccccgcgaacgcctgatccttgccattggcgcggttgcggcgatggagcatgcggtcgagatcacccgcgcttatgtccacgagcgcaaggccttcggcaagaccctgttcgacttccagaccatttccttccgcctggccgagcttgcgaccgaagcccatatcgcgcgcgtcttcgtcgacgactgtctggtcaaactggccgagaaccggctcgacaacgtcaccgcctcgatggccaagtggtggtgcagcgaacgccaggtccagaccgtcgacgcctgcctgcagatgttcggcggctatggctatatcgaagaaaccgaaatcgctcgcatgtataccgacgcccggatccagaagatctatggcggcgccaacgagatcatgaaattgctgatcgcgcgctcgctctgacggcgcggctgccggcgatctgaggatggggcctgcccgatgatcgggcgggcccgttttattccccggggtgaggcagcggttctacagaaagacgaagaccaagggcagccagaactttcagtatagttccgaattcgggatttcccttgtcgctcaaggctcgatagaggctttcgcgggagagtcctgcatcttcggcaatctgtctcattcctttagcgcgtgccacgacgcccaacgcgtcggaaataaacgcagggtctcctgtttcgaacgcatcggatagatagccggccatagcctcgtcatcgtccagatattctgccggatcaaaggccgtggtctccagcgccattgtcacctctccatttccgccgcaagtctctttgcttgctcaatgtcgtcattttgacggttattcgtgccaccgcatagaagaacaataagaacagtgccacgctgggcgaagtaaaccctataccctggtccctcatgaatgcgcagctcggaaacaccctgccgcaccagcgcatgcggcagacagtagtttttagatgattttatctggagaatatatcgtgagagaaaatctggcgcattcctctcatctgagcgggcgtcgcgctcacccccgcgcccgcagccccgcgccggcggccagggtggggggcaggcggccgaccgccagcgcggcggcggtggtgcgctccacgtccaggcggtcgagggtgagccggccttcggagtattcgaccacccggccggtgagcacgatgtggttggcgcggggcatcaccgtcacccgcccgcggcggggcgagagttgcagaccgtccagccggtcgcgggtcagcatgtcggcgaaaagcggtgccagaccggcatggacgatgccggtgaccgggtcttcaggcacgccgagcttcggggcgaagaagcggcagacatagtcggcgccatcggccagagaggcgccgtcggcgaggctggcgaccgccaccccccgaggcggcagggcggcaatggcggcgtcgtcggggcggatcgcctcgacctctgccggatcctcgaccagcacataccagtcgtggcggccttccagcacggcggcgggggcgacaccgcccagggccgcggtgatcgcgcgcagcatcgccgggcgcggttcgattccggtcagccgctcacgcggcagggagaggcacagtcgaccgccatccgaatgatcgcgggtgacatggagcagcccgccccgggtacggaacaccaccgcgggtgcctcgggcgcgaccctgctcaacaccacatgggcggcggccagcgtggcatggccgcacatcggcatttcggtggtgggagtgaaccaccgcagatggaagggaccggcggcggcgccatcgcccgtgccgaacccgcccggatcctcgggcaccaggaaggcggtctcggacagccggttttcggccgcgatcgcctgcatcaccggcaccggcagccaggcatccatcaggcagaccgccgccggattgccggcgaacagccgctcggcgaaggcatcgaggtgaaagatcctgacgtttcgcatggcgggaccattccttcgcaaactgtgggttgcgtttaattggaatgatcacgccaaatgagatcgtcaggcaagcggcatctgcgcgctgcggcaaatccgtggtcagcggttcatatcatgatattcgtcgttcggcagcatgtcgacggcgctcgcgacgcggttggtcatgttgtagaagccgatgacattggccaggtcgaaaatgtcttcgaccgaaaagcccgcgtcgcgcagccgggcccggtctgcctcatcgaccagggtcggggtttcggtgaccttggcggcgaaatcgagcatcgcccggtggcggagcgacagcggtgccacccggtagttcatcaccagcatctcgccgagcttcgggtcgcccgacagtgccctgaccgcctggccatgggcgaccagacagtaatagcagcggttgatcgacgagaccaccaccgccaccatctcgcgctccagcttgtcgagcccgctgtcgcccagcatcaactcgttgtagaagcggctgaaggtgcggaatttttctggccgcagcgtataggcctgcagcacatgcggaaccatgccgagcttctcgcggcacttcgcgtaataggcctggatgtcatcggcatggccggcttcgtcggggatgggcagggccatcacctcgggcttcagctgcagcggcttgtcggcggacatgggtgagcgtctccccggttcttgtatgatccggggagtatgcctgccgtggccggggctgtcttcagaagccgggcgtcacccgccacattggccgcgatggcgcagcagatgatcggccagcaccaccgccatcatcgcctcgcccaccggcaccgcgcggatgccgacgcaggggtcatgacggcccttggtcaccacctcggtatccgcgccgtcgcgggtgacgctgagccggggggtgaggatggagctggtcggcttgaccgcaaagcgcaccaccaccggttcgccattggcgatgccgcccaggatgccgccggcgcggttgcccaggaaagcgggcttgccctcgcgcatccgcatctcgtcggcattctgcgagccggtgagacgggcggccgcgaaaccgtcgccgatctccaccgccttgaccgcattgatgcccatcatcgccttggcgagatcggcatccagcttgtcgtagagcggatcgcccagcccgaccggcacgccttccgccaccacttcgatcaccgcgccgcagctgtcgccggatttgcgcaggccgtccagatactcggcccagcgcgcggcggtttcggcatcggggcagaagaagtcgttgcggccggtctcgtcccagtcccaacggctgcgatcgacgccgatgccgcccatctcgaccagggcgccgcggatggtgacggtctctcccagcaccttgcgggccaccgcgccggccgccacgcgcaccgcggtctcgcgggcgctcgaccggccgccgccccgatagtcgcggatgccgtatttggcctgataggtgaagtcggcatggcccggacggaacttgtctttgatctcgccgtaatccttcgagcgctgatcggtattgcggatcagcaggctgaccggggtgccggtggtgaggccttcgaaggtgcccgacaggatctcgacctcgtcgggctcacgccgctgggtggtgaagcgcgactggcccggccggcgcttgtcgaggaaaggctggatgtcggcttcggtcaacgccaggcgtggcggcacgccgtcgaccacgcagccgattgccgggccatggctttcaccccagctcgtgaagcggaaaagctcgccgaaactgttgcctgccatggccggtccgatccttcaaaacggtgctgtgggagagaggtgggggtcagccgagattgatgtcgggcgcatcctcggccttcatgccgacgatgtgatagcccgcatcgacatgcatcacctcgccggtgatgccggtgcccatgtccgagagcatcagcagcgaggcgttgccgacctcttcgatcgagaccgtgcgccgcagcggcgagttcatctcgttccagcgcatgatgtagcggaagtcgccgatgcccgaggcggccagcgtcttgatcggcccggccgagatggcgttgacccggatgttttcggggccgaggtcggccgccagatactgcacgctggattcgagcgccgccttggccacgcccatgacgttgtaatgcgggatcacccgctccgcccccagataggagagcgtcaggatgctgccgccatgctgcatcagcggccgggcatactgcgccatctgcaccagcgagaaggccgagatctgcatggtgcgcaggaagttgtcgagcgtggtgtcgacatacttgcccttcagctggttcttgtcggaataggcgacggcgtgcaccagaaagtcgagccggccccatttttcggcgatcgtgtcgaacagggccttcatgctgtcgtcgtcggtgacgtcgcagggggcgacgagcgtggcaccgacttcggcggccagcgggcggacccgcttttccagcgcctcaccctgataggtcaatgccacctccgcgccgttcagcgtcaccgccctggtgatcccccaggcgatcgagcggtcgttggcgacgccgacgatcaggccgcgcttgccggccatcacgttcgattgaacgatcatgcggtcccctcgcagtatccaggcggccggtccagggaggcgccgggggcgcggccggccctggcggacctcgtgtgacaggttgcatcctgcaggttgcagacgtgccgttcggccggcggccgggcacaggtgcggcgcatcctacacgaaacggcggtccggtcaaatcggcaccggacggggcctgaacggcggatttcagcgctgtccgggccggtgcatgtgccgtcgtgccagcctgcgggcggccgcatgccggcgccggtgacggtcgatccgcgaccgcacggcggcccaatagccacccagcaggaagacataggccgccagatacagtagcaacagggttgcgatcatgctgcccaggctgccatagaccgcgttcatgccacccgtctggcgcagatagaccgaaaagccgatcagcagggccatccagcccagcacgatgacggctgccggcggcagcagcacccgccggcgcggcggcagggcatcgggcagcaggcgcagcaggccccagaccacggtgacggtgccggccagcaccaggggcgggcgcagggtatggaccagccagacccaggcatcggacaggccgaagaaatcgaccgcagggccgatcacgatcggcaggaagaccagcagcgccagtgccaccggcagggcgagcgccccgcccgccaccagggccagactttgcagccgccgtttccacagcggccggaccatcttcacccggaaggcgcggttgagcgcgttgcgcaggctttcaagcgcattggaggccgaccagagggcggtgaggatgccgaaggtgagcagcccgcccttggggccgaagatgatcgtgtcgatcggcccgcgcagcgcctgggcgacatcgggcggcagatagtcgagcagagtgaggatcagggcatgaacctcgccaccctggccgatcacgccggccagcaccaccagcacgatcaggaaggggaacatcgaaaacaggctcgcgaaggcgatatggcctgcaatctggtcggcgccgtcgcgggtgaagcggccgtaggtgaccatcagctcgcggacccgccggttgctgcgcaaccggcggagaagagggcggtagaagggggtcttgtcagggtttgccgttgccgtcattcgatcccggctcgccgccggacctgatcgtaatccgcgggcggcttccaccgcttcacgaattccgtcagcgcggggtcgtcgcgatcgggcaggaccagtttcagcaccacgaacaggtcgccgcgatcgctcttgtccgcacccatgccgcggcccttgagccgcagccggcgcccgcccgaggatccgggcggcacggcgacccggaccgggccgtccagggtgggaacgacgatgccggcaccgagcaccgcttcaggcagggtgatgggcacatcgatcaggatgtcgcggccctcggcgcggaacagggggtggggtcggacattcacttccaccagcgcatcaccggcctcggcattgccgaaaccgggcatgccctggccgttcagccgcagtttctggccgtcgcggatgccggcgggcacggcgacttccagctcgcgcccctcgggcaggcggatgcgcttgcgggtgccgcgggcggcctcgatgaattcgaccgtcacggtataggtgacgtcgacaccgcggcgatgaatgccggtgcggccgccgctgccgttgccaccggcggcctggtcgctgcgccccggctgcgcgcggcggctgcgggcggggtcggtgaagatgtccgagaagaaatcggcgaagccgccgccctcggcaccccgggggcgcgggcgggcacggccgttgccggcaccatcgatctcgccacggtcgaaggcggcacgccgggccgggtcggacaggatcgcataggcggcagacacgtccttgaaccggcgttcgacctcggcgtcgcccgggtgcagatccgggtgataggccttggcgaggcgccggtaggcagtcttgatggcgtcgggcgtggcatcacggcccacgcccagtgtctgataaggatcggcgttcacgcggtcccccgtggacgtaagcgggccgccgcccgatcaggcggcggcccgtgcccaagggtcgttgcggccggcccctgcgtcaagcccgtagacgtcaggagttgacgatcttccagctgccgtccggctgacggcaggcggtgccataggcttcctcggtcttgccgccgacattcacgcgctgggtgaactcgcggcagtattcgccgctggagcgctgataggtcttgaccggggtgatcgagccggaattgccgctgtccgggttgctccagctgctgctctgtccggtggggttgctttcaagcgcccgctggctggcacgctctgcctccagctggtcggcacggtcgagcgacttgccgatttcattgccggcgaaggcgccgagcagcgcgcccgcggcggtggcggccagctggcccgtgcccttgccgaactgggcaccggcgacggcgccgccgacgccgcccagcaccgcaccgacaccctgcttggtgcccatgtcggactgggcgcaggcgccgagggcaaggccggctgcgacgatcagggggatgaacggcttcatgggagcttccggtagatgatgtgtcgggtgcggggaggtgtggggtgcgggcgccacatccgggcgccgtttcgtgtcaggtgcgcatggtagcacgcgaccagccatggccaagcggcctcggcgtgtcaaatttcggtcggaggacaacacatccgggccttggggaagatatcggcggcccacccccgtctgccaaggggtgcgacagatgcgaccatggaagggggcgggtgctgcccgcagcgcttgccgccctgccgggtgtggtgcatctattgagcggagggccggctcgcgccaccagaccgcccccactcccccgcccatcattcgcggagcctttgaaaccatgtccctccccgaacttgaagatccgttcgagcagttcggcaaatggtatgccgaggtgcgggacgaacccgcgatcaccgagccgacggcgatgtgtgtcgccaccgccgggagcgacgggctgccggcggcgcgcatggtgctgctgaaggcctgggaccgcgacggcttcgtgttctacacgaattacgagagcgacaagggccgcgacctgctggccaatccgcaggcggcgctgctgttctactggatgccgctgggccggcaggtgcgggtgcagggccgggtagagcaggtgacggcggaagaggccgatgcctatttcggcagccgggcccgagacagccagatcggcgcctgggcctcgcgccagtcgcggccgatgaccggccgctacgatcttgagaagcgggtggcggaattcgcgatcaggttcaatgtcggccgggtgccgcggccggattactggtcgggtttccgggtggtgccgcagcgtatggaattctggcaggaaggccgtttccgcctgcatcagcgtctggtctatctgaaggacggggacggctggacccgtcagtggctgttcccgtgatcagaccgctgggcgttctggcgccgcccgatcccgaggtggcgcggctgaagcggcgggtgacgctcgcctcgcttgcggtcgcgctcatcctggtggcgctgaaactcgccgcctcgatcatgaccggatcggtcagcatcctgtcgagcctggtcgacagcgtgtcggattcgggcgcaagcctggtgacgctgatcgcggtgcgccaggccatgcgcccggccgatgcccatcatcgcttcggccatggcaaggccgagccgctggcagcgctgggccaggcactgttcgtgaccggctctgccctgttgctgtgtgtcgaggcggtgcgccggctgatcgaacccgaacccgtgggcgaaggaccggtcggcatcgccgtgatggtcttcgccatcgtggcgacactgctgctggtccgctatcaggaccgggtgatcgcccgcacgcagtctctggcggtgggggccgaccggctgcactatgtgggcgacctgctgatcaatctgggcgtcattctgtcgatcctgctcagccagtatgccggcgtgaccgaggccgacccggtgatcgccgtgctgatcgcgctgcacctgatccgcggcgcctggaagatcgcgcggggcgcgctggatgcgctgatggaccgggaactgcccgaggccgagcgcgacgagatccgtaagatcgttctggcggtgccgggggtgcgtggcatgcacgacctgcgcacccggtcgtccagcgtgcacaccttcatccagctgcatctggaactggatccggcggcaccgctggcggatgcgcacgggatcgccgatcgggttgaaacgctgctgcgtgcacgttatcccgatgccgaggtcatcacccatctcgatccgaagggcgtgacggaattcgttccgaccttccgctgatcgtatcgacggtagtgatgccgaaacatctccactacaggttgtcggtttgctaggctctcgcatggtggatcgcgttgcgaccatcaggccccatgtcgggcgacccgcctgtcgacgtccagaaggaagactgccgcgatggatcttgccagccatatccgccgggtgcccgatttccccaagccgggcatcctgttctacgacatctcgaccctgctggcccattccggggcctggcgcgagaccatcgaccggatggcggaagcgatccgtccgatgcagccggatcttctggccgggatcgaaagccgcggcttcctggccgctgcccccctggcgctggcgctgggcaaggggttcgtgatggtccgcaagcgcggcaagctgccggggcgcacggtgtctcatgcctatgcgctggaatatggcgaggatgtggtcgaggtgcaggacggcatgatcgagcgcggccagcgggtggtgctggtcgacgacctgctcgccaccggcggcaccgctgcggcgtcgatcgagctgctgcgcaaggtgggggccgaggttccggccgctgccttcatcattgaactgatgggcctcggcggccgcgagcggctggacgtgcaggaggtgcggaccgaaaccgtgctgcagttcccggcctgaccagatccgccgggaccatgggcaggatcaggcgccggcgctgatctccgcatgacgcgggcaggtcgtgaggtggtcgttgaccagccccgccgcctgcatgaaggcatagactgtcgtcgagcccagatgccggaaacccgcctgtttcagccggcgggccaaggcatccgagagggcggtcctgcccggcacctctgcaccggtcgtgaaatgattggtcagcggctgcccgtccaccgccgcccacagaaaggcggcgaggccgggcccgctgtcgcgcagcgccagcgccgcccgggcattggcgatggtcgcctcgatcttgccgcggtggcggatgatgccggggtcggccagcaggcggtccacatctgccgggccgaaccgggccaggatgtcgggatcgaagccggcgaaggcccggcgaaagccctcgcgccggcgcaggatcgtgatccacgacaggcccgactgaaagctctccagcaccagcatctcgaagagcggccgctcgtcgcggaccggtacaccccattcggtgtcgtgataggcccggtagagcgggtcggtgccgcaccaggggcaggggccgtgccttgcttcctcctgctcagccatcggttcgcggccgggcggtgatggtcagcccctgggcggtgagggcggggccgctgccgtcggtggctgcggtcgtgcggtcgatgcgcagcaaggcgaggccgacggggccgatcgcgctgcgcagctggccggcctcgcgttcccccgccatcaccggcgtgcccggggcgggcaggggcgcgccatctgtggcatcgaccacgaacaggcgcttgcggacctggccgcggaacttgctgcgggtggtgacctcctggccgacatagcagcccttgtcgaacgcaaccccgttcagccggtccagatcatgttccagcgccagcccctgttcgggcggcagatcctcggggccttccggcacgcccgcctcgatccggtgcagatgccaggccgcttccggcaccggggtgagaccggtatcggccgcaaaggcttcaagcgccgcctcgggcccccagagccgcaggccgaggccggccccacgcggatcggggacctgcagaacatcgttgccgtcgccctcgacgacaggtcccgcatcctgcacccccgggccgaaggcgaccgcgacagcaagcccggctgcgggtgcgatcctcaccttcgcccgcagcttgtaaagggtcaggcgccggatcaggtcggcggcaaggccggttgcgcattcgaccagcagccggtcgtcgccggcgcgggccacgatcaggtcatgcaggatcttgccctggggcgtgagcagggcgccgtaacaggcccgcccgtcggccaccgggtcgagatcgcccgagaccagaccgtcgaggaatttgagcgcgtcctctccctccaccgcgaccaggctgcgggcgggcaggcgggtgaaggcggggaccgtcggccggaggggcagtgtcgcggtcgtcgtcgcgggctcggtcatggcgatggatccggatccttgatgggcgggcggacaaggtcgctcaacagtggcgtcgccgggccgatggttcaagaggcgacggccggccatgaccggccatggttgcgcccgaacccccgcgcgccctataaccggcgggatgcccatctccgggaccgcgcatggaattgctgttcatcacctcgacccgcatcggtgacgccgtcctgtcgacgggactgctcgatcatctgatcgcaaccgaaaccgctgccggccgcccggtaccgcgggtgacggtggccgtgggcgcgcccgccgcaccgctcttcgccggggtgcctgggctggtgcgggtgctgccgatcgtcaagcggccccacgccggccactggcgcgatctctggcgggccacgatcggcacgcgctgggatctggtggtcgatctgcgcggttccgccatcgcctggctgctgcgggcccggcaccggcgggtgctgtcgcgccatgaagacggccggcacaagctttatgaactggcgcgcacgcttgatctggacccgccgcccgcaccgcgcatctggacccgcccgcaggatcatgccgcggctctggcggcctttccggaaggttcgcagcccatcctggcgctggcaccggccgcaaactgggtgggcaagcaatggccggcggagcgtttcgccgaactggtcggtcggctggccgggccgggcggggcgatggccggggcacgggtggcggtgatcgccgccccccacgaacgtccgcaggccgagccggcgctggccgctgcgcgcgcggcggggctggaggcgcccgacatcatcggcagcctgccgctgctgggcgtgcaggcgctgctggaacgtagcgccctgttcatcggcaatgacagcgggctgatgcacatggcggcggcggccggtgcgccgaccctgggcctgttcggccccacacccgattcgctctacggcccctgggggtcgcatgccgtggcggtgcgcacgcccgaatcgtatgaccgcctggccgccgaacggccgacctcacccgccgatcgctgctacatgaccgggctggccacggatacggtggaaggggcggcggtggcgctgctcgaccgtgtggcgcggtcgggacggataccggcatgaccgcgcggccggccgatctcgccattctgctgccgccgagcgacagtttccaggcggcgaatgccggcgcgatctcgttgtcggtgcgcgatttcgtccgcttcagcggctatgccgaccggaccacggtgttcggcgcccgggtcgacgagccctttgcgggcatccgtttccgcgggctcgccacccgcgggctggcgggctctcgccggcttgcctatctgctctcggcaacccgtgccctgctgaccgcgcgcccgaagctgatcgaggttcacaaccggccggaattcctgccctggctgatgcgggtggcacccggtgcgggcttcgcgctgttcctgcacaacgacccccaggcgatgcgtcggttccgcagcgcgggcgagcgtcgggcgctgctcgcccggctcgacacggtgttctgtgtcagcggccatatccgatcacggctgctggaggggatcgacgatcccgcgctggcccgcaaggcggtggtctgcccgatcggtttcgacctgccggtgttcgacgcgaagcgtgccgcgatatcggcaccccgagagccggtcgtgctcttcgtcggccgtatcgtgaaggacaagggcgccgatctgttcgtcgaagcggcggcggcggcgctggccgaccggccgggctggcgggcggtgatggtgggtgccgaccggccgccggagggggcgactgcccgcgcggcggcggtgtcgccgttcgaaacggcggtgcgggcgcgggtggcggcgatcaatgccggccgcgaccggccgctgatcgagatgaccggattccggacctacgaccaggtgctcgacctttacggccgggcggcaatggcggtggtgccctcggtctgggacgagccgttcggccgcacggcggtggaggccgtggccatgggctgcccgctgatcgcgaccgaacgcggcggtctgcgagacatcgtccatggtgcgggcctgacgctggatccggccacgccggatgcgctggcggccgcaatcggcgcgctggccgatgatcccgcgcgccgcgaggccctggcgcggaacggccgtgcgcatctggaccgccagggctacgatatccgcgacgtcgcggccgggatggaccgggcccgccgcgaccggctgggacagcccgtgtccgccccgccggtttcgacgtccggtaacccgccccgacccccgctaacccaacggacggatgatgcctgataccgaacagccgcgacctgcgaccgcccccgaccgtcccattctgcagagggacggcctgcagagagacgggcggccgcttcgggtgatgcagctcatggcgggtgccgcccatggcggtgccgaagccttcttcgaccgcctggccatcgccttccatcgcgccggcatcgagcaggccatcgcggtcaggccgcatgaagagcggatggcgaagctgagggccgcggggcttgaccccaaggggctgcgcttcggccgccatgcggatctgaagacctggtggacgctgcggcggatggtgaagcggttccgtccggacatcgtgctcacctggatgaaccgggcgacggcggcctgtccctcgggcgatttcgtgcatgtcgcccggctgggcggctattacgatctgcgccattatcggggtgccgatcatctcgtcggcaatacccgcgacatcgtcgcctatctgcgccgcaagggcgtgccggccgatcgcagccattacgtgccgaatttcgtggacgcaacgccgctgccggccgaaccgcgcgcccgctggggcacgcccgaggatgcgccgctgatcctgggcctcggccgtctgcatccgaacaagggcttcgacgtgctgatccgggcggtggcgcaggtgccacgcgcccatctgtggatcgcgggggtgggctcgctggaagacgatctgcgcgagctggcgcggtcgctgggcatcaccgatcgggtgtcgttcctgggctggcgcgccgatgtcgccgccctttatgccgcggccgatgtgttcgtctgctcgtcacgccacgaaccgctgggcaatatcgtgctggaggcctgggcgcatcatgtgccggtggtggccgccgcatcccaggggccgtcggagctgatcgcccatggcgtgaacgggctgctggtgccggtcgacaatgatgccgccatggccgcaagcatcgagacggtgctgcgcgagaccgccctgcgcgagaccatggtcgcaggcggccgggcgacctatgaggggcatttcaccgaggcagccgtggttcgcgcctatgccgatctttttgcccgcatcctgcccacccgctgaccggaacccgccgatctgagaggaccgcccccatgtgtggcatcgccggcatcatgacccgcgacggcagcccgcctgcggcggaactgctcgaccgcctggcccgggggctggcccatcgcgggcccgatggccacggggtcacggtgcgcggcggggtcgggctggtccatacccggcttgcgatcatcgacctcgtcaccggcgatcagccgctgctctggccgctggaccccggggccggggaggcgggcggcacgctcgcactggtgggcaatggcgaaatctacaactatcgcgagctgaaggccgagctggccggccacgctttccgcaccggatccgattgcgagccgccgctgccgctgtacctggaacaggggttggacgggctggatcggttgcgcggcatgtatgcgctggcgatccacgatccgcggcagggcgggcggctggtgctggcacgggaccccttcgggatcaagccgctctattatgtcgagggggcgttcggtcttgccttcgcctcggaaccgggggcgctgatccgggccgggctggccggcgcggcgctggacgatgcccgcatcctggaactgctgcagctgcatttcaccaccgggcccgagaccgtgttcccggcgatccgccgggtgttgccgggcgaacggctggtggtgacggcggggcaggtgaccgctcgccggcagagcccggccctgccggcagccgatgcccgacctgaccccgatcccggccgcgacatggcggcggcggtcgaggccttcgaccgggtgttcgaacaggcgatcgacctgcatcagcgcagcgacgtgccctatggcctgttcctgtcgggcggcatcgacagtgcggccgtgctggcgatgatggcccggctgaacccgcgcccggtgaccgccttcacggccggatttgccgatggcggcgtccacgacgaacgcgcccaggcccgcatcgtcgccgatgccgcgggtgccgagctgatcgagaccctggtcacgcgtgcggatttcgaccggatcgccccgctcgcggcacaggcgctcgacgaccccacactcgactatgccgtgctgccgagcttccgcctggcggagatcgcccggccgcaggtcaaggtggtgctgtcgggcgagggcggggacgaacttttcgccggctatggccgctatcgccgggccgcgcgctggcggctgctgggcggccggccgatgcggcgcaagggcgatctggacgggacggggctgctgcgtcccgaatacgaggcggcggccgcgcgctggcgcgacggcatggaggcggcagagacggcggcggcgcaggcgggcggcagccggctgcgccggcttcaggcggtagactgcaccgactggttgcccaatgacctgctgctgaagctggaccggatgctgatgttcaacgggatcgaggggcgcaccccgttcctcgatcgcggcgtcgccggctttgcgctgcccttgcccgatcggctgaagatggatggccggtgcggcaagctggtgctgcgccactggctggcgcagcacctgccggccgccgcaccctttgcgccgaagcgcggcttcaccgtgccggtgggcgcctggatcgcggccgatgccgaccggctgggccatctggtggcggacgagccgctgatcgcccgactggcacggcgcgaggcggtgatcgggctgttccgcgaggccggccgccagggacagcgtgcctgggggctgctgatgctggcgctttggcatcgcatccatgtggcgggcggcgcaccctgcggggacatcgccgccaccctggccgagacctgaccggcttccggccggtcagtctaccccttccacctttgcccgatagaccaccggccagtcgtcccaggcgatgccctggcagatgcccatcatctccatgccggccagacggaaacgcgcgccatcccacacccagcgcgcgcccaccccgcaatcgccgatcccgcgccccttggcgaaggtggagagcgtgcgggttgcggggtcgtagccgggattgatcagctcggccgcgcccatcagcccgtcgggcacatcgaacacggccggcaccggctcggcgccctcggttgcgacgaagaaatcataggcgacgttgtaggcgccggagaaacaggcctggccataaagaacatgggtgtcgtccaggcgttcgatgatcggatcgaactgttcggcggtggtggactcgcagtcgccgtcgtccgacttacgcgacaggatcgccggccgggccgccggcaccggcttttgagacgccggcgccgcccggatcaccggcagttccggcaccggcggcacggcatcggccggcttcggaccaggcttccaggcggcggtgacggtgtcgacccggccctgggcgtcgtccagaaacagcatcgccgctgccgatccggagagcgagatgccggccttgaccgggatggtgacggcgccgcccgagagtgtcaccggcagcgtgtcggcgcggcgcagctggtcgagcagcgccggcaggctgtcggccggcaggtccgccaggaccacaccgccttcgatccgggccggggcggtcgcgaccgcaggcccggcatcgccacccacccgcagcgtcgccgtgccgcctgttgcctggtcgaccaggatcatgccgatccgggcggtgagcggcgccgtagccgcaccctcacgggtaaggcgcagccaggcaccgtagtgatcatcggccggcgccatttccggcccataggccgagcacgacctgaggttgtcgcaggcaacccaccagtccttgaagctgcgatcggcggcggcctccgagacgatcggcggaagggtgagaacgcctgccagcgtgaccgcggcgagaacggggcgacggcgcccgggcagggcggccggaagggggcgacggatcatggcgtgttccggtgtgggtggggcggctggtggtcgacgggaccggcattctggccgcttctgcctcatggaaccagtgtccctgatgtggcgatcaatggtgttgtatcgcgtatcagcttcgcgcttcgcgggtggtgcgcgcgataagcgtaaaatatgatgaaacgccacaggttctgccgctacacttcgatcagcccccctgacaggtcggagacggatgagcgaacagcatcccacacgcctgcgtcctcaaccggaaggacaatccggacccgccggccggcgtggccgctggcatggcctgccgcgctggtccccgggtcgctggcggctgatccatgcgctgatcgtggcggccgtaggggtgtttctgctgttcgtcggtgtgggggcggtgcaactggtcaccgcctatgaccagccgctgaaggacgcagcggtgcgtgccgaaggcaccgctcgtctgctggcggagcatgccgcccggacgctggaaggggtggatctgacgctcggccgcgcgatcgacatggccgcctccgggccggctcccatggcggaggccggcggcggtgccgaggcgcgccggcttttcgagcggcttgaggcgatcatccgcaccggcaccgcgctgagcgcgatctgggtgatcgatcgtgagggacggatttatctgcacaccggcgtcttcccggcgccgcctgtcgatctctccgggatggcggccgtgcagcggctgatgctgaacccggcggtcggaccggtcgtgggcatgctgggcgatggtggtgccggggcccgcaaggaggtcttcctggcccgtgccttgacggacgaggctggcgatttcaccggtgcggtggtggtggtggtggacgccgaccagttcgcggcactgtatcgccttgcttcggtcggaccgaatggccgggtgatgctgctgtcgtcgctggccggtggcgtgatggccgcggcccccgacctgcccgatgaaacccggctgcggatggcggcgctggcggaggaggtgccgccgatgcctgccgatgcggaccatccaggccctgccgggccgtttctggtgggagaggaggatgtcgacggcccctgggtggcggccgtggcgccggttcatggccgcgacatgcaggtggcggtgctgctggccacagccgatgccctgggcggctggcgggcttcagtctggcggacggcggggctgaccctgatcgtggccgccgggctcgccggcacggtgctgatcgcgcgcagcaccgtgtcgcggccgctggaccggctgtgtgcggcggtgcgccgggtggaacagggcagtttcgaccgcccggtcggcggcagcggcggcatccgcgagatcgaggatgccatggccggcatagagcatctgcgcctgtcgctggcccatctgaccgaccacctgaatgccgaggtggagacccggacccgcgagctggaagaacgcagccagcagttcaatgcagcgctggagaacgtcttcctgggcctcgccatgttcgacgccgagcgccggctggtggtgtgcaatcagcgctatcgcgagctgttcggtttgagtgaggaactggcctgccgcggcaccacgctgcacgcgatccttgaacatgccgcacgggccgagggctatgtggtggccgagctgggcgacatcctgtcgcggcggctggcccggctggccacccgcgagatccgcacctggtccgaggagctgcgcgacggccgggtgctggaccagttcgtccggccgctggcttcgggcggtgcgctgctggcggtgcaggacgtgaccgaacagcgccgtttcgagcaggcgctgatggaagccaagatggttgccgagcgcgccaaccgcgccaaatcggaattcctggccaatatgagccatgaactgcgcacgccgctgaatgcgatcatcggcttttccgagatcatcggcgccgagatgttcggccctgccggcaatccgcgctatgcctcttacgggcgtgacatcgcgacatcgggccggcatctgctgatgctgatcaacgatatcctggatttgtcgaaggtggaatccggccggatgagcgtggaggtgaaggacgtctcgccggccggcctggccgccaactgcctcaggatgatcgagccccaggcccagcagaacggggtccggctggtggtcgaggttccggacgatctgccgcggctgcggaccgacgagcgccgcctggtccaggtgctgatcaatcttctgtccaatgcggtgaagttcacgccgcgggacggcacggtgtcgctgcgggcaagcctggctggtgaccggctgatcctgacggtagaagacaccggcatcggtatgacgccggaagagatcgaggtggcgctgagcgtcttcggccagatcgaaagcgccatgcatcgccgtcatcacggcaccggcctcggcctgccgctggcggcccggttggtggaactgctgggcggccgcttcgacctgaccagcgctcgcggcgtcggcacccgggcggtggtggtgctgccgatcgatggcggtgctatgtcatcggtgcgggatgtggagatgagcggcgcgtcctgaacctgcatgccggtcgcttcgtcggaaaacggctcccgagacgaaaaagcccgcctggagcacatctccggcgggcggcaaacaatctgatctgcaccaggtcgagatggtgccgccggcgtggattgaacacgcgacctctcccttaccaagggagtgctctaccactgagctacggcggcgcctctggcgaagcggggcggaacctgccatgaaatccgaagagccgcaaccggatttttccggaagatcatcctgatttcgggcgaggccgccatcattcgcggaagctggtgccgccggcgtggattgaacacgcgacctctcccttaccaagggagtgctctaccactgagctacggcggcgacgctcgcgaatgtgggcggggtgtgccatgtttccgggcgtcatgcaaccctgttcttcatcgaaccctgatccgactgcaaggccagacgcccgatgaccgaccgcaagccgatcgaatccattgatatgacatcgaaatccgcgccagagcccaggccacgcccgaacgagaccgaggcggcgcgccaggcggcggccgaacgccgggcgcggcaggcggcgcagttgcgtgccaatctggcccggcgcaaggcgcagtcccgcgaccgtgccgccgaggacgaagggctctgacccccgtgctgccgatgcaggggagagttccgccaacgcggcgttgagccgtgctgcggcgtcgtctataagtggccggctgcctgaccgcagcttcgggcctgcaccgcccgcccattcgtgcccggcccgcaccatctggggccggccgcatgccatgggtggcggaatgcgggccttcgcctgttgccagccgcctgcctttgcccgctgccaaacgtccgggagacgccccgatgtcgatcatgtccgatctgtggatccgcgaaacagccttgaacgaggggatgatcgagcccttcgtcgagaagcaggtccgcgagggcatgatctcttacggcctgtcgtcctatggctatgacgcgcgcgtcgccgacgagttcaagatcttcaccaatgtcgacagcgcggtgatcgatccgaagcagttctcggatcagagcttcgtggaccgcaagctggatgtctgcgtgatcccgccgaacagcttcgccctggcccggacggtggagtatttccgcatcccccgcgacgtgatggtgatctgcgtcggcaagtcgacctatgcccgctgcggcatcatcgtcaacgtgacgccgctggagccggaatgggaagggcatgtgacgctggagttcagcaacaccacgccgttgccggccaagatctatgcgggcgagggcgcctgccagtttctgttcctgaagggcgatcgcccctgcgagacctcgtacaaggaccggctgggcaagtatatggggcagcggggcgtgaccctgccgcgcctctgagatcgggatccacgtgaccgtactgaattcgactgcactgcagcaggcatcgttgctcgatcccactcccaggcagaacggggcaggcatggacagcatccgtatccgcggcgggcggccgctcgaaggggcgatcccgatcgggggcgccaagaatgcggcactgccgctgttggccgcggccctgctcaccgaggaccggctggttctgtccaacctgccgagcctggccgacatcaccacgatggtgaagctgctggcccagcacggtgtgatctgcgcgatcgacgaggcacgcgatgccgccaatggcggtcgggtgatcaccctggatgccggccggatcagcaacaccaccgcaccctatgatctggtgcgcaagatgcgcgcctcgatcctggtgcttgggccgctgctggcgcgggtgggcgaggcccaggtctcactgcccggcggctgcgccatcggcacccgtccggtcgacctgcatctcaagggcctggaggaactgggtgcggtcatcgagcttgagggcggttacatccatgcgacggcgcccaaggggctgaagggcgcgcatatccgctttcccttcgtctcggtgggggcgaccgaaaacctgttgatggcggcggccctggccgagggcaccaccgtgctcgacaatgccgcgcgtgagcccgagatcggcgatctggcccgctgcctgaccgcgatgggtgcgcgcatcgagggcatcgacaccgagaccctgaccatccacggcgtggcgcgcctgcacggcgccacccatgcggtgctgcccgaccggatcgaggccggcacctacgcgatcgccggcgcgatcaccggcggcgatgtggagctgaccgggctcgatgcggaactgatccggtcggtgctggacaagctggaagatgccggcgtgcgggtcacccccacggcgcggggcgtgcgcatcgcccgcaccgacggtccgctgcgcggcaccgatgtgatgacccaggtctatcccggcttcccgaccgacatgcaggcgcagttcatggcgctgatgacggtggcggagggggccgccatggtcaccgagaccattttcgagaaccgcttcatgcatgtgccggagctgcaccgcatgggcgccaacatcgtgctccacggcgcctcggcgctggtgcgcggcgtgccgcggctgaacggggcgccggtgatggcgaccgatctgcgggcctcgtcgtcgctggtgctggccggtcttgccgcgcgtggcgaaaccctggtcaaccgcgtctatcatctggatcgcggctacgagaacatcgaagccaagctcgccgcctgcggcgccgatatcgtccgggtcgccggcggcgcctgattgtcgccgcggccgaccctgcggacagcaaaacccgaggacatgtcagagatgagccccgccaccaccgcccgccgcggcctgacgatcgccctgcccaaggggcgcatcctgaaggaagtgctgccgatgatggcgcgcgtcgggatcgagccggagcccgacttcttcgacgacgcctcgcgcaagctggaattcgagaccagcgtgccggacatccggcttgtgcgcgtgcgcagcttcgacgtggcgaccttcgtggccttcggtgccgccgagatcggcgtctgcggccgcgacgtgatcatggagttcgactatccggagctctacgcgccgctggacctgaatatcggccgctgccatatcgccgtcgcggaacccgccgatctggcccatggcgacgatccccgccgctggagccatgtccgcgtcgcgaccaaatacccccatgtcacccgcgcctatttcgcggcgcgtggcgtgcaggcggagtgcatcaagctgaacggcgcgatcgagcttgcgcccaagctcggcctctgccggcgcatcgtcgacctggtctcaaccggatcgacgctcaaggccaacggtctggtcgagatcgagaccattgccgaggtgacctcttacctggtggtcaaccgggcggcgctgaagacccggccgcaactggtcggcacctggatcgaccgtttccgcgaggtggtgaacgatgccgttccggcttgacgtcaacgacccgtccttcccccaggacttccaggccctgctgggcatgaagcgcgagaccacggccgaagtgaacgacgccgtgcatgcgatcctgcaggatgtgcgcctgcggggcgatgccgcggtgatcgactacaccgcccgcttcgaccggatgaccatcgatgccgagcggctggcgatcaccgccgaagaagtcgatgccgcgctcgcggcctgcccgcatcacctgctcgacagcctggagaccgccgccgagcgcatccgcgcctatcacgcgaagctggtgccggaagatctggactatgtcgacgagaccggcgtgcggctgggggcgcgctggcggccggtggcggcggccggcatctatgtgccgggcggtcttgccgcctatccgtcctcggtcctgatgaacgcgatcccggcacgggttgcgggggtcaaacgcatcgccatggtggtgccgacgcccgggggtgagatcaacccgctggtgctggcggcggcgcggatctgcggcgtggacgagatctaccgcatcggcggcgcccaggccgtggcggcgctggcctatggcaccgagaccgtggccccggtcgacaagatcgtcggccccggcaatgcctatgtcgcggcggccaaacgccaggtgttcggcacggtcggcatcgacatgatcgcaggcccctccgagatcctggtggtggcggatgcggccaacgatccgcgctggatcgccgccgatcttctgtcgcaggccgagcacgacaccgccgcccagtcgatcctgatcaccgatgatgcgggctttgccagccgggtggcgcaggcggtggacgagctcctggcgaaactgccgcgcggcaatatcgcggccgagagctggaacaccaatggggcgatcatcgtgaccggcgatctggcccaggctgccccgttgatcgacagcatcgcgcctgaacacctggaactggcggtggacgaccccgatgcgctggccgcccgggtcaacaatgccggcgcgatcttcctggggcgttatacaccggaggcgatcggagactatgtcgccgggccgaaccatgtgcttcccaccgcacgcagtgcgcgttactcttcgggcctgtcggtgctcgacttcatgaagcgcagctcactgatcgcctgcgacgagaattcgctgagggtgatcgggggccatgcgatcagcctggccgaggcggaagggcttggcgcccatgccctttcggtcgcgatccgcctggatgtggcggacgactgatctgcggtgcgatggaaggcgggcatccggtacgataacggggcccgccgccgttccggggcggcccccgccgacccaccgccgaccgccgccttcaggagtcagcgcccccgatgaccgatagtcccgagcctgagcccaccgatccgcaaccgcgccggccgtccgaaccgcggatcgccaacctcaccctcgatcagggcagcgttctggcctggagcccccaggtcgagcatgagcgcaaggtggcgatcttcgacctgctggagcagaaccatttcgtgccgctgggcgtcgaatcagaggggcccttcgacctgctgctgagcatccaggacaaccggctctatttcgacatttccgagaccggcggccgtcagttgacccggatcaccttgccgatcacgccgttccgcgggatcgtgaaggactatttcatgatctgcgagagctatttctccgcgatcaagacccagagcccgtcgcagatcgaggcgatcgacatgggccgtcgcggcatccataacgagggctcggaactgctgcgcgaccgcctggaaggcaaggttgagcttgacctcgatacggcgcggcgcctgttcaccctgctttgcgtgctgcatatccgtcaatgaggggcggggctgggctgcaggtaccggccggaacgggaaggctgaggacgccgtccagcgtgctgttctgttgcacgttgaactcgatccgctcgccgctcgccgaaggcatgctgaaactgtttcacggcaggcggatcttcgtcgacagcgtcggcgtgcgcaccgcaccgatcgatcctttcgccgtggcggtggccgaagagctgggcgtcgacatctcccgccaccgggccaagaccttcgacgaccttgaagacgggtcctatgacctgatcgtatcgctgtcgcccgaggcccagcacaaggccgtggatctgacccgcgacatggcctgcgaggtggaatactggccgaccttcgacccctcggtcgccgaaggcagccgcgagcagcgcctggatgcctatcgcggcgtccgcgaccagctgatgcgccgcatccgcgagcgctttccgccggcggggtcggtggcgctttagagatcgtgtgtccggatgcctctccgataaaggttgcgtcccggacgcctccggtcgataattcgccgctcgtttccggcggggcgcttatcccgttgccggatcccgcaaaagtttcccgcgccgccgcggcgaccgccgcgtgcggtgcgtgcgttcggttttcccccagattacacacggaagcagaaggttacatggcgaaggaagacgttatcgaattccagggcaccgtcacggagctgctgcccaacgcgatgtttcgcgtgaagctcgacaacgagcacgagatcctggcccatacctcgggcaagatgcgcaagaaccgcatccgggtcctggcgggcgaccgggtgacggtcgagatgaccccctacgacctgaccaagggacgtatcacctaccgcttcaagtgaggcgcggcgtgtccgcgcccgacgaagcggccgctgccggcggttgcaccggcggagcgggggacggcggaccggcgggcgatcatggcccgggcggtcgtttcgcacgtccacgcctggtgctcgcctcggcttcgccgcgccggctggatctgctgaagcagatcggcctggtgcccgatctggtccaggccgccgatatcgacgaaaccccgctcaaggacgaagccccgcgcgcgctggccctgcggctcgcgatcgccaaggcgatggccgcgcgtgaggccctggggcctgcggccgacggggccgtggtgctggcggccgacacggtggtggcggcggggcgccgggcgctgggcaagccgcaggatgcggctgaagcacggcgctttctggaattgctgtcggggcgccggcaccgggtgcatggcgggctgtgcgtgatcgatgccgacggccgcgcgcggtcgcggctggtgaccacccaggtcggcttcaagcgcctgtccgaggccgagttccgcgcctatctcgcctcgggcgaatgggcgggcaaggccggcggctatgccatccagggccgggcggccgccttcattccgttcgtgagcgggtcgtatcccaatgtcgtcgggctgccgctggtcgagaccgcggtgctgctggcggcatccggcatcgacatcaccgctgccgatgccagcccgatgaccggagaggccaccccatgaccaaccggctgctgatcgaccaggcggaacacgaaacccgcgtcgcgctcatcgagggcgatcgcgtggtggatgtcgtgatcgaacgccaggcccatcgcagcgcggtcggcaatatctatctgggcaaggtatcgcgcgtgctgccgggcatgcaggcggccttcgtcggcgtggggctggggcgcaacgccttcctgcatgccgatgatgcccgcgtgctgccgcgggccagggcggcagccgaacgcctgtcgcgagaggcggccgaagcggcagccgcctcggccgcggctgccgccgctgcggccgccgccgtgaccgcggcgctggagcccgacgaagacgctgaagagcccgaggccgtggtggccgcaccgccggtgcccaatgcccgggcccgccgcctgaccatcggcgactgcgtggccgatggcgaccagatcatggtccaggtcaccaaggatgcggtgaaaggcaagggcgcgcggctgaccgccaatatcagcctgcccggccggcatctggtcttcaccccctttcagggtggggtgggggtgtcgcgccggatcgagagcgaggccgaacgccagcgcctgcacgatatcgtgcagcccctggccgaggcgggggagggcggcttcatcgtccgcaccgccgccgaaggggcgacgcccgaggaacttcaggccgatgcccagtatctgcgcacgctctgggcggatctggaagcctctgccgcccgcggcggcgcgccgcggcccctgcatctggatctggatccgctgctgcgggcgctgcgcgatcaggcgcaggaaggcgtggcggaaatcctagtcgacgagccggtggcctatgaacgtgcgctggtcttcgcccgtcgcttcatgccgcatctggaagatcgcatccggctctgggaccggcccgaagcgctgttcgaggtgttcgacgtcgaagaggtgatcgcggaagccctgcagccgcgggtgcggctgccgtcgggcggtttcgtcgtcatcgaccagaccgaggcgctgaccgcgatcgacgtgaacaccgggcggttcgtcggcgaggccgaccaggaagcgacggtgctgcacaccaatctggaagccgccgaggtcatcgcccatcagctgcgcctgcgcaatctgggcgggctgatcgtcatcgatttcatcgacatggagcgggcggaaaaccgccagaagctctacgacgccttccgcgccgcaatggtcggcgaccgggccgcgaccaccgtgctgccgatgtccgagctgggcctggttcagatgacccgcaagcgcggccgcgagagtctggcccaggtgctgaccgaggattgccaggcctgcggcggcaccggccgggtgaaatccgccgagacggtcgcatatgaagtgatgcgcgccgcgcgccgcctgctgctccgcccccggccgggcaaggtggccgcccgggcgctgacggtgatggcggcgcctgaagtggcggcgctgttgaccgaaccccgcctcggcatggtcgaggcggtggccgaactgaccgacgccgtgctggaggtgcgcgccgatccggcgcttgcccgcgatgccttcgatctggtggagcgggactgagcggccggcgtcccggaagaggggaccgatcccatgagccatgacgacaccccggccgcggccggcgagggcaccgccggccagggcagctgccctgtctgcgggcgtccgcgcaaacccgatccggagctggcccgctatcggccgttctgctgcaagcgctgcgccgacatcgatctgaaccgctggctgagcggcaattacgtcgtggccggcgcccaggcggaagaggccgacagcgagctgtggtcggccgacagcctgaagcattgaggcgcggccacgccctgcggcgggagtggttccgggccaagcccttgacggatcaaccatcgtcatcggatgttcattttcgctgaaaacggcgctttacagccgtccggctttgccctataacccgacccacgccgcggcggacgccgcagcgggacacgcccaggtagctcagttggtagagcagcggattgaaaatccgcgtgtcggtggttcaaatccgcccctgggcaccatcttctccgaagccgtcgctgccgacccgatcagggccattcgcagcggcggcttcgtcgtttctcctccccccccctcgatcttcgggttccatgtccattcgggggcagaggggcgccgcccgtgacggcacggcgccaaggcggtgacaagaccgtgcagcgcttgagggcgggggccggatggcccagttccgattcatgagccaacttcatgagccaaccggaatggagcccgatcatgtatcgcgaagccgaaaccaccgaggtcaccgccgccgcccgccgccccctgcgcatgctggcggcggccgtggtcgccatgggtctggccaccgggcttgccgcctgcggtgggggcgacgactcggtcgcggtcgacggccgcaccaagggcgaggcgctgaccgacatgaagggcgcctacgacaagggcgcgatcacccccgacgagtacgaggaacagcgcgaggaaattcttgatgagtgaccacggggtccgtgcgtgatcgggacaaggtcacgcttcggcggtgatggccggtccggctgcctgcaggtgcgacaggatacggacgagatcctcgcaggcgccggcctccgtcccatcgtaatagcggaacatatcctggatcagtgtctgttcacaccctatcaccacgaggatgtggaggcgatgatccgggcgtccgacagccggctttatgcattgtccacctattatccgcatatcgaaggcggccgggaccctgtcgcatccttcgatgccacgctcggcggttgcatagaggcagagcgcgccgccttctatgccggaaatttcctgcgtgttttcggcgagtgatcaggcccggcggccgaacatcaccagctgaccctcggctgcgatatctgcgtcgtatgcggaggcgttgacgcattctttaccgcccgtcctgcattctgagcatcgacgcggcgcatgtctctgccgcactgcgaaaaagccggtcggggatgctttcccgcccggggtgaatgccttaaactttgcccgcgggtgcctggacggcgcctgagggaagtggtccggccccggccggacggcgtgacggccaggagacgggcacggatggcgacggacgagaccgagcctgcagacgatgatatcgactggggcgatgtcggcatggaaatgccgcaggccgcgcccatcgatcggatcaggcgcgcggtggcggtgctgaggcatccggctgcgagcgaagacccgctggcctctgccacccaggcgctggagggcgtggtcgagggcaccgaggccgcgaccgaggcgatcctgtcgcagatcgaggcgatcgaaaccgccctggatgcggtgagcgccgagctgtcgcccgaaagtcaggcccgtgcggcgctggacaatgccggcatggcgatcaccgcgctctacgaggcctgcggcttccaggacctgaccggccagcgcattgccaaggtgcgcaaggtgctgcagcaggtggatgcccatctggaagagctgttggagatcgtgggccatgatcaggtggcggccctgccgccgccggcggagcgcgagggcgatgcccggctgctcaacggcccggtcgacgacgccacccgtgtgtcgcagagcgacatcgacagcctgttcgactgacgtaccaatgcttcgctatgcgaacggcggcgctgtgaagcggccgccgttttcgtttgaggccgatatgtccgcccggtcaggcggcggccgatccgctttccagcgcaacgagatccgcctcgtcgaccgtgtcgaaaccgggggcggcgccacgcacgaagcgggcgctgcatgacgggatctcgccgccgacccgggtccaggcctcgccccagccggtaccgagtcccaggaagcccgcaaccgcatcggcggtggccggcatcaccgggcgcgcgaacagctggaacaggccggcgagccgcgggatccgttccggcgtgccgtaaagccgcgcctgcttcatctgcccgttcagccccagcaccacgccggccagcgccgccagagagaagctgcggccatcgagcgccgcatgcagccgggcccggaaatcgacgatgaggtcgtcctcggcccggtcctggggcagggcggtgccggccaccgggtccagattggcgatggcaccgagcgaggtgccgaggtcacggaccaggaacagattatgggtgcgggccagatcggccagtgacagctcgcgggcgtcgtgtggttccgacatcagcgccagatagaagcgcagtgcctcggccggaacccgatcgagcaggtcgttcaggaagatggcccggccggtcgaggggtcgaagctgcggccggacaggtcggtcagtgccggcggcgccacgatccgggtgtcggtgatcggccccagatccggaatttctgccaccgcctcgatcaggctgcgggcggtgagggcatcgcggccggcgaagaccgtcaggcgcaccggcatcggcttgtcgcccagctggcggccccgctggcggcgcagcggcagcacgcccgggccttcgccctggaaggtgagcacgccgtcgatgccgatcccggcgcggcgcagcgtggcggccgcgcggccgccctcttcgacgccgtcccgcgggctgccgtcccggctgctgcgcggccgcggcgcatcacccgccgccaccagcacccgggccgaccggcccagcaaccgctggccacgggcatagacatcggccgccagccagatggatgcgaaaccggccgcatcgatatcccggtcgccgggcggtgcggcgcacagaatcagttcatcggtcagcaccgtggtcattgccgcggctctccccttgtgccctgtcgcggttgatgccctctcgcgggggtcgatgcccgcgatccgtcaaggttaggagggggggcgacagccgtcaacatcaagggttgttcaattgaaaacgaatgcgcgctgtgagattcatgcctcagacaaaccggcgctggtcgccagtcttccgcgcggccgtgtcgggccgatgcaaataccgcaaaaggaaaacgcccggctcatccagagatgaaccgggcgttttcaaaacccgagcgagtggcgggagtgacgggacttgaacccgcggcctccggcgtgacaggccggcgctctaaccaactgagctacacccccgtagcctctcgcgtgccccaccgtgtctcagtgggtgcgcggtttatagccagtcggcgtgcgcttgaaaagccctttttttcggccttgtgacgattgcgcgtcgccgccacatgttgaagcaagagggccggtatcggcgccggtccgagtaccaaagtcgaggacatcacccatgcccttccaaaccgaggtccgcccgccgagttcgacgatcatgctcaccgcgctccggatgctggtcatgcagccggccgacaagcaccgggtgggggagcgtctgctgcaggatctggcgcgcatcgcgcccaaggcggcagagctgtgcgatccggcggcgcgggccgaattcgaccgccgcgtggtcatcgatctccggcgcctgctggtcgcaggactgatccggcgggttggcgacggcctgctcggcatcaccgatcgcgggcgcgaggcgctgaaggagaacccggaagggctcgacgacaccgtattgatgcgctacccggaatttcgtgcccatctggcccggcgctgcggcctggtgatcgacccggccgcggggctggacggcgcgatcgagccgccggtcgagggcggcgacgcgccgatgcgcaaggcgccggtggtccgcgagctgcaggaaggcttcatcgccttcctggatggccagaccgcgaccgacaacccctatgaaaccgacacccaggccttcatcacctgggaagagggctattgggaggcggcaggcatcgcccgcaacgagatggcttgagcacgacaccatagccctacatgcaaacgggccgcccggggatgtccccgggcggcccgttcttcgagatctggggacggatcaccaggcgacgacgagcgcgcccttgtactgctcgttgatccaatccttgatcttctggtcgtgataagcctcgaccagggtcttggcccagggggcgtcggcatcgaccttgcggaccgcgatcacgttggcatagggcgactcggccgcctcgcgcgcgatcggatccttcaccggatcgagccccgcctcgacggcgtagttggtgttcacggccgaggctgcggtgtcgtccagcgagcgcggcagctgggcggcgtcgagttcgatgatccgcaggttcttcgggttctctgcgatgtcgagcggcgtggccttgagacccgccccctcgcgcagcttcagcacgccctgagcctgcagcagcagcagcgcgcggccgccattggtcgggtcgttcgggatggcgaccgaatcgccgtccttcagctcggccaggctcttgatcttcttcgaatagatgccgagcgggaagaccacggtcttggcgatcgacaccagaccatagccgcgatcggcattctggttgtcgagatagggctggtgctggaacgagttcgcctggatatcgcccgcggcgagcgcctggttcggcacgacatagtcgctgaactcgatgatgtcgatatcgaggcccttcgcggcggcgatcggcttcacctgctccaggatctgggcatgggggccgggggtcacgccgatcttgatctcttcggcctgtgccgcaccggcggcgatgaggccgaggatggcggccgcgccgcccaatgtcttcagaatccgcatctggactggtgtccctgcatcttgtccgtcggatcggggccacgggggcggctgcgaccctgatcccgtccggccgcctcacccttgcgggagacctgccggaccaaacacgaaaaaacccgcgtgacagcgtcgcgcgggtttccgacccctccgctttagctgcatttgtaacgcgcccgcaagctgtggctcaaatcggcgcgacaggggcaccctaaaacaccgccgcgcttacgtcaattgccgatcgacaacacggcagccatgtggaaaccgcaggcaatcctgcccgattgcgaaacggcagcgggcgcatggctttcaccacgcgcccgccgcaggcattccgcagggaccggccgatcaggccgacgtcgccgccgccagcgcctgttcgatgtcggcgatgatgtcgtcgacatgctcgatgccgatcgagaggcggacatagcccggggtcacgcccgaggccttctgctcctcttccgacagctggctgtgggtggtggtggccgggtggatggccaggctgcgcgcatcgccgatattggcgacatggtagagcagcttcagcgcctcgatgaaggcgcggccggcctcggcgccgcccttgatctcgaagccgatcagcgcgccatagccgcccttcagatacttatcggcgcgggcgcgcgcctcaccctcggccagactcggatgggtgacggtcagcaccgccgggtgctccgacaggaacttggcgaccagggtcgcgttcttgttgtgctcgcgcatgcgcagcggcagcgtctcgagcccctgaatcgtctggaaggcgttgaagggcgaggcggcgcaacccaggtcgcgcagcagggtgacgcgggccttgatgatataggcaatggggccgagcggcttcaccgcctgggtccagaccgcgccgtgatagctggcatcgggggtgttcagcagcggctgacgctcagggaaggcttcccagtcgaaggtgccgccgtcgatgatgatgccgccgatcgaggtgccgtggccgccgatatacttggtggtggaatagaccaccacggccgcgccatgttcaagcggccgggcgatgatcggggcggcggtgttgtcgatgatcagcgggatgccgaaggacttgccgatttcggcaacctcggcgatcgggaacacccggagcttcgggttgggcagggtctcgccgtaataggcacgggtgcggtcgtcggtggcgcggcggaaattctcaggatccgacgggtcgacgaagcggacctcgatgccctgctggcgcagcgtgttggcaaacaggttccaggtgccgccgtaaagatcggtcgaggagacgacattgtcgcccgcctgggcgaggttctggatcgccagcgccgaggccgcctgacccgaagagacggcgagcgccgccacaccgccctcgagggcggccaggcgctgctccagcacgtcggtggtcgggttcatgatccgggtatagatgttgcccagctccgacagcgcaaacagattggcggccttcgcggtgctttcgaactgatacgacgtcgtctgatagatcggcaccgccaccgcgccggtggtggggtccgcacgatagcccgcatgcagaacggccgtctcggggtgacggtactgggtcatcttgtctcgctccctggatggtgccgggcccggatcatgtcttgaagggggcagtgccggcccgttgcggcactgtatataaacgacacgcattgtggaaccggcttcaaacacaaaaaatctttgtcaatttggcagaaaaaagctcccgacgatgatgaccgccgggagcagaggggccgggaggccctgcgggacaggaaagaggacgccttgcggcctgcggcagctcagccgggcaggccggtgccgctgtcggccacttcgcgatagagggcgaccagggcgccgtgatcgttgaagcggtcggggtcggatcggctgccagccggtcgcagaccgcatcgatcttgtcgatgtcgatcaccaccccggcctcggccaggcggcgggtgatggcgttgcgcggcgtgccgccgaccatgatcgcattggggcgaagcgccgccaccggccgcaccggccaggcctcggccgtgcgcacccagccgagatgggtgggggcggtgacggtgcgggcctcggtgccgagcagcggcttggtcggcatcagcggcaggcggatcatctcgcgcagggcatgggcggcctcgatcaccggctccagcgccacatcggtcgcaagccccatgcgcgggccgttgagccgcagctgggcgatcgcctcttcgagtgcggtgttgccggcgcgctcgccgatgccgcagagcgtcgcctggaagctgtcggcgccggcttccagcgccgccagggtgttggcgagcgccagccccatatcgtcgtggcaatgggccgagaggatcacgtccggaccgacccaggaccgtatggcgcggaccagggcggcgaattcatggggcagggcacagccgaccgtatcggggatcgcaaccgtgcgcgcgcctgcttcgaccgaggccttgagcaggcgctccaggaagggcagggagccccgggtggcgtcttccggggcgacggcgatgtcgtcgaaccccagagaggccgcgtggcgcacgctgcgcaccgcctcctcaatcgcctcttcggcggtgatccggcgcttgtgctccagatggatttccgagccgaccagcaggatctcgatctgggcattgccgctggagcccagcccctcggcgatgatgtcgatgtcgcgttcggcggcccggcagaaggcgcagatcttgcttgcccgcgggccctgggccatttcgcggaaggcttcgaaatcctcgcccgacgaggccggaaaaccgccttcgaccagatccagccccagcgcatccagccggcggaacatcgccaccttctgctcggccgacatcacattgcccggcgcctgctcgccgtcgcgcagcgtggtatcgaagaccatcacccgtcgcggctgaggtgcggtggcgggctggcggatgtgaacgatgccgttctcggtggtgtccatggcttgccccgtcgctggctgctgccgatcgtgcagaaccctttgatcgtggcgcgggtctgcatacacaaccactggtacatatacctgatggttttgtcgatccaaaacttacacgcgccttgcgcgatgatgcggtcccgggattggcagtcggggatctgggcggtatcacagcatgtctgcaccgccttccgaggagctgcccccttgatcgaccggctggagttcctgctggccctgtcccgcgaacgtcatttcggccgcgccgcccaggcctgcggcgtgtcgcagcccacactctcggctggggtgaaggcgctggaggacatgctcggcaccatgctggtccagcgcggctcacgttttcgcggctttacgccggaaggtgagcgggtgctggactgggcgcggcgcatcgtcggggatgcacgctcgatgcggcaggagatcgatgcgctgaagcgcggcctgtcgggcacgctcaggatcgcggtgatcccgaccgcgctggggatcacgccgcggctgaccaccggcttccggatccgcaacccccaggtccgtttcgccatacgaacctgcacctccaccgaggtgctgcagctggtcgatgatctggcggtggaggcgggcatcacctatctcgacaacgaaccgctcggccgggtggggacggtgccgctgtatcgcgagcgttatcacctgctgaccgccgccgacagccccgagggcggccgcgcctccatcgcctgggccgaagccgccgggctgccgctctgcctgctcagccgcgacatgcagaaccgccggatcatcgacggcatgctggcggccgccggcggcgatgcggcgccgctgctcgaatccaattcggtctcggtgctctcggctcatatccgcaccacccgctggtccacgatcatgccggtggggctggccgaggcgctgggtctggtgggcgacggccggatcaatgccgtgccgctggtcgatccggatgtgtctcaccaggtcggactggtcgtaccccagcgtgagccgatgatgccgctgaccgcagccctggtcgctgaagcccgccgcctggtggccgccgacagcgtgtcgatgccccaatcccgatcgcgacgataggaaaagctgatcgtgtaacggaaacgcgatattgatacggcgtcggcccggggccatcctcacctcagaggactttcgcccaggacaaccagaaaacgggccggggaatgacgcgatacgacagctggacgcccgaaaagggcgccctgatcatcggtgatatggcggcggagggccgcacggccctgctgccgatcctgcacgagatccaggcgagcttcggccatgtgccggccgaggcggtgccgatgatcgccgaggcgctgaacctgacccgggccgatgttcacggcgtggtcagcttctatcatgatttccaggaaacaccggtggcaccccgggtgctgaagctctgccgggccgaggcctgccaggccgccggcgccgaccaggtggcccgccgggtggcggagcggaccggccttgcctgcggggaaacctcggccgacggggcgctggcggtggcggcggtctattgcctgggcctctgcgccacggcgccgtcggccatgctcgaaggcccgggcgtcgagggcggaaggcggctcggcgcccggctgggcgggccccggctcgaacgcctgatcgacgaggccgtgcgatgagcgtgacgatctacctgcccaaggatgccgccgcgctggcgcttggcgccgacgaggtcgcggccgaactcacccgtctcgcccgcgcagccgggcgggatctcaatctggtgcgcaccggctctcgcggtctgttctggctggagccgatgatcgaggtggcgaccccggccggccgcatcgcctatggcccggtcgaggcatccgacgtcgaaaggctgatcgcagccggtctcttcgagggtggggctcatccgctccgcctcggcaccgcggcctcgatcccgttcctggcccgtcagacccggttgaccttcgcgcgaaccggcattgtcgatccggcatcggtcgaggattatcgcgcccatggcggctgggccgggcttgaacgcgcactggagctgggccctgagggcatcgtcgaagaagtggtgcagtcggggctgcgcggccgcggcggggcgggtttcccgaccggtgtgaaatggcgcacggtcgcggctgcaaaggcgccgcagaaatacatcgtctgcaatgcggatgaaggcgacagcggcacctatgccgaccggatgatcatggagggcgaccccttcgtgctgatcgagggcatggtcatcgccggcatcgcggtgggtgccacccgcggctatgtctatctgcgctcggaatatccccatgccgcggcggcctttgccctggcgctggacgaggcccgccgcgccgggcttctgggccgccgcatcggcggctcggcccatgatttcgacatcaagctgcgcatgggcgccggcgcctatgtctgcggcgaggaaaccgcgctgctcgacagtatcgaaggcaagcgcggccaggtccgcgccaagccgccgctgccggcgcatcagggcctgttcggccggccgacggtgatcaacaacgtcatctctctcgccagcgtgcccttcatcctggccgagggggcgggggcctatcgcgatttcggcatgggccggtcgcgcggcacgatgccgatccagctggccggcaatgtccgcttcggcgggctttacgagaccggcttcggcgtcaccctgggcgagctggtcgacgagatcggtggcggcaccgccagcggccggccggtgcgggcggtgcaggtgggcgggccgctgggggcctatttcccccgcgccctgttcgacacccccttcgactacgaagccttcgcggcggccggcgggctgatcggccatggcggggtggtggtgttcgacgacaccgtcgacctgcgcgcccaggcgcggttcgcgatggaattctgcgcgatcgaaagctgcggcaaatgcacgccctgccggatcggctccacccgcggggtggaggtgatcgaccggatcggggcgggggatccgaaacagatcaccctgctgcgcgacctctgcgaaaccatgaagttcggatcgctttgcgcgttgggcggtttcgccccctatccggtgctgagcgcgctcgatcattttcccgaggatttcggtgcgggcgcggccgggtccgccgccgcggccgaatgaggagaccggacatgtcgctgatccacgaaaccgattacggcaccccggcctcgcacgccaccgccatggtgcggctgaccatcgacggccgcgaggtggaggtgcccgagggcacctcgatcatgcgggcggcgaccgaggcggggggcgccatccccaagctctgcgccaccgacatgctcgatgccttcggatcgtgccggctgtgcctggtggaggtggaaggccgcaacggcacgcccgcctcgtgcaccacgccggtggccgacggcatggtggtccatacccagaccccgcgcctgcagaagctgcgccgaggggtgatggaactctatatttccgaccacccgctcgactgcctgacctgtgccgccaatggcgattgcgaactgcaggacatggcgggcgccgtgggcctgcgagatgtccgctacggctatgacggcgccaaccatctggtggcggaaaaggacgtctcgacgccctatttcacctatgacccgtcgaaatgcatcgtctgctcgcgctgtgtcagggcctgcgaagaggtgcagggcactttcgccctgaccatcgaagggcgcggcttcggctcgcgggtggcggccggccagggcgaggccttcttcgacagcgaatgcgtgtcgtgcggcgcctgcgtccaggcctgcccgacggcgacgctgaccgagaccacggtgatcgagatcggccagcccgaacgctcggtcgtcaccacctgcgcctattgcggggtgggctgcaccttcaaggccgagatgcgcggcgaagagctggtgcgcatggtgccctacaaggacggcaaggccaatcgcggccattcctgcgtcaagggccgcttcgcctggggctatgccacccatcgcgagcgtattctgaagccgatggtgcgcgagcggatcaccgacccctggcgcgaggtgtcgtgggacgaggcgatcggccatgtcgcccgtgaattccgccgcatccaggccaaatacggccgcaccgcgatcggcggcatcacctcgtcgcgctgcaccaatgaagagaccttcctggttcagaagctgatccgcgccggtttcggcaacaacaatgtcgatacctgcgcccgggtctgtcattcgccgaccggctatgggctgaagaccgccttcggcacctcggccggcacccaggatttcgattcggtcgaacagtcggatgtggtgatggtgatcggcgccaaccccaccgacggccacccggtcttcggatcccggctgaagaagcggctgcgtcagggggcgaagctgatcgtggtcgatccgcgccggatcgatctggtgcgcacgccccatgtcgccgccgcccatcacctgccgttgcgcccgggcaccaatgtcgcggtgctgacggcactcgcccatgtcgtcgtcaccgaaggcctggtcgacgaggcgttcgtgcgtgcgcgctgcgacatggaaagcttcggcgcctgggcggagttcgtcgccgacccggccaattcgcccgaagccgtggcgcagtataccggcgtcgatcccgacgagatccgcaaggccgcccggctctatgccaccggcggcaatgccgcgatctattacgggctgggcgtcaccgagcacagccagggctcgaccacggtgatggcgatcgccaacctcgccatggccaccggcaatctcggccggccgggcgtgggcgtgaacccgctgcgcggccagaacaacgtccagggcgcctgcgacatgggctcgttcccgcacgagctgccgggctatcgccatgtcgccgacgatgccacccgccagatgttcgaggaactctggggcgtggagctggatcacgagccggggctcaggattccgaacatgctggatgccgccgtcggcggcagcttcaaggggctctatgtccagggcgaagacatcctgcaatccgaccccaacaccgcccatgtcgcggccgggctggcggcgatggaatgcgtggtgatccaggacctgttcctgaacgagaccgccaattacgcccatgtcttcctgcctggctccaccttccttgagaaggacggcaccttcaccaatgccgagcgccgcatccagcgggtccgcaaggtgatgtcgtcgcgctcgggcaaggccgattgggagatcacgctcgacatcgcccatgccatgggcttccgcatggattacagccatccgtccgagatcatggacgagatcgcgcgggtgacgccgacctttgccggcgtctcttacgaccggctcgacgcgttgggctcgatccagtggccgtgcaacgacaaggcgccccagggcacgccggtgatgcatgtcgacggtttcgtgcgcggccagggccggttcatgatcaccgaatatgtgccgaccgacgagaagacagggccgcgcttcccgctgctgctgaccaccggccggatcctcagccagtacaatgtcggcgcccagacccggcggaccgagaatgtgcgctggcatgaagaggatctgctggagatccatccccatgatgccgaagaacgcggcatccgcgacggcgatctggtgaagctgcagagccgcgccggcgccaccgcgctcaaggcgctgatcaccgaccgggtggcgccgggcgtggtctacaccaccttccatcacccgatgacccaggccaatgtggtgaccaccgactattccgactgggcgaccaactgcccggaatacaaggtgaccgcggtccaggtctcgccctccaacggccccaccgactggcaggcacgctatgacgatttcggccggcagagccggcgcatcgtggtcgatgcagcggagtgacgaggaccagcggcctttggcccgggtgatgcccgccttctggcacgagggccatgccggcagccgggcgcgcatcatccccgacgaggtcgcggtcgccttcacctacaaccagagcacccatgcggtgatgatggcgagcccggcggatctggaggatctggccgtgggcttcagcctgaacgaggcgatcgtcgagcatcccggccagatcgaggagatccgggcggtggtactggaagacggcatcgatctgcgcatccgcctggatgccgaccgtgccgccggactgatcgaacggcgccgccatgtcgcggggccgagcggctgcgggctttgcggcatcgacagtctggccggcgccatgcggccgccgaagacggtgggggaggggctgcggctgacgcccgatcaggtgctggtggcgctggacgcgctgggcccgcatcagatctgggggcgggaaagccgggcgatgcatgccgccggctggtggcatcccgatcgcggtatggcgctggtgcgcgaggatgtcggccggcacaatgcgctcgacaaactggcgggcgcattggtgctgggcggcctgcctgcggccgagggcgtggcggtgatcaccagccgggtctcgatcgagatggtgcagaaggtggccatggccggtatcacggtgatgatcgcggtctcggcacccacggcactggcgatccgcacggccgaggcggccggcatcaccctggtcgcggttgcgcgcgccgatggcttcgaagtcttcaccggggtacggcggatcgccggcctcgaccaatcctgaggaaagctgaccgccgatgtcccccgacaagctggtgatgatggccaatcagatcggccgtttcttcgtggcccagggccccgatcaggcggcccagggcaccgcggagcatatccgccagttctgggacccgcggatgcgcgcggcgatcctggagcacctggccgccggcggcgaggggcttgacccccatgtccgccgcgcggtggagatgctgcgcgacggttaggccgttgcggtcaggtcaactcaacgcccgggcgatcgcggcaaaaaaggcgtcgtcgtcgatttccagccggcgcctgtagccgggcttggcgcgggcgctcgccaccacgaccaccaggccatgggccgggttgatgtggatgtactggccgtaaatgccttcggcctggaagctgccggccaggatcggatcgtcgagttccggcacccaccacatatagccataggggatgcggcggccgtcgatctgataggggctgccggcctcgtcgcgccagccggcgggcaggatggagcggccgtcgatccggccgtcgtccagtacgaactggccgaagcgggcatagtccgaaagggccgcattcatgccgctgcccgaaatggtcatggcgccgggcgcctcgcaccaccagcgggcatcatgggccatgccgatccgcgaccagatccggcttgaaagatagtcggtgaggcgcatgccggtcgcggcctcgaccaccgccgccaccagatagctttcgccggtgttgtaagcccaggccccgccgggtggcgttgcggcgggcaggccggtcatgaagccgatgatgccgcccggctgccagcgggcctgaacctccagcagctgccggcggtccgagattggatccacatagtcttcattccagcggatacccgagcacatccgcagcacctggcggagcgtgaccgcgcgatagccgccgcccaggggcacatatgccgtcaccgggtcgtcgatcgagccgatcgcaccctcggcgatcgccacgcccacgagtgtggaggcgatcgatttggcgagtgaacaggaatgccagagcgtatccggcgtcacgccgcgctggcagatctcggccacccgccggccgtccttcagcaccaccagcccggcgacggcattggtcgtcagatagtcgtagaggtcgaagacgcggcccttgtcgtggatcgcgagcggcggcaggccgcctgccgggtggtcttggaaatcccgtaccggaccggtcccgcgcgagatggtccgggtcgggaaccagccggtgtcggtggtcatggtccggatcatctcgtcgggcagcagctggccgtcatagaagcgggtgagatgagcgcgggccgcggcggagagggccatgtccggtcgtcctcgtctgtcggaaatcatgtaaaggtatgtcaggccatcacgaaatggccgggcgccacttcgtcataccggcggaccggcggttgccagccggcggggcgcagcgggcttgcgatctcggcgggggcgatgtcgcggcggcggaagcgtgcggccggatccgctaccggcacggcatcgagcagccggcgggtataggggtggcggggatcgtagagcacctgggcgcgcgggccgatctcgacgatttcgcccagatacatcaccgccacccgatgggcgacgcgctccaccacgcccatatcatgggagatgaacagataggcgaggccgagacgggcctgcaactccagcatcagattgaccacctgggccttgatcgacacgtcgagcgccgagaccgcctcgtcggcgatcagcaccgagggttcgagagcaagtgcccgggcgatgcacagccgctgacgttgcccgcccgagaattcctgcggccgccgcccggccatctgcggatcgaggccgaccagggccagcagctccgcaacccgcgcccgggcggcggcgccccgggcgatgccgttgatctccagcggtgccgcgatcgcggtgcccaccgaatgacgcgggttgaggctggagaaggggtcctggaacaccatctgcacccggcgcacggcatcgcggcgcgcaaggccgtcgagcggccggccgtcgaccagcacctcgccggcatgggggcgggtgagccccatgatcgtgcggccgatggtggacttgccgcagccgctttcgccaaccagggccagggtctcgcccggtgcgaccgtgaaggacacgttctccaccgcatggacggccgggcgccgccgggcgaacagcccgccgccggtcagataacgggtggtgaggccgcggatctccagcgccggggtggcggcatggtcgggggggcctgcgagcggcgccgccggggtggcggcaccgctctcgggatcgatcgcatcgaagggggtcgggcgatcgatcgaccgcatagcgcccagccgcggcacggccgcgagcagggcgcgggtatagggctgctgcggggcgtcgaagatccgggcggtcccggcggtttcgatcagggcgccgcggcacatcaccaccacccggtcggcgatttcggccaccacgcccagatcatgggtgatgaacagcaccgacatgccgtcttccgcctgcaattcgcggatcagccccaggatctgggcctgaatggtgacgtcgagtgcggtggtcggctcgtcggcgatcagcagtttcggccggcaggccagcgccatggcgatcatcacccgctggcgcatgccgcccgagaagttgtgcggatggtcgccgaggcgcgaggccgcggccggaatccggacccggtcgagcaggcgcaccacctcggcatcggcggcgcggcggtccaggccgcgatgcagcatcagcgcttcggcgatctggaagccgatggtccggaccgggttcaggctggtcatcggctcctggaagatcatcgacatccggccaccgcgcacccggcacatatcaggctcggacagggtggtcagctcctggccttcaaggcggacggagccggtgacccggctggtcgcggccggcagcaggcgcatcgccgccatggcggtgacgctcttgcccgagccgctttcgccgaccacggctacggtcccgcccggaccgacggcgagcgagatgttgcggacgacgctggtccagccggcggggccgcggaaggcaacacccagcccttcgatttcgaggacgggtgccggggcgggcggggaggccgtctcggtcatgccgcccctccagccctgcggtcgaccggcgtcttcaggccgatccacaccgtcttgacctgctgatactgcgccatcgcttcccggcccttgtcgcgggcgagggagcccgacttgccccagccgccgaagggcgtcttgacgtcgccttcggtgaagccgttcaccgccaccgtgccacagctgagccggcgggcgaaatgaagcgcgcggtcgatgtcgcgggtgaagaccgtggcatgcagcccgtattcggtgccgttggcgaccgccagcgcctcgtccatgccgtcgaccggcaaggtgccgagaaccgggccgaagatttcctcgcgtgcgatcgacatgccggcggtcaggtcgccgaagaccactggtgccagatagctgccggctgcaagcgccggatcgacccggccggcatggaccagtctcgccccctcggcccggccgcgttccagatgggcctgcacccggcggcgatggccggcggagatcatcggccccatcccggtcgcggggtcgagcggatcgcccggcgccagcgactgcagccggtcgacgatccgcgccagatactcatcctgcaggcggcgcggcacgatctggcgcatattggccgagcagttctgcccggcattccagaaggcggcggtcaccgcatggtcgatcagctcaggggtcagctcagcatcgtcgagcacgatgaacgggctcttgccgcccatctccagccctacggtcttcagattgctgctgccggcatattgcaggaacagccgaccgacctcggtcgagccggtgaacgagaccgcgtcgatatcgccatgctggccgatcagccggccggtggtctcccccgggccggtgacgacgttgagcacgccttcgggcagcccggcctcgatcgcgagttcggccagcgccagggtcgtcagcgaggtctcttcggccggtttcaccaccaccgaacagccggcggcgagcgccggtgccagcttccaggccgccatcagcagcgggaagttccagggcagcacggcgccgaccacgccgatcggctcccgcatgatcagcgcgcaggccgcatcgccggtgggggcgacgtcgccatagctcttgtcgatcgcctcgccataccactggaagaagtccggcacctcgccgccgatctctttcaggcagtcgctgaccggcttgccgctttccaggctttccatcaccgcaagccgcggggcggcggcgcggatcagcccggccaggcgcagcagcacctccttgcgccgttcgggcgtcgctcgggaccagacaccgtcgcgaaacgatcgacgggctgcggcaaccgcgcggtcgacctcgtcggcaccgcagagcggcagggtggcgagcaccgcgccggtcgccgggttcagcgtctcgaacagggcgccgctgcgggcggcggctggtgcgccgtcgatgaaggcccgcgagggcaggcgcagctctgcggcgatccgccgggtgtcttcgagggtcgaccaggtcatgggcgcaggctccgtggcgaaagatgggaagcagaccgggcgcaatagctttcagatgccgccataggggcggcgccacctgccggttgcgaagcggtcggcggcgaagggggtgatatcgaccggggccggccggcccagggccagatccgccagcacctggccgaccgcggggccgaggccgaagccgtggcccgaaaagccggtggcgaccagcaggccgggcgtggcggcgggggcgtcgatcaccggcagggcgtcgggcatcacgtcgatggcgccggcccaggatttgacgatcgggggcgtgccggcggcggggaacagcgtcgcgaagcgcctggccgcatccgacacccgtttcggattggccgggatgtcgggcgcgcgcggccgcagggtgcgcgtggtcgcgggttccgccagacgctcgatcaggtcatcggcgaaggggcgccccagcttgagcgagaaggcccgccgccgctggatcaactcgcgcaggaagaagccggcggcgcggaaggaatcgagggtgaggtcgacatcggtgccgccatcggtggcgatgatgcacgacccgtcgggccgctggcgcaggcccagccccgcgcccacgaaacagggcaggtccagatcggccatcggcgcggtcagggccacggtgctgcgcacggttttctgcggcagggccgggatcagcccggccagcaggcgatggctgcgggcgccggccgtgcagatgacagtggatgcagcgatccggccgtgttcggtgacgacaccgctgatccggccggccgcggtctcgatcgcccgggcgccgcaatcctcgatcaacacggcaccggctgcacaggcggcgcgggcgaaggcgagggttgcgagcagcggttcggcctggccgtcgctcgccgccagaatgccgccggccgtggggcggccgaggccggggaagcgctctgccacctcggccgcactcaacagccgggtgtcgtggacccggtcgccggcatctttcagccagccggcatgggctgcctgttcggcatcatcggcggcgacgaacaggcagccgcgctgccgccagccggtctcgtgacccagatcggtccgaagccccggccagagcgacaaagcgagccccgccagcggcagttccgccggatcgcggcagaggctgcgcacgaagccccagttgcggcccgattgctgcgagccgatccgcgcgacctccagcagcaccaccttcagccccgcccgggcgagatacagggctgtcgcacagcccatgataccgccgcccaggatcacggcgtcggccgtggccggcagcggctcggcgccgtcttgcaaccgggcgagggtgtcggcaggggcgtggcccagaagactaagcgacggcatcgagcacggcatccatgtccatctcgacccggatgtcggggtcgaacagcccggcctgaacggtggtgcaggcgggatcgatgccgcggaaggcttcggcatagccgtccatcaccgcgtcgtaatcctcggcccgggcgatgtagatccgcacccgcaccacatgggcgagcccgccgccggcctttgccagaaccgcggcggcattgcggaagatctgcgcggtctgcgccgcggcaccctcggccagggtgtcggtcgcgtagtcgtatcccgtcgtgccggaaatccggacccggtttccggtcaccaccgcccgggcataggcatagcggcgttcccaggcactgccggaatagagccggcggccggtcgaaggcggggtcgaagacacgggatgggggaagtcggtcatctctggcaccgtcgcgggttgaactccgccatgaggatcggagaccggcgccgccgacgtcgatgtcaaaaaatcgcgcctggggtgcaataaatcgaaccggcataggagctggttctatggggcgaggatccctgcgcgagacaggatccgctgtcaccccgccacactttattgggtcgggcctgcgatttattagaatcgacacccgatccggccctgcgatccaattggctcagccgatcgacggcgacgagacagcctcagggagagcggacggatatgcgtgcggacttcgtcatcatcggtggtggcatatcgggggcggcggcggccttcttcctgtcggaagcagggcaagtggtgctgatcgagcaggagagccatttcggcacccacagctcgggccggaccgcgggccagttcaccgtcggcatttccgccgacacgatgcgggtcgccgctgccgccagccgcagcttctttcagaccccgcccgagggcttcgccgaggggccgctgatcagcccgcgcggcagcctgacggttgcgcggcgcgaccggtttgcggtgctcgaccggctggaggcacggatcgccgaggccggcggccgggcggagcggctggaccgcgccggcgcgctcgcggccttcccggcgcttcggcccgagacggtcgatgaggcggtgctggaggtggatgccgccgatatcgatgtcgaccgcctgcttcagggatatctgcgcggcgcccggcgcaacggcgcccagaccgaaaccggtgctgcggtaaccgccatccatcgcgagggcgggctctgggtggtcgataccgcgaccggtcgccacgaggcgccggtgctggtcaatgcggccggcggctgggccgaccgggtggcgggtctggcgggtgtggcgccgatcggcctgaccccctatcgccgcaccgctttcaccttcccgctgatccaggctccggaaggcggcagcatcgggggcgactggccgcatgtcacctcggccgaatacgattggtacgtcaagcccgaggccggctgtttcatgggctcgcccgccgatgcccatcgggttcagccgggcgagatgtatccggaagatttcgacgtcgccctcggcatccatgcgatcgagcgcgacaccaggctgaccatccgccggccgctggccagctgggccggcatgcgcagtttcgtggctgaccgcaaccccgtctgcggcatgtcgggggcggcgcccggctttgtctggctggcggggcagggcggctgcggcgtgctgacctcgccggcgctcggccgggcggtggcggcgatcgcctgcaaccggcccctgccggacgatctggacgactggggcctccgccttgcggcgctgtcgcccgaccggccgggccttgcggccggctgacgccttctcttcccccgcgctgccctatgaccggcaaaaagccggcacgatcgaccaaaaaagaagatccatcgggagacttacgtcatgcagacgccttcgctttcgaagcgcagcttcctgaaactttccgccgcggcaggggtggccggcgcggtcggcggcatggccgcggggccgctccgcgcgcttgccgccgggcccgagccgcgcccgggcggccaggtgatcgccggcatctctcaggagccgacggtgttcaacccgctgatgccgggcagcgaatacgaccagggcatctggtggcaggtgttcagcacgctctggtacatcgacgccgacggcacgatcgtgccggatctggcggcggagctgcccacggtcgccaatggcgggctgtcggccgatggccggatctggaaggtccggctgcgcaagggcatcacctggcatgacggcacgccgttcacggcccatgacgtgaagtacacgctggatctgatcaacaatccggacttcaaggtgcgcaaccgggtcggccattcgctgctgcgcaatgtgacagtcacggcggacgacgaaatccagtgggtgctgtccgaggccttcgcgccctatatgtcggtgctgtcgctcaccttcatcgtgccccgccatattctgggcaaggcggatgatccgaacaccgcccccttcaacacggccccggtcggcaccggcccgttccgctggggggagcgccgggctggcgagctggtgctgctggaaaagaacccggcctatcatggcgacgggccctatctcgaccgggtggtgttccgctacatccccgatcagaccatgctctacacccagttccgcagcggcgagatcgattatctgggcctctccggcctgcagccggccttcgatgtcgaggcccgcgccctgccggaccgacggatcgtggcggcaccggcgcctttcgtcgagcatatcgccctcaaccacggctttgcccccttcgccgacaaggcggtgcgccaggcgctgtatctggccatgaaccgcaaggcgcggctggaggcgatctatcacggccggccgatcgagaccgagtcctatgtgccccacggtcattgggccttcgatgacgggctgccgaagcacagccacgaccccgcggcggcaaaggccctgctcgacaaggccggctggctgcccggcgccgacggcatccgtcagaaggacggcgtgcggctggccttcaccaattcgaccagtgccggatcccagtcgcgcgaacaggcccagcagctgctgaaacaggactggcgcgagatcggcgtcgacatgacgatcgagaacatgcccggcgccgtgatctggggcgaattctggcagaagtcgcagtatcagtcggtgatggtcgcctccaacttcctgcagggcagcgacccggacgtcacgccgcgcttctccagcaaggcaatcccggcccagggcggcagcgggctcaacacctatcagtaccgcaacccggaagtcgacgggctgctggaacgcggcagccgcgagatggaccaggcggtgcggcgcaagatctatcagcgtctgcagcagatcatccgcgaggatctggtcttcctgccggtgtcgcagtcggtgatcgtcgaaggcgtgaaggcgaagctcaccggctatcgcccgaacatcaatgcctcgtcgaactgctggaacatgcgacactggttctgggcggcgtgacggaggatcttccggaccatgacgatctatctggcgcgacgatgcgggcaggccgtggtgctgatgctgctggtctcggtcatcggcttcggcatcctgcatctcgccccgggcgggccgctgtcgcaatacgtcctgtcgtcgaacatggcgcaggaagatatcgaccggatcacccgccagttggggctggaccggcccttcctgctgcaatatgtcgactggctcgcccggatggtgaccggcgactgggggcagtcatatcgtgacgggctgccggttctgaccaagatcgcgacccatatcgggccgacgctcgaaatcatgcttgcctccaccgtgatcgccgccctgctgggcggcgtgatcggcatgcgggcggcggtgcgccggcattcgctgaccgacctgctcgccaccggcggggcgatgatcgcgctgtcgatcccgaccttctggttcgccctgatggcgatctatctgttttcgatcgaactcggctggctgccgtccggcaatcgcagcaccatcggcgacggctcgctcggcgatgtgctccatcacatgatcgcaccggtgatggtgctggcgctggtggagaccgcggtctgggcgcagttcatgcgggcctcgatgctcgacacgctggggcaggactatatccgcacggcgcgggccaaggggctgcgcgaacgggtggtgatccgcgcccatgcgctgcgcaacgcgctgctgccgatgatcaccctggtcgggctgcaattccccaccctgctcggcggtgcgctggtcaccgaaacggtgttcagctggccgggcatgggacggctgttcctcgacagcctggaatatcgcgactacccggtggtgatgggcattctgatgctctcggcgctgatggtgatggcaggctcgctgttggccgatgtgctctatgccgtggccgacccacggatcaggatggattgaccgcgatgaccgtgcagactgcctccgatatcgcagcccctgccgcgccgcgcggtttcctgcggcagctgatggcgcggcccgccaccatggccggcgccggattgatcctgctgatgacgcttgcggcctttctcggccccctggttgacccgaccgatccggaccggatcgacgtgctgaagcgtttcctgccgccgctgagccccggtcatctgctgggcaccgacgagctgggccgcgacgtgctcgcccgcctgctcggcggcgggcggatctcgctcgccatcggcttctcggccatgctgctctcggtggtgatcggcaccgccatcggcatggtcgcgggctggcgcggcggggtgatcggtgccgtgctgatgcgcttcgtcgatgcgatgatggcgtttccgaccgtctttctggtgctggccctggccctgctgatcagccccggccttgcctccaccaccatcctgatcgccgccacctcgtggatgagcgtggcccgactggtggaggggcagtaccggtcgctgcgcacggccgattatgtcgcggccgcccgcaccgcgggtgcctcggatcttcgcatcatggtggtggagctgttgcccaatgcggcaggcgcgatcatcgtggcggccacgctcaacgtcgcgcgggcgatcctgctcgaatcctatgtcagctatctgggctatggcattcaggcgccgatggcgagctggggcaacatgctcaacaatgcccaggtctatctgacctccgccccctggctcgccatcctgccgggcctcgccatcaccctgacggtcaccagtttcaacttcatgggcaacgggctcagggatacactcgacccccatcgctgacgaccggccatcaggaggcgcgccatgtcccgacgtctgccgtcgctcaacgcgctcagatgcttcgaggtggtggcgacccatatgggggtgaaaaaggccgcgcaggtgctgaatgtcagcgaaagcgcggtcagccgtcaggtgcgcatcctggaggaccagctgggcgtgtcgctgttcctgcgcacccatggcggcatggagatcaccgaagagggccgccgtctggcgctggcggtgacggaagccttcgatcacatcgccaatgcgatcgatccgttccagaacgaccaggatgtggtcacgctgaaggtgatccccactttcgccctgcgctggctgttcccgcggctgcacagattccacgaacagcatccgatgatccggatcgtggtccagacccggctgaacgacatgacggtggacgagaccggcgccgatctgggcatccgctatggccgtggcggctttcccaacgaggatgcgaccgaactttacgccgaatggatcgtgccggtggcggcccccgggcatctggatcccgaccggccggaggaagatctgcgcagcgccatgctgctccacccgctgcccgatcatcaggactggatcacctggtccgagaagtcgggcatgccgctgcgcgtccatgacgggctggatttcgacgcgctcgacatggcgctgagtgccgcagaagccggcctcggcgtcgcgatcgccgatgtggttctggccgatcaggcgattcgcgacggccggctggtggtgccgatcgacaaggcggtgccgagcggcgtgtcctatttcctggtccgccgccccgaacttcgccgccgccgccaggtccgcctggtggaagactggctgctggccgagattgcaaccgcacgcgagaccattgccagctacgcgcgcggctgagctgcacgagctgagctgcacgagctgagctgcacgagctgatctgcaggagctgacccgtctatgccgcgcggcgttccgtaccgcggcccatcagctgttcgccggccagggcataggccagaaccagggccgcgaacagcaccgccacgcccgacatcagcggcacgaagccataggccgccaggcaccagccgcccaccgcaagcacggcggcgttggtgaggccgtaccagcgttccatgcggccgatcagccgggcgcgggtgggggccgccatcggcaggcggttgagattggccatggtgaccggccgtatgccgccggtggcgaaaccgagtgcggtgatcgcgaccagcccggcgatcaggtttttcgaggcggtggcgaacaggatcagcgagatcaggccgatcgcgggcatggccacggtgatcgcccgggcgccgatccggtccatcaccgtcggcgcatagcgcgccgacaggaaggccgccaggttgaacaggctgagcaccagcccgaaccagtagagatcgaccttcagcgtcaggaagaacagcgccggcaggaagcccacgaaggcggcaagcgcgaaggcgcgcatcagcacgtaataggccatccagcccgcctcgcccggcacgctggtcgccggagcgagggaagcgggcgcgccggggctggccgcggtctgtgccggcgccgccggggtgctgaccatcaggatcgcgatcgccgagaccagcgccgcggccagtgcggccaggaagggcagttccggggcgaagcgatagagcacgctgcccgccgtacccgccaccagcaccgccaggaagatcagagaggcggtacggctttcatgggtgcgataggcgatgacctcgtcatcgccgtgcaggctgcggagcagggccgaatcggtgccctgggccagcgcatagccgataccgccggcgatctgggccgccagcagccaccagaagccgccggctgcatccagcggcgccggcaatgccggcaccatggcaaaggccacgatcatgccgaggccggccgccttcagcacctcgccggtggcgatcacgcccttctgcggcaagacccggccaagccggccggccgggccgaccgccaggcagatggtcaggccataggccgccagcagcagttccagccggaagatgtcgagcccgcgttcgtagaagaacacgaacaggatcggcaggtggaaatagagccgcgacaggatgcgatagacatagatcagcggcacgtcgcgtgggctgcggatgctcatgaccgggtcctcacgcgctggccgcgcggccgcggacctcgttcacccgctgcatcaggcgctgcttgtaggcctcggtatcggtatccaggttggggaagacctcctggatgcggctgaccggatagaccccggcgcggaccagatacggccgctcgaaggtgaagtcgacgatggtgttggccttgaccgcactgtccgaggtggcaccgggcgtgtcgccgcccaggtcgatgatcaggtcgaccccgtcgccgatatcggcgaccgccttgtcgagatcgacgaagatgtcgccctggcccgagatgttggccgaggtggcgcccaccggccggccggcggcgcggatgatgtcttccagcggcgaggcgccctggcaggccacgcccagcgtgtcatagcccatggtgaaggccggcggcaggtcgcaggccttgtcgaagatcagcgtcagctcccccggccacagccgcacgaaggcatcgggggcgacccagtcggggaccaccacatggcgggccgcctcggccggattggcgatcgagaaggtcagcggaccgaatttggtgcgcttcttcacgtcgaacacccgctggatggcatcggcgttgaaggcgtcgcagatcagattgtactgcgtgcgcgtgggggtgatgaccagcccgcccgcgcggatcacctcggccgcctcgtcgatcgcgccggcggaaagtttcacgatattgaccatggtgcctgccgtcccttgcccgtgcggaccatgccgatccgggttctgcccccgttgccccggggaccggccgtgttccggccgaacataaccctggatcgcctggtccatgatccgatcaattatggcgacaggctaacatcaccggccccgaatcggaagcatgcagatcaacttgtacgggatatacgcaacaggccgtctcatcctgaggttcggccctctggggagaggcgggggagggcgggtcagctgccggtgggggtgccgatggcgaaggcggtgaacagttcccgcgccatcgcgcgatcgaccggctggccggcatcgcgggccagcgccagataggcgcgcaggatcggcgccatcgacggcccataggtctcgcgttcggccaggaagagcggacggagcagcagcaccgcgcgctggacctcttcaaaggccacccgcatccgcccggcgcgggcatgggcatcggcgatggcggtcagcacacgcgccatcgacggcagaagcacccggttgtggcgagtggcctgctgggacaggcgccggaagacatcgcgggcggcatcgatatcgccgcgaccggcatcggccaccgccagcggctcccccacctgggcagcggattgggagaggcgataggccgccgccgccgtatcggcattggaggcgatgcggtcgaccagcaggaagaagatctgtcgggcgagattacggtcaccctgttcaagggcggcctggcccagctgttccgcccgggcggccgcctgttcggcgtcgccgtcgctgatcagcatgcgggcgtcgtgatcgatggtcataccgtcggtcatgtcgggcagcctggctgaggaggcggggccgtgcgggggcgcggggatgaggccttgagcgtggcagcacgccgcggcgccatagttatggtcgcgtggcgcatgcgaaacaagggttcccgacccgtggtcgcatggattgcgggatttcgtcggccggcccggttcaggggccgcggggcggccggctgtcggggttgacggggggccgttcctgcctgccgcgattgcgcagaccgtggaccagtagggccaggatccaggcggcaagcgggaccagaaagaagccgtcgaacaggggatgcgcgggatccgccccggtcaccgcggtgacgaaggtcatccagaccagagtgaagacgatgagcgcgcggcgccagcgatcgggcatgccgaaagaatgccctggtcgtctccgccatgcaatcatggcgtctgttcgattgcggccatgtcccttccgccgctatcctgagcggacgggacatgaaaggcgacagtggagacgcccgatgagccatgcccccaaagacgcacgccttgcggctctgccccaggcggcagcacggatcgtggaggccctggggcttgccccccatcccgaaggcggatggtttgccgaagtctggcgcagccctgcacccgatgggggccggggggcgctgaccacgatctatttcctgctggcccgcggagagcggtcgcactggcaccgggtcgatgccgaagaggtctggcatcactatgccggggcgccgctggcgctggacatggcacccgacgatgctgcggccccgcggcgccatctgctgggattcgatccagaccgtcccgcaaacgccgatgccggccggccggtgctggtggtgcccgccggctggtggcaggcggcggaaaccctgggcgagtacacgctggtcggctgttcggtggcgcctgccttcaccttcgacggtttcgaactggcggcaccgggctgggcgccggggcgtccggccggcaggccggaatcgtgagcccggcacgggacgcgcgctggcaggcggtcgccgccctgaccgtcaccgaactggccggcggcgactgccccgcggctgagcggcgcgcgcggcgcatgctgcggatcgcacgcggtgccgaggacggatcggggccacgccggtctgcggcgctggccgggctctcggtgctgctgtggcggccgccccatcttgtccgccgcgacgccatgccctggctggagctgatcgcaccctatcgcgccgaaattgccgccgatcgccagctgggtgaggcgatgatgctgaccggtctggcgctgagtttcgccatggggccgggatcggcggaaatccgccgctgggcgggcattgccgggcccgatatggccgcgcgggtggcaggtatcaccgcgccgccgctgccggatggcgacatgcctgcgcaggcgccctgcacgcgccctcagcgcagggcttggcgttcgcgcgccactcggtcaaactgagcctgtcatccgacttttttatgtggtttcccgcaatgcaacagcgggccgaccggcagtgaaggagaagcacattatgggcaggccgcgaggcttcgaccgcgaacgggtcctggatcacgtggtggatctgttctggcgtcacggatatgacggcacctcggtggaggccatccgtcatgccaccggcatcgggcccagcagcctgtatgcggccttcggggacaagcgcacgctgttcttcgaggcggtggaccgctaccgcgcgcgggtggtcgacaaggcgcttgatggtctggagcaggatcgcggcgacgggctgggggcgatccgcgccttcttcacccgggtggtcgacggcatcgttgcgggggagcgccgctggggctgtctgatgaccaattgtgcggtcgaacgtgcgccctgggacgaggcggcggccgaggcggcgcgcgcgcatctgctgcgggttcgcgcggcttttgccggtgcgctggtgcgcggtgcgaccggtgccgacgagacgcaggtcactgccgtcgcctccatgctgaccgcggtgctgcaggggctgaacgttatggcccgggcgggttttggtcgcgcgcccattcaggccgccgtcgatgccgcgatcgcgagtgccgagggtgccgccatgctgccggtcgcgcgcagaatgccggccgccatcgcctcttgagccgggagatccgcggcggacgctgatttcgcgatgcagaatgatcgtatttggcggaattatgcgggacccacttgctttttccgtatcctggagtaaacgtttcgtaacgcggcggccatgagccccgtgtcgagagcttgccggactgccgccgggggggagggcggtccggccgtacgcccggtgtggggaaacctgcgccgggcgtcctcgtttcagagacgggatctgcccgtccgatgcgatcccctaattgcaaataagtctcaatcttgatattccgggagctgatggaggccgggcggaccggcgggctcttcgggatagtgcggatcttggaccgaacggcgctcgaccggctcaaccacatctattcaggccagcggcgcatcctggtgcgcagcctgatgccgatcgtcggcagcctggcggtggccgaggatctggcgcaggagacctatctgaaggtccgcgccgctctggcacagacccagatccagcatctggaacccttccttttccgcaccgcccgcaatctggcgctggatcatctgcgccgggagcgacgccggggcgccgtgctgcgccagggcgaggatcaggacgatcttgcccatgtcgccgccgacacgcccagccccgaggcggaagtcggcgaccgtcagttgctcgaccggctggaacaggtgatgtcgcggttgacgccgcgccagcgccgggtgatggtcgcctgccggctggaaggccgcagctatgccgaggtcgcggccgatctcggtgtgtcgaccagcacggttcagaaggatctgaaggacgcgatggccgcctgtctgggcagtttcacgagggacggtcggtgagcggttccacggacacggtgcccgtcgatgccgctctgctcgatgcggcgctggaacgcttcatccgcgcccgcgatgtcgatgccgatccggccgaccgccaggcgctggccgagtgggcggccgccgatccggcccatgaagccgcactcgcccgggtggaggcgatgtggggggccgatgccttcgcagcggcgctcgtcagaacgatgcagccggtgatgtctggcgcagcacgccggccccggcggcgggcatggccgctggccctggcggcctccgtcctgctcatgatcggcatcggggcggcactcgacctgccgctgcggctgcgggccgatgcgatcaccgccaccggcgaacgccggctcgtggtgctggccgacggttcccgcgtgacgctcgacaccgacagcgccatcgcggttacgatcgacgagaccggacggcatctgaccctgctggagggccgggcctttttcgaggtcacgcccgatgccgcccggccgttcgaagtggcggccggacctgccaaagtgcgggtcaccggcaccgcctttgccgtggggttcagtgacgacgacgcggtcatggtgcaggtccgcagcggccgggtggaggcgggggcagccggcagcagccgcgcgctgggtgccggcgacgcgctgcgcctggacggggccggccccggcatcgtcacccgccccgatcccgcccagggactgggctggctggatggccggctggtcttcgtcgaccggccgctcggcgatgtcctggccgaactcgaccgctatctgcccgggcggatcctcgtcaccgaccccgccatcgctgcccgccgcgttaccggcaattaccggctggacgatccggccggcagcacgctcgcccttgccgccgtggccggcgcccacgtcacgcagatcaccggcaggctgttgattctgcatcagtgacatctgtcaggcactgccgccggccgccggtcggcactgtcgtgccgggcgcgtagcgtggtcagacggcggggcggcgggtcaccgactggctcccgaaaatcatctccgtcggcatttgaaagatgaaataggggttgagcaccggcaatgcactgacggtgtccaatcggtcgagatcctcgtcactgagctggactgcaagtgccgccatattgtcgatcacctgctgcggccggctcgcgccgaggaggagcgaggacatcccgggtcgggacagcacccaggcgagcgcgagctgcgccatggtgatgtcgagtttgcccgcgatctctcggacggtatcgacgatgtcgaaattccgtgcgctgaacagcatgcccccgtaaggattgtccccgctcagcctgtcgccgcttccggtgcctccgcccctggcgcgatccggaagcgagaccgcctgatctgcccgggcaagcatctcgcggccatatttcccggtcagcagaccgcccgcaagagggctccacggcatcatgccaaggccaagctcgcgggccatgggcagaagatccagctcaacgccacgctccaccagggaccatgcgttctgcagaccgatcggtcccggcagaccatgggctgcggcgagcgtggccacccgggccacataccatgaaggcgtattcgaaaagccgtaatagaggatgtcgcctcgtgtggcggcggccgcaagtgtctgaagaacctcttcggctggtgtcgtccgatcccagacgtgaatccaatagaggtcgatccggtccgtcgccaaccgccgcaacgatccctcgatccccagacggatgttgaacgcgccgttcccgccatgcatcggatgtccctgcgatcgggggaaacctgatttggtcgagacgacgagccgatccctcatgccactgtcggcaatgaattgccccagcatccgttcgctatcgccgccactatagatgtcggccgtatcgaccagattgccgccggcttcaacataggtatcgaagatcgcgcgggcgccggcttcgtcgctgccccaccgcccggctccgaaggtcatcgtgccgagcgcgagcggactgacgaccagacccgatcgcccgaaggtgcgatagtctttcatgtgcatgtccatctccttgctgcgagccgtcgttgatggcgtgctccagaggatagaagcttgcgtctgtcggcattaccctctcacttgtgcatgaacctgtgagaaggcttcagcaatgccgcgacacatcctcaacgatcttgcagccttcgcggcggtcgcgcgcgcacgaagctttaccgccgcagcggctgaactcggggtttccccctcggcactcagccatacgatgcgcgggctggaagagcggctcggcgtgcggctgttggcacggtccactcgctcggtcgccccgaccgaggcggggaacgcattgctcgaaagactgacccctgcgctcgcgcagatcgacgaagcggtgacggcgctttcggacttccgcgacacgcctgcaggcgtcgttcgcttgaccacctttcactggatggcctcgacgctcctggccgaccgtctgccggcattcctggcccggcatccggaaatcatggtcgagataaatgtcgacgatggtctgcgagacatcgtttcttcaggattcgacgccggcataaggcttggcgactccgtcgagaaggacatgatcgccatcaggataggcccgccgatgagagccgtggtcgttgcgacgccggactactggcgttctcatggcaggccggagcacccgcgggatctgcgacgccatccctgcatcggttatcgcaacctgtcgagcggaacgctgatgccttgggacttcgagaaggagggcaaggaactccgccagcaggttacggggcctctcgtctgcaactcgtcggatcttgcgctggctgtggtccgttcggggcggggcgtcggatggcatatggagacggatgtgcgggaggatctcgaagcggggcggctggagcaggttcttgatgattggagccagcctttccctggcgcgtttctctatcacccgagccggcggcaggttccggcgccgctgcgtgcccttatcgatttcctgaagatctgacggcatgcgacgttcataaggaaaattttcttcagaaaaatttacgcgatccgccgcccggtgacgtcaggtctgcggggcgtaactgcatacgagacgcaatcgcaaaacatgcagcacgccccgccctttcggtgacgcacaggcgggacgatccacatgaccagacggcatcagcagcggcgcaagagtgcaggccgccacaccaccgggcgccaggccgccatggccctggtcggcgcggccattctggccggcgccgggatgggcgccagcacggcggtgcaggcgcagagcgcggctgccgttcaggatcagccgcatgatttcgacatccccagccagccgctggtcggggcgatcaacgccttcagcgccgccaccggctggaatacgggtttcgcggccgggctcgatgccggtgtcgtctcgcctggtgtgcggggccggctggatagcgagcaggccctgcgccggctgctggcgggcacggggctgacctatcggctgacggggccgcgggcggtgatgctggaggccctgccgaccacgcccgacggggcaacgcagctcgatccgctgacggtggatgcggggcgccagagcacggcgcgcggcgccgttcagggcatcgtcgcgacccattcggtgacggcgtccaagaccgacacgccgatcatgctcaccccccaggcggtgtcggtggtcacccgggaccagatggacatgcagggctcgaccaccgtgtcgcaggcgttgcgctacacgccgggcgtgatcagccagtatggcgatgtcgatctccgggtcgactggttcacagtgcgcggcttcacccccgggcgttatctggacgggctgcgtctgcccttcggtgcgcgcggctacagccagccccgcatcgagccctatgggctggaacggatcgaggcgctgaaaggcccggcctcggtgctctacggccagaacgccccgggcggcctgctgaacatgacctccaagcgcccgaccgccgaaagcctgaacgagatcgaactcggcaccggcagctacgaccgccgccagctcgccggcgatttctcgggcgcgatggacgacgacaggcggctgctctatcgcctgaccgtgctcgggcgccaggccgacaccgagtatgactatgtcgaggaagacaagatcttcgtcgctccggccttcacctgggccggcgacgacaccacggtcaccatcctgtcgcaatatcagaaaatccgctcggaaggcggcggcggtgcgccggccctgccggcggtgggcacgctctacccccatcccgacggctatatcccgaccagccgtttcgtgggcgagcccgattacgacctgttcaccaacgaacaatggatgctgggctacgaggtcgagcaccggctggacgatgtctggaccttcagccacagcctgcgctatgccgatgtcgataccgacacccgccgggtgcagggctatgccctgtcggatcagaccctctaccgatatgcctgggccttccctgaaacgtcgcggacggtgaccctcgacacccggaccgaagcgaaattcgagaccgggccggtagggcacgacctgctgatgggcgtggacctccagtatgagcgcagccagttcgatgagacccagctgacgctggcggccccgatcgacatttttgatccggtgtatgtcggcgggatcactgtgcctccggtcggcacagccatcgaccagacccgccgccagaccggtgtctatgcccagaacctgatgagcttcggcggctggcatctgatgctcggcgggcgttatgaccatgcggaggccaagaccgacaccaatggtgccgtcgtccgtcagaatgaccatgctttcaccggccgcgccggtgtcgtctacgccttcgacaacgggctggccccctatgtcagctacaccacctcgttccagccgctcgggggatcgaaccttgaaggggagccgctggagccgaccaagggccgtcaggccgagatcgggctgcgctatcagccgaccggctatgcctcaatgatcacggtgtcggcctatcacctggtacagcagaacgtcgccaccagcacctcgggtgccgcctatatccagacgggtgaggtcgaggtgaaggggctggaggtcgaagcccatgcggagctgggggatggctatcgcgcgatcgcgagctatgcctacagcgacagcgagatcaccgagaccctgcgcgatgcgcagcgcggcaaccagttggccttcgtgccgcgcaacaccgcgtcgctctggctggacaagagcttcgaggatggctttgccgaagggctggggctcggtgcaggcgtgcgctatatcggccacctttatggcgacctgaacaacgacttcaaatcgccgggcgtaaccctgttcgatgcgggtgtgcgcttcgatctgggtcggctcagccccgatgccgccggggccagcctggcggtcaacgccaccaacctgctggacgagcgctatgtctccacctgcctgtcggccaccggctgctattggggccccggccgggcggtgaccgccgcgatcaagtaccggtggtgacgggcaggcgatgcgcagctttctggtcaggcttcatcgctgggcggggctttccaccgcgctcttcctggttctggccgggctgaccggcagtgccatcgtcttccggcacgagctggacgcctggctgaacccggcgctgttccaggcgccggggcggggggcggtgctttcgcccgaccggatcgcggcacgggtggcggcgctcgatcctggcatcgcggtcaccgcgctgccgctgaaaccggtggcgggcgaggcggtgctggtgacggtgctgccgcgaccgggcagcccgccgcccggctatgaccaggtcttcgtcgacccggtgagcggcgagattctgggccggcgcgaccagatgaccgcgatcatgcccttcctctataccttccactattcgctgaccgcaggtccggtcggcaaatggctgctgggggtggtggcgctgatctgggcgctggatgcgctggtggcgctgtggctgaccctgccgcgggggcggctgccctttacccgcggcttcggggccggctgggcgccggcctggaagatcaagcccggcctgtcgctcggtggcgccggcagccatcgccgggtgctggatctgcatcgggccccgggattgtggctgtggctggtgttcctggtgctggcgatcagcagcgtgacgctgaacctggaaacccaactggtgcggccgctgttgggccaggtggcggcgctgtcgccgagtgcgcgggagatcggcgcgccgcgctaccggcccgacccgccgccacccgcgctcggcttcgaggcggcggccgcccgggccgaagcctatgccgcggcccggggcctggcgccgcaggcggtcgacgcctatcactatgccgtcttcggcgtctacatcatcagcctggacgaggcggcgacgcacagcgtctgggcgatcgacaccggccacccgcatctctatctcgacgaccagaccggcgaggtgctgatggcgaccatccccggccagggcaccgccggcgacgtgttcctccaagtgcagttcccgctgcattcgggccggatcggcgggcttgccggccgcatcctgatcgcggtggcgggcgtggcgctggcggtggtgtcggtcaccggggtggtgatctggtggcgcaagcgccgcgcgcgccggcaggttgcggcgcgcgagaccgcggccgcccgaaaggggccggcatcggcacgggtttgactcgtctccatccgatcgcatatccatgacactccaaggccggcctggtgccggcggatcgcgcgcgaggatgggatgaccgacacccggaaatgggcgctgcaaggcagcccggccgatggcgacagccgtgcctatcgttccgccctcgggcgtttcgcgaccggggtgaccgtggtgacctgccgcgatgccgccggccggccggcggggctgacggtaaattccttcacctcggtctcgctggacccggcattggtgctctggtgcctggagcgcagctcccccagcctgaacgccttcaccaccagcggccatttcgcgatcaacgtgctggatgccgatcagcggccgctttcggacctgttcgccgaccccgaggccgaccggttcgccgggcttgcggtcgaagacgggctgggcggggtgccgctgctgcccggctgtctggcacggttcgaatgcgcgctgcatgcggtgcatgacggcggcgaccatgtcatcctggtcggcgccgtccggcgctatgccgagcggccgggcaatccgctgctctatttttcaggagagtatcgccgggtcggcggctgatcccggtgagcttcggtcatcgtcagacttgtcgaggtacaggcgagcgccgacatcctttccaggggccacagcgtcgaggggaggaaggtcatgccagatcgtgactcggtcctggcggcgctggtggccgatggccagtcgctggttcacgaccagctgcccgatctgatcgggctggccgagacggtggcgaccgttgcgcgcgacgatccgcggcacccggtggggctggtggcggcactgatccgggtcaggaccctgctgatcgaccagctgcgcaccgaggcggggatcgtgtatccgctgatccgcctgggcggcagcccgatgctggccgacatgatccgggccgtccaggcgggtcaggcggatatcgagcaggaactggaccggatgctgtcgatgaccggcggcctgaagccgccgccggacgtgacgccgtcctgggcggcgctttatgtggcgatcggcgtcatggccgacaggatccgccgtcgccacgccctggcccgcaccgaggtgtacgggccgctggtcgcccagccttagcctttgcggatccgggcttagccttcccggatccaggtctggctgcggccgaacagcgacaggccgataaagccgcggacctccagcgtgttgccgtcgggcgagagcgtcatcttcgcgtcgtagatctcgccgttcttggggtcgaggatttcgccgccctcgtaggagaggccgtcgcgaaccagcccggtcagaatttccatgccggtgatcttctgcccggcgcgggtgtcggtgcattcatggcagacgggatccggatcctcgcccggttcgcggaacagtttttcgatccggccgtaccagcggccatcccgctcagaaatcctgaccagcgaccgcggcttgccggtttcgtcgtcgatcgtccgccacagcccggcggcatcgggattgccgtgcccggcctgatcgtcggcagactgggccagggcagaccgggtcagggcaggatggccggcggcaagagccaggggcagggcggcaagcccgaccagcagcagacgtcggttcagacggggcgaagagggcatggaacaagggcctccgatggggggacgggcggtcggcgaagatcatcatcctatgattgaacggcggcggcaatcctgacggatcggcgggttccggcccgcttgtgcgtccccggggttgcaagcgtcatcaaagcgcgggcaggctggcgccataacagatacggaaacgccgggagcccgccagatgaccagccagaccacacgcctgcttttcgttcgccacggcaccgccacccgcatgaccgaggagctgcgcgacccgccgctggcgccgcgcggccgggacgaggcggcggagaccgcagcgcatctggcggcgctgcttgcaggccggcgcccccggctgctggcgagcccgctggcgcgcaccaccgagaccgcgtccatcatcggcgcggcgctggatcttgcgcccgaacccgcgcccgcctttgccgagatcccctggaccgacggccagccggtcgtctcccgcgcggccgacatcaaggactggctggggcgcggctggggcgacatgccggcggcacagcgcgcctgggcggtcggggtggtagaggccgcccggggcctgtcggggctggtggtcgtggtgtcgcatttcgtgccgatcaacgtgctggtcggccatgcccgcggcagtgaccgggtgctggaattccgcccgcgcccggcctcggtcaccatcttcaccgcaggggccgacggcctggcggtcgaatcgctgggggccgaagacgagagcctgttcgcctgatcggatccgcttgcggaggccggttgcgctgctgcgcgtcgtgcgtgcgtattttacaaccacattcgaccgttgaagcgcatccggcttcgcgcgatactgcgccccaagaagcaatgagaaacatggcgccggctcgacagggcaggaccagaagacgccatgccgcctggaacaccggagagccagagcccgatcagcggacctgggcggctggggccggccgggccggggatccgggcccgtgtggaggagacgacgccatgagcgtggcgcgcggcaccgcaggcggtgtgtccagaggcggcgatgacgggcggatgccccggtcgcttgccctgatcgtgatttcggcaggctgcatcctggccctgtccatgggggtccggcagagcctgggcctttatctcacccccgtcagcgaggcgatcggtaccgggcgcgaagcctatgcgctgtcgctggggctgatgaatctgatgtggggcctgtttgcgccccttgccggcgtgctggccgacaagcgcgggccgatggcggtgggtctcgccggcggcgcgctttatgccgtgggcgtggtctggctcgccttttcgggctcggaactcgaactcgccggcgccggtatcctgatcggcatcgggttgagcggcgcgggcttcaccgtcatcctcggcgccgtcggccgtgccgcaccggaacgcttccgcgcctcggcgctggcgctggccagcctgggctcgtcgctcggccagttcgtggcgttgccctatgcccatgggctgaccgatgccgccggctggtggtggagcctggtgatcctgggcatcacctcggcgctgatggtgccgctggcgctggggctgatgggcgcggccaagtcgggtgatccgatcgtgtcgcgccagaccctgggcgaggcggtgcgcgaagccttcagcaccccgggcttctggctgctgaatgccggcttcttcgtctgcggctttcacctcgccttcatcagcgtgcatctgccggcctatgccgcggatcgcgggctggagccctgggtggcgaccgcagcactcactgccgtggggctgggcaatatcttcggcacctatggcttcgccaagctgggcacggtgatccagaaaaaggacgcgctggcgctgctttacaccatccgggcgttcatcttcctggggttcctgctgctgccgctgtcgcccaccctggtcatcaccatgtccttcctgctgggccttacctggctcggcaccgtgccgctgaccagcgggctggtggcgcatatgttcgggccggtctatctgtccaccctgttcggcctggtgttcatgggccatcaggtgggcggcttcctgggctcgtggctggcgggccggatcttcgacatggtcggctcttacgatccggtctggtggctgtcggtcgggctgggcctgatctcggccctgctgcatatcctgatccgcgaacggccggtcgaacggctgcgcgcggccaccgctatcgcctgacgccaacgccggaggggttctgcttgcatcctgccgcacccgtcgtccctgacctttcggtcctgcagccccttccgccgcagacgcggctggaggggctgcgcgccgagattgccgctgcccgtatcgtcgattgcgggatggtccatgaacgggtgttgcgggcggcagacgggcagacgccgctgccctccgacatgccgaacggggtggtgcgcgcggggctctgcccgatgccggtgcgtcgccagcgccttgcctgcagccatactgcggcccgggtgcggatgatcgaggcggtggggctgttgcaggatgccgaagaccctgcggtagcggccctgcagaaccggatcggcgaactcgatgcccggatcggacgcatcgatcatgcccgcggcgatgccgaactggcccatgcgctcgcctgccgcgatggtgatgccgcggcccgcgatgatgccgcagcgaagatcgccgagaccggccggcagttcacccgggcgctggcggatctcgacgccctaagatccgatctgctggcggcgatggaccgtcagctggcgaagacgcgtgcggctgggggcatcagcccggcggggtgatccggtcctgcaccgtgcgcggcgccagggtgcagagatgccaggcgatcggcgcctgccagacggcggcatcgccgccgcgcggcagaacccggtccagcacgccgggcagggcggcatccagcctggcctgcagggcggccggggcgcgcagcctggccgcagcggcggtttccgccagggcgtcgaattcgcgccaatagccggcggcgtcgcagatcccggcggtggcggcgccatcttcgatcgcgaccaactccagcccggctggggcggcgagcgccaccagcccgtccggatcgatgtcgaaagggccggcctcacctgccgggcgggtcagaccgggcagcaccttgccgagcagtgctgccccggtgccgatcagccggcagcgggccggccggtcccagagctgcaccagaatatggccgccgggcgccagcagcccggccatcgcggtcagcacccctgccggatcgggcagggtccagaggccgcgcaggcaggtgatcagatcaatcacccccggcttcagcgccggccgcgcggcatcggcgacgagcccggcgatgcccggtacccggatggccgccagggggccggccgcgatgtcgctggcgatcaccaggcggcccggctgggccagcgcacggacaagcgcgccctggcctgcccccagatccatcaccaccccgccggccccggccaggcgatcggccaccgccgccatgtggtcgagcagggcgcccgctgcctgcggacgggcgccactgcgatcctccagcagggcccgatcctccagcagggcatggacgccatcccagtgggtgcggctgccataggtggcggcggccccgtcggtggtgggcgctgcggtcatcggatcaactccagcatcatgccgcccagccaccaggccatgccgacccagatccccgcccagccgaggatggtgccgagggcgacggccagcagcagcggcccgcgcccggcgggcagtggtccagccagggccggggccggcagtccgactgcccggcgcagatgatcgaaggcccggcggcgcagattgggcaggcgcagcacctcgaccagcatcagatagccgtcgccgttcagcaccggcagcagggtgacggtggccccgaacagcccggcggcagccaggatcacgccgcccgaatgcagcggactgcccatgggggcggccatcatcgccgccagccccagcccggccagggcctggctggcgaagggcccggccaggatcgcgaccatgcgcggccccatggccagcgcttcccagtcgcgccggtcggggcgcgtccaggcgaagggcatcaggaaatagatcgcaaacccggtctcgcgcaccctgacgccaagcgccctgcaggcaagcgcatggccgccttcatgcaggaagccgctggccagggtcacgagatagagcagcggcagcatccagccggtcagcgtcgccgatgcctcgtcaagaaagcgcccgcccatcacgatcagcagcaccggggttgccagggcggccagggtaaccacccccagcagccccatccgcaccgcgcctggccaggccagcagccggtcgagcagcggttcgggatggaccacacccagccgctggatgaccagatgatggagcagggcgaaatcgaagccggtgaaggggtcgcgggcgcggttgccgcggccgtcgatttccagcaggcccaggcccagaagcttggtttcgaaccgcatcagcttggccgcatcggcgcggataccgcgcgccgccagccgggcggacagggtgccgaagctcgactgcccgtcgaacacccgggccacttcgaactcggccgggcccagcacccaatggccgtcacccgcgggatcggtgatttcgatccgccggccgcgggccggatcggtgatctcggcatgttcaaaccgggcgggaaagcagccgcgggcgatcgcggcgccggcgctctcagcggccgtggtgtcgatctcaggcgcggtcagcgtcgtcatgccgggtctttcgtgggggctgccgggcgaagccgggtgctgaggcggaattctgccgtcacccgaccttccggaccggcatcgagccagagctcgtccgggcccggcgacatttcagccagatcgatcggctcgtcgcggtcgaacagccgggcgagcatttccgccccctgaggggcatcgagcaggatgcagaccggtttgggctcccccggcgctttggcgaagatcgccggcggcaggcccagatcccgcgcccagcggcgcatggcccggaaggcctcggcatcctctgccggcttgccgccggggcgagggtcgtcggctttgatctgccagcttcgccgcttgaccaccagccggcccagcaccagccgcggcgccagatgccgcccggtcaccgcagaggcaagcgtgaacatcgcccggtgcagggccgtgcgggtcagcgtgcccaggtcgtcatcctgtccgcagcggctccggatgcgcagcgtgccgtcggccgcgcgccggacccggacctctgccgaccggatgcgccggcgcgggccggtcgcggcatcgccgggcagggcgatgtcgatgaaggccggatgttccggccagtcgatatgcgagcgctggtaatggcgcccatcatcggccaggcccagccgcgccggacctgcggcgccgtcaagcgcccagccggccgccatgtcggccgcctggtccggatcggggcagaagggcatggccaccggctgcacggcggtcgcgaccgccggatgcacttcgccgatcaccagccgccagtcgccgcgggcgatcgccgcggggcttgcggccgcgatcatcagatcgggcgaggcgatgtcgaggccgagggtgaccggctggggggcgcgcggcagcaggcggcgaacggccgtttccaccgcatcaccgacatgtgcgatatcggccggggtgagggcgatttcgtcgacggaggcgtcagtggccaaccggtcccaggcctggcgcagcaccggctcgatcaccgccaccgcagcggtcgcgagatcggccgagggggtggcggccagcaggcggaccagatcgaccgttcccccggcatcggcggcgccgtcatgcgccagccggtcgaaggcctgtgcctgaccatcggcgatcagcatggccacggccgtcgccactcgccggtacaggttcagcaccggggccagatccggttcggcggccttgaggaacggcccgcccagaacgacattgcccgcccgggcgcaatcttcgtagaccggctgacggccgacatacatccggccatggtcgcgctcgcggtcggcgccggcagcggccagcagggtgtgcaaccggtccaggatcgccagccggtcgcgtggccgcccggccgcggcggcgaaatcgcgggcaccggcctcgatcgcggcgatgcgatccagccagaggtcggcggccggagtgccgatccgccccagaagtcctgccagatgatcgagcggccggcggctgccgggcgcgggcgtcagcgccggcagcagcacccgccggccgaccagcatgtcgatggcggcggccgcgtccccggtcgctgcggcggcggcaagcccggcgggccgcgcgggccccagccgcatggccgcgcgcaccaccgcggcgacccgggcgggcaggggggtgctgcgatcgaccggcaggcgcagccggccggcatcatccagcgtgcagccggggtttaggatcagcggcagctgcccggccagcgccggatcggcggccaccgcttcggccagggcctcggccacccagtgttcgatcaccgtgatccggtcgccgatcacccggtcgccgatcacccggtcgggcacccggtccggatcgccggtcacctgcagcgcggtttcggatcggggatcgatccgcccccaggcgacggggccgaaaaagctcgcggtatcgttcttggccgcaaagcgctgcagatagctccaggccagacgcagcttctggcgggcgcgcttgcgcggctgatccaggttttcggccgcgagttcggcgatgcgcgccggcgcgtcgcggttggacagaaacagcgcctcttccgccatggcatcgccgagcgccgcaaccagccgtcgccgggcatcggccgccgcaggggcgaaggcggcggcgcggctatcgggcgtgacggccggatcatcgatcacggccagcatgtccgcgtccagacaggcgcaccgcagccgggcgaaaccgaaaccggcgccacgcatccagaacagcggaaaccagtcgatggcgggcagatcgccagcggatgcctggcctgtggtggagacctggtctgtggtggcggcctgatctgcggtggcgagacgggtggcggatggggccgggcgggtcgcgaccgtcatgcccccaccaccgcgccgcgttcggccagcttgcccaacagggccgcatcctgcgggccggcaccgcccagccgccgggtgagtgccgcggggctgagcggtccttcttccagggccgccagcatcagggccccccgcggcggcagcgccgagagtttgggcgcggcggccagatcgggcatggccaccagataggcggccggccgcgccggcagatcctcgcggcccagcgccgcagaattgcgcagccagggggccagatcatgggccgtggtgacggcgaccgcgcggccggtgaggccgacatgccctgcgggcaccgccggttgcggcggcgcatcggcaagccgcatcagcagtccggccgtggcgcggtcgagcgcgatcaggtcgcgcagcccggccggcgcttcggttgcgggatcgccggccagatggtccaggatccgggcgcaatagcccacgacgaaggggccgtcatcctgccagtgatcggcttcaagaaagccttcggccagctcgcgcaggtccagccccttggccttcagcgcccgcatggtcagcggtgccgccgtttccagcgcgttctgcaccgatccggtcatgcggaagcggtagttcagaatgaacatgcgcgtcggcttgggcgttgcggcataggcacgtaccgtggccacgccgtcatcgtccaggccgaagcggcggcccagcgtctgatcgtcgatcgcgggatcgaacatcgcctcggccagcggcgcttcgcgcaggattcgccgccaggtggcatagaccgtggcggcgggcagcccggcaccgggaatgggggcggcgggcggggtcatggcggtcatcacgcgatctcccgaaccggcggcaccacgccatggcggcgcgcggccgcatcccaggccgccttggcgcgggccagatcggcggcgatcatcgcctcgtcctcggccccgcccagctcgcgggtctgggggtgatgggcgcggccctggaattccaggatcaccgccgaaggcagggcccgggacagcacctggtcgagcatcgcccagaccggttcgggcaccgtgctgtcatgccagtcgtgatagagcccgtcataccaggatccgccggccagatggatgcagaccacccggtcgagcgggatggtcgccagatagtcggaggcgtcgtaaccggccaggttgaccgaattggtgtagacattgtgcaggtcgagatgcagccaggtgccggcgcgatcgaccagccgggccatgaattcggcctcgcgcatcgcagcccccggggtcggcatgtaataggccgcgttctcatgcgccagcggcatgccgtagatgtcctgaagccgccgtgcccggtcggcgacccggacgagttcaggcgaggagaactgcaccgggctcgaccagatgtcgagccaggacccgtcgccatagaagcagtgatcgccgacccaggggctgttgatcgccttggccagcgccacatggcggcgcacggccggcgtgtcttccagccggccgaagccgaattcgcaaccgtaattggaatgggcgagcagcggcttcgcggcacccagcgcctgcatgcgccgctcctgccccgggcggaagatccaggggctgtcgagcggccccatgatcgcgtccagcagtatctcgaacaggtcgaccggctgggtttcgaacggaaaccagtcgaggatttcgggattgtactgcaggccgacgccgagcggtgcgggcttgtccatcggggagtccttaagggttgatcccggggaggttgatcctggggaggcctggccgcgttgcagcgtcagcccgccacgataggaatgagagaggcgaccagcaggaccgccatgacggtgttgaagatcctgaccgcccgcctggtggcgagcagccggcggaccgcgacgccgaagccggtccagatcaccgcggccggcacgcagaccagaaagaagatcagcgcgatgatcacggcctgaacggtggggttgttggccgccgcgccataggcccccatggtcgcgaccgccatggtccagaccttgggattgacccattgcagcagagccgcctgcaacgcgcccaccggcctgccctcggcctgtttcaggttctgatccagccccttgggctcggcgctcgcgatcttccaggcgagccagagcatgtaggcgacgccgatcacctcgatcgcgatccgggttgcgggcacggtttcaagaatggcgcccaagcccagccccaccgccaggatcagcaggggggccccgaagcagatgccggccatcgccggcaggctgcgccggaagccgaagctggcgcccgaggtggtgagcagcacggtgttggggccgggtgacagcagggccacgatcgcgaaggtcacgaccggccagacgaagtcgagcgagggtggttcgatgggcggcacgggggcggctccggcgcgggttggatggataaccgaaggttgatccatccggacccggagtgcaatacgggcgatgcgatgcctcagctgccggtcgcttcggcgacgatgccgatcttcaccagcttggagagcaccggcgccagcccggcgccggccgcggtgtcgcgccgcgccgcctcgatcagcccggccatgcggccgctgatccggtaggagatcggcaccagcaccccctgatggccggccttctgggtgaaggcgacgtaactgtccgtttcgtccatatccatgatgtctatgtcgccgcgaccatgggctcccatgatgaagcccggaatgtcgaagcggctgtgcatcagctccacccggatggcgagttcacccgccccgccgccggccgacagcgccggaagcggcgtttcggccagcccgcccacggccacgcggcccatggtcacctcgtagcggaacaggtcgtgcagccggtcgcggagcgacggatcggtaatgccggcatcgggcagaagccgggtctggatgaactgctcgaagggtttcgacaggtcgatcgcccgccagcggccctccggccggttgccggcatagatgctgcccaggatccggtcgcggcccgcccagtcgacgaagcggcggatcaggtcgctgaagccgtcgacacccagctgatccttcatggccagcaggcatttgatggtggtgccgtggaagtgatagaggtcggccaccgcaaagccgaaggtctccacccaggccatctggtcgagattgagccatttggtctcgtagaccatgtggttcggttctcgcatatagcggatctcgtgctcctgggcctgccgctcgaattccgagccgggcaggatcgagagccggaaggcctggatgcggtgcgggctcagcgagtagcagaaatccaccgtctgcatgaattgcgggatgccgtcgcccggcaggccgtagatgcaatcgatgatcgccgaggatttcagcttgtccgacagccggttccaggcgcggcggaagcggtcttcggtgaaggggcggcgcatcagcttcgccgcttcctggctggcgctctgcaggccgaattcgaaggtgaccagcgggttcagccgcaccagctcgtccatcacccgggccaggttgtcgtcgatgatctcgagcttcagctccagcagcaggctgaagggctggacccggccgtcgcgcagatgctcgaccaggatttccaggatccgggccgcgcgttccttgcgcatgttgaaggtgccgtcgcagaacatgatgtgcgacgggtgatgcgagaggatgttgtgaagctctgcctccacccgctccatctcgtattcgcgcacacccttgctctcgccccagatgcagaaggagcagcgataggggcagccgcgcgaggcttcgtagaggaaggcgccaccatggggcagctcgatcccgcccagatagggcgaggggatgtcgttgatgtcctcgatcagcgcggcctcggcggtctcgtgataggccgtgcctgcgggcacgcggccgctgccgtcgaagatcaggaagtcgtcggtgttgccgtcgggcgccatataggcgatcccgcccacggtcgagagcttcgggctgccgtcgaggaaggaattcagcaggtcgcggaaggtgacctcggcctcgttgcagacgcagatatcggcgcagcgctcgcggtcgaacacgaagggtacataggatccgcggatctgctggccgccgaagatcaccaccgtctgcggccacagctccttgatcgccttggcggcgcgcagcacgaatttgatgttccagatgtagcaggagaagccgaccacgtcgaaattgtgggtctcctgccatttcagcaggaagaacagctgcgcctcctcatccatcagggatttgggcgtggcggcacagtgttcgatgaaggtgacacggtcggcgatcgcgggcgtgcgccgggcataggtcaccaggttccacagcgcgagcgaggtgtcggcttcccagttataggcgacgagaccgacgcggagggtcggcttcgcgccgaagcccgcagaggccgcggtggcggtgcgggcgatcatggtatcgggcatgtccatcccctgatgatccggagacaaaaggtccggatcctggctcattcggaaatggccggtcatgcgacggggcggcagcgacgcgggaatttacaccgggggtcacgggggcgcaccggccggtcggcggacataacgagaacgccccgtgcctgcgcgatgtgcgcaaaggcacggccggatcctgtcgtcgtcatgtcggagcgggccggtgtccggccgggacggatcgcggagcagcgggggcggcgtcgcgcgggccgtgtcggccggtcaggcgaaaaccttgctttcgatgatctcgacgtcttcgagatcgaagtcttcaaggccatcggcttcgagagcgtcggcctcgacggtcttggcaccgtcggtggccgtgtccgttgccgcggtatcggttgccgccgtgctgtcggtggtgccttcggcctcggtggcgacaggctccaactcgtcggtggcggtggcgtccctctcggtcatttttgtctcctcctcgtgttccggtgaaacctgtcgtcgcaggtgggcggcctcgtcgtcgcgggccgctctgttctggagtgcgtaatccttgaattctggcgccgaaggccccgatacgtcaacctttctaaccattgagcatcatgaaactccccgaatggtggagcaatctgcgcgcctttggatggatatccgatctcatttgctccacttgggatctgtcatgaaacggttaccggcggtggctagggtgccggccgttccgggggcgctgctgcctccggcctcgtttcaggagcagaccgatggtcgagcaggagatcttcatcgacggtttcggcaccatccgcctcgccggcggtgtggtccgtattgaactggcccgtgcggtgttcgatgacgccgacgccgacggccggccgaaactggcgccaaagggcatgctgatcatgccggtggaagcgttcctgcgggcggaacgccagttcgccggcgtcgcccagcgcctggtgcaggcgggtatcgccgccggtgatcgcaagctggccgagacggctgctgctgctgcggcccccggcaccgcgcagggatgaaacccgctgcatgatgttcgccggcgggcacggatttaacggtcctgtcccgaagctgcaactttccttgggcatcttccacacctgggcgtcgcgcagggcttcaggcgaaggcatgtgcgacgtcgcacccgtccagaatttcccgacagaaacggacccggtgacggcgatcccccgcaccggtccgcaagccggagatacggttcatgcagctccagatcctgcacgcctctgaccttgagggtggcgtcgatgccatcggtcgtgccgcgaattttgcggcgctggtcgatgccttcgaagacgactacgcctattcgatcaccctgtccgccggcgacaactatctgtcgggcccgttcttcaacgcggccgccgacccgtccttcggcgcaagcggcgtgctggatcaggtctataacgagctttacgacctggcggatggcgagggctatgccggtctcggcgccggtgccggccgggtcgacatctcgatcatgaacgtgatcggcttcgatgcctcggcgctcggcaaccacgaattcgacctcggcaccagcaccatcggcggcctgctggctccgaatttcggtgcggcggacggcgtcgccgatgacggctgggtcggtacccagttcccctatctctcggccaatctggacttctcgggagattcgagcctccgcggtctctataccgacgagctgctgacctcggacgccttcgcgaccgggccggagcagtcggcgagctcgaccaccgcgccgaagatcgcgcctgcgaccctgatcgaggtcaccgaccccgagaccggcatcgtcgagaccatcggtgtggtcggcgcgacgacgccggttctcggcacgatttcctcgcccggcggcgtcgagatgatcggcaccgaccagaacgatatggcggcgctggccgaggtgctgcagccggtgatcgacgaggtgatcgcccagggcgtgaacaaggtggttctggtcagccatctgcagcagatcgcgcttgaagaggcgctggtgaagctgctgcacggcgtcgacgtggtcatcgccggcggctccgacaccatcctcgccaatgaggacgacgtgctgaacccgggtgacgaggcggtcgccggctatccggtcgtcaccaccaatgccgatggcgacaccgcggtcgtggtctcgaccgatggcgagtattcctatctgggccgcctgatcgtcgagttcgacgacgagggcaaggtggtcgcagagagcctcaccaacccggataacggcccggtcgcgagcaccgaagagaatgttgccgctgcctgggacggtgatctggacgctgccttcgccgagggcaccaagggcgatctggtcgacgatctggtcgacgcggtcgaggccgtggtggtcgagaaggatggcaacatcctcggtcagaccgatgtctatctcgatggcgaccgtgcggatgtccgcacccaggaaaccaatctgggcaatctctcggccgacgccaatctggcgacggcgcgcgaggtggacgagaccgtgatggtttcgatcaagaatggcggcggcatccgcgccggcatcggtgaggtcgtggtcgacgacgcgaccggccaggtctcggcactgccgccgcaggccaatccggtggcgggcaaggaagagggtgacgtctcgcagctcgatatcgagaatgcgctgcgcttcaacaacaccctgtcgatgcagaccgtgaccgccgcgcagctgaaggcggtgatggaacatgcggttgccgccagcggcaacggcgccaccccgggccagttcgcccaggtcggcggcatgaccttcgccttcaaccccgagcgcgccgccggtgaccgcatcgagacgctgcagatcgtcaacgaggcgggcgaggtggtcgacaccatcgtctcgggcggcgaggtgcagggcgatgcctcgcggccgatccgggtcgtgacgctcggcttcatgcaggaaggcggcgacggctatcccttcgcggaattcgccgaggccgatcccgatttcgccaatgtcgtggcgctggacgagaacaacgtcgcggccggtgatgcgagcttcgccgccccgggcagcgaacaggatgcgctcgccgaatacctgctcgacgcgcacaatgtcgacaatggcggcaccgccttcggcgaggccgagaccccggcctcggacgatacccgcatcgtcgaccttgcggtgcagaccgatatcgagagccgccccgtcgcggccgaccgcagcatcaccgtctcgggcgacgatgtcgccgagggctcggtgatcgcgcataatgtctggaccaccagcagcgctgacacgaccgccggtgcctcggaaatcgtcgcctatgacaaggcgaccaaccgcatcttcgcggtcggcccgaacggtgtcgacatcatcgacgccgcgaccggcactgtgctgggtggcgtggacctctccgcgctcggcggcgccaattcggtctcggtcaagaacggcatggtcgcggtcgcggtcggcgccgaagacaagacccagcccggcaccgtggtggtcatggataccgacggcgccgagatcggccgctacacggtcggctccctgcccgacatggtgaccttcaccccggatggtacaaagatcctggtcgccaacgagggcgagcccgaggactacaccgtcggtgatccggaaggctcgatcagcgtgatcgaccttgcctcgggcaccgtccagaccgccggcttcacccagttcaacgatcagatcgacgcgctgcgcgatgccggcgtgcggatcttcggcccgggctcgacggtcgcccaggatctggagccggaatacatcgcgatcgcgccggacggccagaccgcctatgtcacgctgcaggaaaacaacgcgattgcgatcgtcgacctgtcgggtgacgagccggtcgtgaccgagatcgtgccgctcggctacaaggaccattcgctggccggcaacgagttcgacgcctcggatcgtgacgacggcatcaacatcgccaaccacccggtcttcggcatgtacatgccggactcgatcgcgtcctataccggcgccgatggcgacacctacctggtcatcgccaacgagggcgatgcccgcgaatggggcgattatgccgaggaagagcgggtcaaggacctggatctcgacccgaccgccttcccgaatgccgaggaactgcaggcggacgccgatatcggccggctgaccgtcaccaaggagctgggcgacaccgacggcgacggcgattacgacgccctctacgcctatggtgcgcggtccttctcgatcctgaacgatcagggcgagatggtcttcgacagcggcgcctcgatcgagaagatcatcgccgcccgctacccggaactctgggacgacagccgctcggacaacaagggtcccgagcccgagggcgtcaccgtcggccgctacggctccagcacgctggccttcatcggccttgagcgttcgagcgcggtgatggtgttcgacatcaccgaccccgacaacgtcaccttcctcgacatgatccgcagcgagggtgatgtcagccccgaaggcgtgctctacatcgcggccgccgactcggccgatggcatcgccaagctgatcgtcgccaacgaggtcagcggcaccaccagcctctacaacatcacagcaccgctggcggtcgacctcaacggcgacctgccggtgttctcggccggcgaaggccccgagaaggggacggtggagatcgacgacaacggccgctacacctaccaggccgatgcggcggtgctgggcgcgttggatccgggcgaggttaccaccgacagcttcgagatcgtggcgaccgacgaggccggcaacaccgacacctcgaccgtgacggtcgagatcgtcggtgcggccgaaggcggcgcgggtgacgaccgcttccaggcggttgagggcggcgacgcccatatggcgggtgcggccggtgacgacatcatcgtcggcgtcggtggcgacgacatgatctcgaccggcagcggtgccgacatcgcgatcggcggcgcaggccgcgacaccgtgatgctcgacctcgacccgtccgagatcgggatcaccacgatgaacgccttcgacatctcgctctacaaccgcctgctggcggcgggggatgccgccttcgacgccgacgccccggcctatgtgatcaccgatctggagaccggcgcgcagacccgggttcaggccgatgtcatcgccttcggcgatcgcgccttcacggtggaagacggcgtgctgaccctgtcggcttcgaatgacgagatcgacttcggcagccgcgccgacaaggtcgcgggcggtgccggtgacgacgttctcgacggcggtgccggcgacgacatgatcgcgggcggcgccggcaacgacaccctgctgggtggtgctggcgacgaccagctctatgacgatgccggcgaggacaacctcgcgggcggttcgggcgacgacgtcatcgtcgccggccatcaggccggtgagacggtggtgatgttcggcggctcgggtgccgacgtcttcggcctctcggccggtgaggacgagggcatcgatgtcgagggcatcatcgccgacttctcgaccatcgaaggcgacatgatcgacctgtcgggcctgcgcggcgccgacggcgcggtgctgacgctggacgacgtggtcggcatggcagagacagtcgacggcaatgcggtcatcgcactcgacggcctcaccaccaccggtggcgaggcggttgcaggctcgctgaccatcgcgggcttcgatgcggcggatctcgatgcaggcatgttcgtcttctcgaacggcgccttcgacgaggatctggtcgccgccgcggcggcggcgtgagcggggggcacgagatgaccttcgccacgatcccgtctctcgcggatctgggcctggacgacggcaccggggggcttcggctccccggtgccgcacccctgtccggggccggcttcctgaatgccaccgcaccggtcgccgatgcggcggcccatggcgccttgcgtcgccagctgcgccggcggctgatgcgcttcatcgaaaaccgtggcatgggcctgggtggtgtggcactcgccgccctggcgctcgccgcgtgctcgtcggacaatgacggcccgctgccctcggccggcgccaccgaggcccggctggtcaaggaccagattgccggcgccgaggccttcctcgatgccgatggcgaccgcatccgcgacgagggtgagaagggcgacgtctccgatgccgatggccgggtgaagatcgatggccgcgacggccagatcgtcaccgagggcggcatcgacaccaccaccggcgcggtgatgggccggctgatggcaccggaaggcgccgaggtcgtcacgcccctgaccacgctgctggtcgagaccggcgatgccgcggaactgttgaaggcgctgggcctgcccgagggcacgaaccttgcgaccttcgatccgctggccgcgctgggcggggccgaagatgcccttgcccgcgatgtgctcgcccagggccacatggtctatgcaaccctcgccgcgctccaggcgatccaggacggcgtcaccgacacggccgccgccgaccgggcgctcgacctgctgggcgccgagatcgagaccggcgacccgatcgacctcaccgacagcgccctgatcggcgatctgctggcgggtgctgccggaaccgatgccgacaccgccgacatcgcccgtctggccgatgcgctggccgcggtcaacgaccggctggcgagcgaaatggcggccgatccgctgtcgtccagcgcacgggcgacggcgctgctggccgaatatgtgctgcccgaggaaatcgcggcgcttgccgacgatacggccgatgcctcggcgctggaccggctggccgcgcgctatggcgacgggctcgacgatctgatcacccgcctcgccgatgtgctgccggatgtcgccgatgcggatgcgcaggtggtggccggtgcggatctcttcgtggtcgcgcgcggcgagagcctggtggtcgaggcgggcgatgacgaccacccgcttgccaacgacatcacgctggatgccgcgggcggcacgctcaaactggtctcagtcggtgtgcccgagagcatggcgggcgagctggtcgtgaccctcgaccccgagaccggcgcgatcaccatcacccccgcgctcgatttccacggcaccgccgccttcacctatgtggtcgaggatgccgccggtcatcaggccgagggcctggtgctggtcgacgtgccggcctggcgggcgaccgatggtgacgatctgctgctcggcaccggtggggccgagaccattgatggcggcgccggtgccgacatcatcctgcccggcgccggcgacgataccgtcttcggcggtgccggtgcagatctgatcctgggcgaggccggtgccgaccggctggcgggtggatcgggtgccgaccgcatcgtcgccacccatcaggcgggtgaggcggtggatctgttcggcggttccgacgccgaccggttcatcatcgccccgcatgaagccgaaggcgcgctcgatctggacgtcaccatcgccgacttctctcggatcgagggcgacctgatcgatctcggtgacctgcggggtgccgatggtgccctgctgaccatcgaggacgtgctgggccgcgcccagacggtggacggcaatgcggtgatcgatctggacggcctgaccggggccggcggcggtgccgtgaccggccatctgaccctggccggcatcgatgccggcaacctcggcgccggggatttcgtcttcgatgcagcgcctgcctggcgtgacgatctggacgatgccctcggcaccccggctgccgcctgatccacctgccttccgacccacctgccaccggagtgccccggcactgtttccgttcaacccgaaccatccccgccgccgcagcccggccggcgccaccctgaggcgggtggtgctggccggcgccgcggcggcggcggtcttcaccctcgatgcgggtcttgcatccgccatggtcgacgagacggcgccggcggtggagccggccctgccgggcatgcccgtgctgccgccgctgccgctgcccggcgccttccgtgacgggccggttccggtcgcccttgcaccggacgactgggcgcgttttcgcgaccggctgctgaccgttgccgccgatcatccgcgccgcgcggtggcggcggcccggatcgatgccgcccgcggccggctgggggaaacccgtgccggccagtatcccgcggtcgatatcggcctcgatacctcgcgccggctggccgatcacggcgtcgacacgctcgacagccggatccgcggctccgacgaccgcagcgatgtggtgctgaccgcgcgccagctgctctatgacggcggtgccaccttcgaccggatcgacggcgcccgcgcccgggtctccgccgcccgcaacgaagaccgggacgaggcggccctgctgatccgcgatgcggtgatcgcccatctggacgtgctggaggcgcgcacccggctcgatctcgcccgcgccgaggccgatgcctatcgcgcgctcgaagcccggatcgccgagcgtctggatctgggcggcggcacccgcggcgacgggctgcgcatcgccgcccggctgtccgaggcgctggcgaccgaggccgcgcagagccgggcgctcgacaccgccgccgaagcctatctggaactctatggccaggaatcgccggcggggctgatcctgccaccccggcccgacgccccgcgcgaggtgcaggaggcgatcgggctgatcgacggcacgagcccggcgctggcagcccgccgcgacgccgagcgcgccgcgcgcttcgatgtcgacgccgccgatgccgaagactggccggaactcagcctgcaagtgcaagggcggcgctatgacgttttcgacgacggccgcgaaagcgatctggtcgggcgggtggtggtcagcctgccgctctatgacggcggcgcccgcgacggccgtcaggcccaggcccgcgccgcgatgcgcgcggccgaggccgataccgcccgcatccgccgcatgctgacccgcgacgtttcggcggccgtggcggttcgtgccgcccgggatgccgagctgggcgcgctgatgagcgcgctggaggccaatgagcacgcccgcgcgatcttccgcgacgagttcgaagccgggcagcgcgacctgctcgacctgatcgaggtcgaacgcgactaccaccttgccgcggcgcgcctggtgtccgggcgggtcgaggccgaacgtgcccattggcggctgctggaggcgagcggcgccctgggcggggccgtcggcctgctcagcctcgcccgtcagggagatgacgaatgaccgcaggcatcgacgacgacgggacggccgcggccgtccatccgggccggcgccccggccactggttctggagcggggtccgccgggaatggccggccttcggccagatcgcgctcgccgcagcggtgatcaacctgttcgcgctgggctcgtcgctgttcatcatgacgatctatgaccgggtcatccccaatgacgcggtcgaatctctggtggcgctgacgctcggcatggtgcttgtgctggtcttcgacttcctgctcaagatgctgcgcagccatgtgatcgacgtcgccggccagaccgcggacgagcggatcggccgccgggtcttcggccatgtgctgcgcattccgctggagcatcgcgccggctcgtccggcgccttcgccgccacggtgcgcgaattcgaatcgctgcgggattttctgacctcggccagtctcgccgccttcgtcgatctgccgttcgtccttctgttcctgggcgtgatcctgatgatcggcgggccgctggtctgggtgccggcgctggcggtgccgctggtgatcctggcggggctcgccgtccagccgatgctggcgcgtgccgcgcgcgagggccacaaggccgcccagaccaagcatggcgtgctggtcgaaacggtgggctcgcttgaaggcgtgaagggggccagggccgagcggatcatggccgggcgctggcgcgatgcggtggagcttcaggccggcatccagtccaaaagccggttctggagccagctggcggtcaacttggcgagcttcgtgcagcagggcgcccaggtcgccatcgtctttgccggcgtcttcctggtgcgtgagggcacggtcagcatcggcgcgctgatcgcgagcgtgatcctctgcggccgggcgctggcgccgctggcccagatcgcgaccctgctgacccgtctcaaccacgtcgcccagagctaccgggcgatcgaccggctgatgcgcctgccggcgacggtggagccgggccggcgctatctcacccgccggaccgtcgaggggcggatgaccttccgcggcgtttccttcacctatccccgcggccgccagccggcgctgacccgtgccggcttcatcattcagccgggcgaaaaggtggcggtgctggggcggatcggctcgggcaagagcaccatcgtccgcctggcctcggggctctatgcgccgtcggaaggcacggtgctgttggatgacgtggatctgcgccagctgcacccggacgagctgcgccgccatgtcgccgcagtgctgcaggacacgccgctgttcagcggctcggtccgcgacaacatcctgatgggggcggacgagccctcggacgaacgcatgctggcggccgccggcgtcgccggcgtccatgatttcatcggcggcatgaccgacggctacgacctgatgctgggcgagcggggcgaggggctctccggcggtcagcgccaggcgatcgcgctggcccgcgccctggtctcgcccgcgcgggtgttggtgatggacgagccgactgcatccatggatgtgcgctcggaaacgctgttcgtgaagcggctgaaaccgcatctgggcgaccggaccctgatcctggtcacccatcgcatgtcgatgctggaactggtcgaccgggtgatcgtgctcgatcagggccgggtggtggccgacggccccaaggccgaggtgctggcggcgcttcagacccccgccgacggggcggcaccggccaatcttcgtgaaaccccaaccgtccggcgaggtctccgtggccatgcagattgatccggtcgccgacctgtttcccggcgaggcgccgccgcgccgctcggcggtgccgggcatcatcatcgtcaccgtctgtctggcggtttttgcgctgatcacctgggcggccgtcgccgaactggaccagatcacccgcggcgacggcaaggtggtgccgtcgaaacgggtgcaggtggcccagaatctggaaggcggcatcgtctctgaaatcgcggtcatggccggcgaccgggtggagccgggcgacctgctgatccggctggattcgacccagttcggcgccgattacgagcagagccgcaccgacttcctggcggcgcgtgcgcggcttgcccgtctggccgcagaggcgcgcttcgaggccccggccttcgcgcccgatctgccggccgagatgatcgaggtcgagcgcagcattcatgcggcgcgggccgccgaactggcggccagcctcgccatggtcgacgcccagtcccgccagcggcaggaggcgctgaacgaggcccgcgtcgcgctggatgccgcaggccgcaggcgtgcgctggcggcagaagagctggacgtgcttggcccgctggtcgcccgcggcctggccccgaagctggagcggatccgcgccgaacagcgtctggccgaggccgagggcgcgatcgaggccggccggcttgcggttgcccgggccgatgccgcgatcgacgaggtggagcagcagcgccgcaccacccgcgaacgctttcgcacccgcgcgatcgaggaactggccaccgccaagctggaccacgaccggctggtcgaacagctgccggcgctggtcgacaaggtccgccggacagaggtgcgctcgccggtcaagggcatcgtcaaccgcgtgctggtcaccaccgaaggcggggtcgccacccccggccagccgctggccgagatcgtgccggtcgaagacaccctgctgatcgatgccgaggtcaagcccgccgacatcgccttcctgcatccgggccagccggcgcgggtgaagctgaccgcctatgactattcggtctatggcatgctggatgccgaggtcgagaccatcggcgccgatgcggtggtcaaggaagacggctccagcagctatctggtcaaggtccgcaccaccggcgcggcgctgaccgcccccgatggccatccgctcgagatcatcccgggcatggtcgcccaggtcgacattctgaccgggcggcgcaccgtgttggactatctgctgaagccggtggtcaagctgcgcgaaatggcgctgacagagcgctgagcaaggcgtcagggctgcggcgccgggccgcggcggcccttgcgcaactcggcatccaggaacaggctgccttcggcacgggcgagcgccgcggcggcatcctcgcctgccgcaagcctcacctctcccaggccgccatcatgtccggcgcccgacaggtcgcggatcatcccccggacgattgccgatcggtcggggtcggtctcgcccggcagcagcaccgcaaggcgctgcgggtcgatccgccccagcagcgccgtgggcggcagcgcctggcgcagggccgtgatccggtcatgcggtgccgcctgccagccggtctcgcagacgatcagcagaccgccggctggagcggtatccatccgggtctgcagcccggccaggaagccccggcggttcggcaggccggtcggggcgtcggtcaccagatcgcgtttcagccggacccgcagatcgcggatcaccacggccatgagcgcgatgccacagccgagcgcgatgagccccgaggccgcctgcgaatagatcgcatagtggctggaggcatagtcgcgtgccgtggcccccgatccgagcaggatggcggcgaccggcttgctggcgaaggtcagcgtgaacagccagagacatccggccaggatcgcgtcccacacgctgcggcggcgggcaggccagacgatgacgccggagattgccagcgccgtgacgaagggcagctgatagtacagctcgtagggcatggtgttgcgctcaccgtcccagatcgccaggcggatgatcagcgatgcggcgaagcttgccggcaacagccagcggggcagggcgcgacggtagtggcgggccagcccatgcgccagaagatgggcaccggcggagaaacaggcatagccggtgaacgataagaccgtggtccagggggtgacccgcagcaggacctccgcggccggtgcgccggcgcccaccgcccaggcggccgcgatccagcccagatgccggaaggcccggtgcgaacgggcgaccagcaggaagacggcggcgaacagccccgacaccacgacgttgatggccagggcgaggaggccgccggtcatgcgataccctgccgtctgtcacacggtggcatgagagttgcgtgccgtggcctccgcatctcatcctccccttcgtccagatcaccccgcgtggcaccggggtgtatttcggaaacggttgttccaccgaaatgaagccgtcggatgggtggcatccgcaggtaccagtgtcttcatcacaagttttcgcgttcccgcatcatcttccaaacgctttcttcatgcttcctgtcgttttctatccaggataatacaacggtccaccacatgccggtcctggaggtgaaatggcgcgcgacgcagccggtcctgcggcagcccgcgagggcagatccggactcggatcgcagatctggatcggcggggatcgcgggcctgatgacgctgatgctcgccctgcagatctgggccggtttcggcgtgatctcgtcgacccgtgcggtggccgacggcgatgcgctgatgcgggagaccgacagcctgctgcatctgcttcaggaagccgaggtcgcgcaggggcgctatctgcgcctgcagaccgcccgcgcgctcgacgactaccgccgtacccgtggcagcgcaccggtcgctttcggtcagctggcacgtctggcagaggcggagcagcctgacagcggcgccgggtgcagcgtgatgacggcgatgctggaagaagcgttccggagcatggaccgggtgatcgatctccgtcaggggcgtcccgatgacgaggttctgatggccgcggaagcgcggcagatgcaggccgtcgatctggcgcgccagcagatcgccctggcgcagacccagatcggccagcggatttccgcgcggcttacggctgcggacgagaacttcaccatcgctgccggcgcgtcgctgctgggcttcagcttcgccatcccctccgccatcgccatgtttcgccgcctgcgccgcagccgggaacaggaacgccatctgcgccttcaggtcgaagccgccaatctgcagctggaaagccgggtggcggtgcggacggccgagcttctgcgtgccaatcgcgcgctcgccgacgccaatgcggtcaaggatcgcttcctggccaatatgagccacgagctgcgcacgccgctgaatgcggtgatcgggttttcggacatgatcgcgaccgagatgctgggccctgtcggcaacccgcgctacaccggctatgcacgcgacattctggccagcggccgccatctgctggccctgatcgaggatattctggacctgtcgcgcatccaggccgggcggatcgatatcgacccggtggaaacctcgccgcgccagctggcggccgaggcgatgtcgatcgtctcgacgatggcccgcgatgccggtgtggagatcgtattggaggcggatcatgccccggatcaggcaaggctggatgcgcggcgggtgaagcaggtgctgatcaacctgctgaccaatgccatccgctatggcaatcaggggggagagatccggcttggcatcgcgccggccgaggcggcgcctcatgcggtgcgtttcgtggtcgaagacggcggggcgggcatgaccgaggcggagcttgtccgcgcgcttcagcccttcgaacaggtctcggccgaccgccagcggcgggcgggcggcaccgggctcggcctgccgctgacccgcctgctggtcctggcccatggcggacggttcgatatcaccagccgcccgggtgtcggtacccgcgtggtggtcgagatctgacccctgtcgcagaacgcgacaggggcggcgtcgtatgcgacagccgggccgtcgcaacgcgcgacgccaccccgggtgacgcggggcaatgacggattgaaactccagatattccgcggtcttatcctgatcattcccgggtggcatgacggttgcgatgaccggaacgacggcgcgcgagggaacgccgcgccgaatgttccgggaggaagacctgatggatacgatccagccgaagaagatggggctcgacgtcgacaacccgtataaggggcagtacgagaactatatcggcggccagtgggtggccccggtcggtggcgaatacttcgacaatgtttcgccgatcaccggtaagcccttctgccgggtgccgcgttcgggtgcggccgacatcgagaaggcgctggacgccgcccatgccgcccgcaagtcctgggcgcgcacctcgaccaccgagcgcgccaacctgctgtggcgcatggccgatcggatggagcagaacctgctgctgctggcggtggccgattcgatcgacaacggcaagccggtgcgcgagaccatggcggccgacctgccgctggccatcgaccatctgcgctatttcgccggctgcatccgcgcccaggagggcgggatctccgagatcgaccacgacaccgtcgcctatcatttccatgagccgatcggcgtcgtcggccagatcatcccctggaacttcccgctgctgatggcggcctggaagctggccccggcgctggcggcgggctgctgcgtggtgctgaagcccgccgagcagaccccggcctcgatcctgctgctgatggagctggtcggcgacctgttcccggccggtgtgatcaacgtggtcaacggctatggccgcgaggccggccatgcgctggcgaccagcacccggatttccaagctcgccttcaccggttccacccccaccggcaagctggtgctgaaggcggcggccgacaatctgatcccgaccacggtcgagctgggcggcaagagcccgaacatcttcttcgccgacgtcatggaccgcgacgacgcgttcttcgacaaggcgctggaagggctcgccatgttcgcgctgaaccagggcgaggtctgcacctgtccgtcgcgcgtgctgatccaggaatcgatctatgaccgcttcatcgagcgcgcgatcaagcgcgtcgaggcgatcaccaccggcaacccgctcgaccgcaacaccatggtcggtgcgcaggtgtcggaagcgcagatggagaagatcctctcctatatcgatatcggccgtcaggaaggcgcgcagtgcctgaccggcggtgagcgcagccgcctgtcggaagacctggccaacggcttttacgtcaagccgaccatgctgctcggcaacaacaagatgcggatcttccaggaagagatcttcggccccgtcgcctcggtcatgaccttcaaggacgaggacgaggcgctggagatcgccaacgataccttctacggcctgggcgccggggtgtggagccgtgacggcacccgcgcctatcgcatgggccgcgagatcgaggccggccgcgtctggaccaactgctacaacctctatcccgcccacgccgccttcggtggttacaagcagtcgggcatcggccgcgagaaccacaagatggcgctgtcgcactatcagcagaccaagtgcctgctggtcagctacaacccgaacgccctgggcttcttctgagccgggcatcggtctgatcggggagggcgaagacgatggcacgcctggtctatcacgagggcgagcgcgaggcgcatcgccggttcggggtcgaggacgaggcggcggagatctcggacatggtcaccgaccggctgagcctgggggtgcgccgtttcatcgaggcccggtccatcgtcttcgtcaccaccgtcgacggcaccggccgtccggtcacggccttcaaggcgcgaccggacgacatgccggggcaacccccgctgatccgcgccgccgactcgaaacgcctgatcatggccctgcaaccatgggacgatctggacgttcttgataactgccttcaggatgatatcggcatcggcctgctcttcgtcgatttcgatcggcgggcgcgctatcgcgtcaatggccggtgccgcgccgtcgatccggcggcgatcgaggcggagatgggaacgctctggccccaggcccgcgcgctggtagaggtgaccgtcgaccaggcctatgccaactgcccggcgcgcatcgtgcggctgatcgccgccgactgaacgccgccagccatacccgctgacacggtctctcacgctgaccttgaccggtcttcgtgacgacctcgcatgccttggaacacaacctaagataaaagagggaggacgacatggtgtccctgaagtcagccgatctgaatgccccccgtcgccaggcgatcgacgccatgaaggcgagcctttcgcctgagcaatgggcgcggaacgccgccttcgtggccgagctgcgccgcgagatttcggcgcacccggtgtcgcgccacccggcgatcgacatcctgaaccgcggtgtgctcgatcacgacgcgatgcgcctgatccatctggaatatcgccacgccatcgtgcagatcttcaccgatgcgctgctcgccgcccagatgcagagccgccagctggagccgcgcctggcccccgcctcgaagatggccggccgtttcctgctgaccctgaacgtgctcgacgaattcggtttccgtccgggcaaggatgccgagggctattaccgcggcaatccggcctgcgcccattatccgctgttcgaggcggtgctggacgattacggcgtcagcgcggaggaccgggcgacgttcaggccgaccgcgatcgccaccgaggtgcggtcctttctggaagacgcatacggaagctatgtcgacgtctcggccctgctggcggtggccgaggaagaggtgatcctgttcagcccgccgctgcgccgggccaccggtgccctgggtctgggggtcgatgacggctactactacgtccatggtgtcagtgacgacgacaccgccgaggcggccgatgacgatcacgaggacgatctctggttcatcctgacccaggcgatcaccgaggatcagttcgatcacgtccgccgcatcagcctggagtattgcgacctctgggtgcggttctgggatgaacagctggtgctcgccggcgcggccgaaacctcggccgcctgatccggcgatgcagccgggcctccgccacaccggggtgatggtggcggaggccccttttcgattcggggcacataaagaatgccagggaggccgaccgcatggtgaccatcccggccgccgaggcggcggtgctggaggcactgcccttcttcatgctgggaaccgtcgatgccgcgggtgcggcggactgttcccatcgcggccgcatgcctcgggcagaaggcgggggcgagggggggcatgatcccctcgtcaaggtgacgggcccccggcggctggtcttccccgactacaaggggaatgccatgttcaattcgctgggaaacctgatccagcgtccggcggtcagcctgctgttcctcgatttcgcccgcggtctgaggctccgggtcgacggcgatgccgtgatccatgacgacccggcccgatggcccgatgcctggcatggctggtggcccgcggccctgcgctgtatcgaagtggcggtcaccggctacgatgccggctcagccggcaccgtgccgcggttgcgactggacgaggcggcggtcacgccgcttcggtgacgtgccaggcgccgcgccccaaacggttccaggcattgatcagggcgatcttcacggtgatggccgcctgttcctcgggcgaccagtggcgggccagttcggcgcgcggggcatcgagtgccgcctcgtcacagggcagggtcagggcttcggcccaggcgagggcggcggcgaggcgccggtcttcaagcgcagccacggcggcctgatcgcccatctgcgcgatcagcgcttcatccacgccggtgtcgcgagcctctgccaggtgaagcagcttgcaatagctgcagccgttcagccgcgagacgtgaaggtcgatcagatggccgagagctgcgggcagggcagggccgttcaacgcctcgctcgcagccatcagcttgcgcgatgttgcagccgtagcctttgagccgtggatgtcgatcagggatgtggcggcgggcagattggcgagattggtcatgacggacactccgtttcgtcaggcaatgccgcccccggggtcttgtaccaggggcttgatacctgtcagacgatcacggggctctgagcgtgacatccgtcgccgtaaaattccggtgcccggcaaaaaatacccggcagatccgacccggcggcagaaaatgccgggggatctgccgggttgtgtcgttcccgagcgccggtcaggcggtggcgctgacccgcgaataggcaccgccggtggcgttctggccatagccctgctggcccgaggcccgcccgctggcaccagcctcggcgacgatctgggcgtccagcgcatgccaggcttccgacaacggccggagcaggccgatcacctcatcagcggcattggcgtcgttgcgcaggtcgatctggatcatccggttgagcatgaagcggtagagccgcgacagattggcggcgatttccccgcccttgtcgaggtccagcgtcgcctgcagatggacgatgatctcaccggcatggttgttggcgtcgtgacgagccttgacgtcaccgcgcgcgatggcggccttcgcttcctgcagccaggtgatggcacggtcgtagagcatcgccacgcgctgcgcggcgctggccgtcatcaccgactggatgcgataggtctgggcggaggcgccgtaggggttgctcatcggcctattcctcgtgtggcagggccgcggatcagttgtcggaactcgaactcatggcgtccacctgggctttcaggctttccaggatcgaattcatctgcgagagcgattcttccatccgcaggaacttcgccgtgatccgggtcttgtacaggtcgaggcgggtttccatccgggagatctgatcctcccaggcgctggtccgggtctcgaatgtatcgagctgtgcagcaatcgtgccagttccgctggcgagcgccttgtcggcaacgtcgtagagctgggacgccacaccctgggtgacgctgaaggtgctgttggtggtgccgtccgcgcccgggcggaaaaacagcttcagccccttggcgctgccttcggtggcggtcagcgtggtgccgctgacctgcatgtcgacgccgtcgagcttggccgacgtgatcaccccgccggcgacggtgacttccagattgtagccgccattcttgtaaccggtggtcgaggcgaagctcaccagcgacagatcggcattgtcggtggtgaagcggaagctgagcaggttgcgcacatcgtcgaaattgttgagcagcgcctcgttcagcttcgattcgtcgatctgcagcgtttccttgtcgagcggatcggtcagcgtcgcggtcgaggtcagcgtgatgccgatcgccgacagggcggcgaaatcgatacccaggccttcgacatcgccgttgatggcgtcacgcagcgaggtgttcatgtccttgagcgcgctgttgccgaacagcggcccggcatcttcggatttggtgccgtcggctgcggtcaggttctgctcgttatagaaccggcgcatctcgttataggcgtcgacgaaggcgtagacctgatccttcacgccgttcaggtcgcgttcgacctgaaggttgatcttggtgccttcctcggcctgataaagattgatggtcatgccggtgaagaggtcggagaccgtgttgctgctccgctccaccaccagatcattgtcgacacccagcgaggccatcagcccgtcgctgtcgatgacgctgagctggccgccattggtgtccttcagtaccagccgcgcaccgccgccgtcatccatgatcgaggcctcgacaccaatcgccgccgcattggcgttgatggtgctggcgaggtcggagaggctgtcggtggtggtgtcaaaattgatcgcgaccgagcccaggccggtcgacagcgtgaaactgccggtcgacggcgcggtcgataccagcgacttgatcgaggccgtgtcgttggcgaagcgatggctttcgtagcgggacggatccttgaggccgtcgaccgccatacgtgccgtctgcgcttcctgcaacacgttggagaaagtggcgccgccatctgccgagatgccgagcgtggagagcacgccgccggtctcgttgccgatctggatcggctcgcccgtcgcatcattggtcagcaccagataattctgggtgccgccgaccgagatgatgctggcggtgacaccggtcttggtggtgccggtgttggcgttgttgatcttgtcgcgcagcgactgcagcgtatccgtgccggagacgttgatcgtggtcgccgcgccatcgccattgacgatgtcgaaactgccggagaccgaattggccgcacccccgaaggcggtgcccagatccgcggtctgcgacgcggcggcgccggtcgccaccttggcctgggtcgcgacccgcagaacctcgatcgagcgcacgccgacctcggcctgattggtggccgagatgctgaccagattggcggcactggaggcggtgccgccgtcgagccgcgaggtctgcaggaagatgttcttggtttcgaaggcgctgccgctcttgtcgaaggtcaccttgccgcgcagaccatcaaccgcggtgcggaagttctgcatcagcgtctggtattccttgagcgcggcgatctgcttgtcgaccgtctccaccttggtttcaagccggtcgatgggcacacgctttgccgcaaccagcgcctcgaccgctgcgtcggtatcgataccgctgttcgacaggccggtcacggtgaggcggccgttcgcatccgtcgacagcttgtagctggaacttaccgaactggtcgacatggggccttgcctcttcgcagaactggatcaggcggccggctgtaaccggcagatgcgtgtcggacgggccgacccggacagtttacaacgtccggtcgacgacggcaccgaccatctcacgcagcgccgcgatcatgcgcagcgtcttctcgggcggcagctgctccaccacctcaccggtgctccggtcgacgatacggccgaccacatcgccggtattggtatcgatgtcgagcgccagcttgacctggctggccatgctgcccagatcgatgccctgttcgcgcagggccttggccagagcctcggctgccttgctgccgctgctctgatcttccgcctgggtcacgtcgacccgccggaagggttctatcgtggcggcgcgcgcatagcctgccgctgccgctgcttcgccgccgccaccgctgcctgaccgggcattggtcgccggccggtcggtcacggtctgaacgtatgagcttccgcgtaccgatgcgatgtccattgtcccctccatggctgccgcgttcccttgccctgacgcggctgctaaggatgccttgacggcttgctgtacatgtcgggtcgagacgtgcggtacacgatggatgtcacgcaaaagcggacggcagcgccaaaccggccccgccgcccgtcaggtgcgatctctcggatcgtgccaccgtaatggaaaggcgccggagccgccgggccatcaggcgccggcggctccggaagggccgtcaggacagcagcttgagcaggttctgaggcatctggttggcctgggcgagcatcgacacgccggcctgcatcaggatctgcttggaggtgaacgcggtcatctccgaggcgatgtcgaggtcgagcagctcggaccgggcggcctcgctgttctcgatgctcgaggccaggttcgccgcggcgaactcaagccggttctggttcgcaccgataccggcgcgacggtcgttgacctcgtcgatggccgccgcgacgttgtcgatcgcggtttcggcattcgcccgggtgtcgagcgtgtcggcggccagaccggccgacagagacgccaccgcggcgctgtcgagggtgaaggccagatcgtcttcggccgccgtcgtccccgtaccgatcttataggtgaaggtggtcgaggcgttgttggcgacggtcgcgtcgaaggtgttgttcgccgtgatgtcggtcgccgggtcgaagtccgaggtcagcgtcagggtcaggccgaactggtcgaaccggacatcctgggtcgcaccggccgccggggcggcggtcacctgctcagaggtctgggcaacaccggtggtggtgttggtgaccgtgaagcggctggtggcgctgtcgaaggcgatgctgaactggtcggcgttcgacacattggctgcgttgttgtcgaaggtgatcgcgccgaagccgtcggccgattcgatatcggtgccgatggtgcccgcggtcacggtctgcgaaccgttgatcagcttctggccgttgaactcggtgtcaccggcgatacggtcgatttccgaccgcagcgaggtgaactcgtcgttcaggtagacacgctcggcgtccgacacctggtccgaggcggcctgggtggcgagcgtcttcatccgggtcagaacgtcgctgatgctggacagcgcgccatcggcgatctgcagcatggagcccgcctggccggcgttgacactggcctgacgcagcgccgcggtctcggattcgagacgcttgccgatggcgagcgaggcggcgtcgtcacggcccgacagaacgcgggtaccggcggacagcttggcgagcgaccgggtcgcgtcgttgtcgctttccttcaggtagcggtacgcaacgttggccgaatagttggaggcaatggtcatggccatggtacggtctcctacttggaaccgatggcgcgggcatccgcccgctgatgccgacatcctgtcggcagcacgtccttcctggtcgtgcctgtgggtaagtatgcaatgacgatgccagagacgcaagcccctgaaataccgtgaggcagcctgtcgcaggcagagaaaacccggcaaaatctgccgggtgttggcggtctggcccggcagattttgccgggagacggcgcaagtgggctatttttgccgggctggccatgcgccggatggggcgcgtgccgggcacaccggcttgaacgactgcggggcggcccggttccctttgcggcgaccctgaggtgccgctgcgggacggagccgccccggaggacggtcttgaagcggaagagggggccgcggcggcggccgccctgatcagcccagcagcttgaggaggttctgcggcatctggttggcctgggcgagcatcgacacgccggcctgctgcaggatctgcttcgaggtgaaggcggtcatctcggacgcgatgtcgaggtcgagcagttccgagcgggcggcttcgctgttctcgatgctcgacgccaggttcgccgcggcgaattccagacggttctggttggcaccgatgcccgcgcggcggctgttgatctcgtcgatcgcggcggcgacgttgtcgattgcggtttcggcattcgcccgggtatcgagcgtgtcggcggcgagaccggccgagagcgaggcgacggcggcgctgtcgatggtgaaggccagatcgtcttcgatcgcgttggtgccggtgccgatcttgtaggtgaaggtcgccgaggcgttgttggcgatggtcacgtcgaaggtgttgttcgtcgtgatatcggtcgccgggtcgaagtccgaggtcagcgtcagggtcaggccgaattcgtcgagccggacatcctgggtcgcgccggccgcgggggcggcggtcacctgggccgaggtctgggcaacacccgtggtggtgttggtgaccgtgaagcggctggtggcactgtcgaaggcgatggtgaactggtcggcgttcgacacgccggccgcgttggtgtcgaaggtgatcgcaccgaaaccgtcggccgattcgatatcggtgccgatggtgcccgcggtcacggtctgcgaaccgttgatcagcttctgaccattgaagtcggtgtcggccgcgatgcggtcgatttccgaccggagcgaggcgaactcgtcgttcaggtagacgcgctcggcatccgaaacctgatccgatgcggactgggtggccagcgtcttcatccgggtcaggatgtcgctgatgctggagagcgcaccatcggcgatctgcagcatggagcccgcctggccggcgttgacactggcctgacgcagcgccgcggtttcggcttccagtcgcttgccgatggcgagcgaggcggcgtcgtcacgacccgacagcacacgggtgccggccgagagcttggcgagtgaacgggtggcgtccgagtcgctcgcgctcagatggcggtgcgcgacgttcgcggcgtagttcgaattgatcgtcagcgccatgacttggtctctccgatacttgcgcttccggtggctttggagcgttccatcgcgccacttcgagcggccaaccctggcccggcccgcacggcacgatctgatcggggacgcttattgcacggggtgtgccaagtctgaaaaatatttaaatacaatgggttaaaaagtttgatccgccgcatctgcagaccgtgcggagattccgacccggcagtttccgccagggcgggcggcagaaactgccgatcggcaggctcgcatcgcccgaggcacggcggtaatctcgtcgcgaccccgtcaatatctgccgagccggaggagccccatggccggacccgagatggtcgaatacgaggatgcatcgcccgaggtgcgggcggtcttcgacgacatcatgcagacccgccgcgtcgaccggctgaacaatttctggaaggtgatcgcggtccacccaccgaccctgaagcggacctgggaaagtctgaaggaggtgatggccccgggcgcgctggacccgatggtgaaggagctgatcttcaccgccgtcagcgccaccaatggctgcgcctattgcgtcaccagccatggcggcgcggcggcgaaggccggcgccagccccgagatgatccgcgagatgctggccgtggtcggcatggccaacgagaccaaccgcctggtcttcggctatcaggtgccgatggacgagccgccggccgccaccgccgaaacggatgcggccgacgcgtcgaagcgccggccgcggtcaactcaggtcagggcgcgtcgggcgggccgcgatcagcggtagccgtatcccaccacgccggtctcggggcggatctgcagggtgtcgtagccgtcgagcagcgcctcggggccgagaaccgggtcgcaggcccggaagatgatgtcgaagccctcgatatggcgcggcagcatcccgcgttcatcctgaagccgctgccaggcgagcacgcaggtcacgcccagcggccggcgggcgacggcaaaaccgtagcggccataggcgttgcggcgcggcacggccgagatctgcggctccagccccgggaattccttggccagcagcagcctcagcttttcctgggtgaaccggtcgcggggcgcattcaccggcagatcggcgaaagaccacaggctgtcggtgcgcaccagccagagatcggcctccagccggttctgtccggcttcgaccgaacggttgggcaggatcgacacctgcttcagctccgagccgttgttcgatttcgtctgggtgacgatcagcggatcaggggccgccgccagccgggccagcgcctccagcgggccgagacgggtggcaccggcctcttccgccagcgccgtcggttcggggccggcacgttcataggtgcagccggtaagggccagaaggcccaggacagccgcgacgaggccggggagggcaggcttgcgcatccgggtcatcgggctcactccggatagaaggtgacgacgcgcaggccctcgcgcgattcgggcgtgctgagttcggtgtcgagccgctcgaacagccggcgcgactggccgagcttgcgggtgtgatagagcgaccaggcccgcatcagggccagatcccgccgttccggggcgatctggcggcgggtgtcgagcaggcgcatcgccagcaggtaatcctcgtcgtcataggcggcctgggcacgggcggcaagcagttccgcctgcagatcggtgcggcgttcaggggtgatcggctgggtttcgatcatccgctgcgcctcgctgaccagacccatctgcatcagggtcaggatttcgccatagacggcatccgcccccatctcgccgccggccgcgcgggcctgggcaaaggcatattgggcttctgcgggccggccgaggcccagcagacaccaggcgcgctgcatggcggtgccgggcgcctctaccggcaccggcggcagggcggcggcgcctgaaagcgtcgtggctgccggtgcggcaacggcggtggcgcgcgatcctgcgctcacgccgccggggacgatgccccctgccgtggcccgccctgccgtggtcgacacccctgccggcacacccgtctgtgcactggtggcgccacggctcgccacggcatcgggggtatagccgtaggagcggccatagacgtcgcccccggtatagcctgtggtcggcgcatagccggccgcggccggcaggcccgcccgatagaccggctcgcccgccgaccaggacacacccgcccggccggtgccatagccggtataggcggtgggcacggcgtcggggggcagcaccggtggcaggcgcccggccagggcgcgggtggcgtcggtgggcatctgtgtggcatatccggccgccccgccccgcggatccggggcaagccggccatccagcaccagcaggcagccggcattgtcgccgcgggcataggcttcggtcgcggggccgccgccaccgccgccgctgccgcgcagcccgctgaagaacttcgtcagccgcgccgagcggccgccatattgctgttccagtgcctggaaccgggcggtctgaccgctgccctgcaggccgagggcaaggccttcgaccgcctcgtctccgccgccccaggccagcgcattctcgaaccagagcgctgccgtggcgggatcttcgcgccggctgtgccaccagccgagcgccatggcggcgcgggcatcgtgcttttcttcggcccaggtcgcgaaatccaccaccatggcgcgcggcgcgttggtctggcggccgagcatggcgctcatgctgtcgacatagtcgcggccaagccccgacgagcgggcgaggcgcgccgcctcggcggtcttgccctggcgggtgagggcctgaatccggccgcgcagcccggcctccttcgcaccccagctttcggccttgcggaaccaggcttcggcctcgccggcctggccctgttccatcagataccaggcgaccagcatcgcaccgtcggcatcgcggcccgcctcgacatcggccttcaccgcgtccagcgtttcggcggtcacctgcggccgggtgccggatttgcgggcctcgggcgacatcgccgcggccagctcgccgcggcgcagcccgccgaccacctgctgcagcgctgccggatcggtgccgacccggccgcgttcgatcgccaccagctgttccacctgatcggacggcaggatggtgccggctttctgcaacgtggcacgccgctcctgcgcgttgtcacaggtcgacacgatggtccggtagaggccgaatgccgcatccggatcgccgagttcggcccgcgcctcggccaggcgccacatgctgtcgacgctggagcagctgatcagcgccggatggcggtcggcgatctccaccacggtccgccactgcttcgcatcgctggccgagacgagccgggtgcggtcttcgcccatcgccagggtgtcgagcatggcctgcgacggcgaccagccgggatagcgcccccgcagctccgccacccgtgcccgtgcctcggcaaagcggccgtcgccgatcagatcccagatcgggcgttcgtccaccgggctgtcgggcgtgcggctgaacaggtcggtcggcgtctgccaatcgggatacagcgccttcagccggcggatttcggcctccagcttctccatgtcgcggatgcgggcataatagcgcagcgccgtttcgtcgacggcgcccgtggccggcgtgctcggctgaacctcgacccgcacgcccggggccaggctttcggcgccggatcgcggggtggcggtgccttgtgccgcggccatgccggtgccggcgagcagggcgatcaccgacaccatcgccggcgcggaggcgcggagaagcggtctcagggtcacaggcatgcaggcttcctcccggcggcggcaaggcggaccatcagggtcaggctggccgcgtaatacgaggcgtcgtcgtcgacggcggtgacatcggccggcatcggccggtcgtgaacgatacaggcgaccaggccggccacggcgcggaaaccggcatcgctgccgcgctcggtgaccctgccgtcgggcagggccacgacctgcggccggtcggcgatgcgggcggccccggccggccagagccggtcgagatcgacatagatcggcagggcagggtccagcaccccggcccaggccagatacagcggcacccgcacggcgttgtagccgaaggcggcggggaaattcggatcctgcggcagggtgaaggcgccgtcaggctctgccaccacccattcgggcggcagggccggggtgccgaaccgcacggcggccatgacagccggggtttcggcggcaagccggttccagatcgcggcgccgtccggatcgatgtcggccagaaccgggaaggccggcagcacccaataggccgggttcacgaccaccgacgggtcgcggcggaagccttcctggccgggcaggaccatcagccgcccggcatgctccacgatcacggtgcggcggatcgcggcggcaagttctgccgccgcctcgcgatagcgatcgtcgctccagcgccgccccgcttcggccagtgcccaggccgccagaatgtcgccgtccgacgcgctgttgcgatcggtcaccgccggatcggccttggggtcgtagcgccaggccatcatgccgtcatcgcgcacgaacagcgtggtatatgtccacgaccagatccgcgcgaaactggcccggtcgcccatcagcaccgacagcagcaggccatagccctggccttccgaatggctgatgccgccattgccggtgtcgataacccggccttcgggggtgagaaagcgctgccgccagtcttcccacagggccacggtgtccgcatccagccccgcctttcgatcggcctcggtccgcggggcttcggcgcgcgccgtttgaaccggcggggtatcggcaggggcaggggtctgcagctgtgcccggtctttcggtatggcttgtccctctgacgagacgggcacgatcgccggcgtcgccgccgcagccagggcacgcggggccggcagggccgatgtcgtcccggcctctgcggtgccgtccggcgtgcggcttttggtggtcgcccagaccgcaaaggcgatcgcggcgatcaccgccaggctgatcacgcgggaacggctgctcatacgggtctccggggggaatggcggacaagaatatgggtggcgatgcccagcgtgccgatcagcagggcgatcaccgcggcccagatcaacacattgcgcgagaaccagctggcggtgatcgacagcacgccgaagggccccacctctccggtcagcacgtgataggccgggccgccatcggccgtcgctaccgtgcgcccgtcgctggccagcgtggcgacgccgcccttgagcgcgtcccaggcctcgtcggcggccagcagccgcacgccgcccagcaggcgctgatcgtcggccgcggtcaccagcgtccaggtggtgccgacatcctggggggcggcgtattgcatcaccgccagcaacggccggctgccctcggtgaacagcgtttccgggctgcgccggtcgggcagggtttcatccagaatccagcgggtctgggtgcgcagccaaccccagctgcggctggcccagccgatcatgccgtcgccccggtcttcggcattttcccccagccggcgctgccattcctcgcgcagcccctcggaccagcgactggttgcggcggcccgggcttccagccgccgggccgtctgtgcctgcagcagctgcgggccggattcggcacccccggtggctatggcatcgtcgccctccacgatcgtctcgggcagacggccgcggttcagatcgcccagcagttcgggcccgaccggtgccgccgcgatcagatccaggcccagccgcgcgatcggcgccacgatcagcgtgtcgcgggcgcgcagccgcggcatctggtcgtagaaatgcggttccatcggcacgccggccgcccgggccatgcgggcaatgaccgtggccgccgccgttacccccagcggctggtccagcggggtcaccacatggaaggcgctgatgtcgtggccggggcggttatagggaaagccggtcccggccatgacccgcagatcgggcaggctggccagatgggcgaccggcggcacctcgatcgtcgtggtgtcgaacagggtgaagcgcggtgcgccgccgcccgccgtgccgccgcccccggggccggccagaacgccgtcggggccgcagaaggcaggggtgccgggcaggcgggtctcgaacgagatcacgttgcggccgggctggaacatcgacagcggtgccagcagctcggcattttcaatcagtgcgccgccgggggcatccagctgcagggcggtggcgaagttgccgttgatcagcaccgccacttcggcccgcgggccgacatttgcgccataggcggcatccagacggatccggacccgcgaattgtcgccgacatacagatccatgggcatgtcgaccggcaggtcgatgcgctggcgcaggccgtcgaagggatcggtgtgatagcccagctgggcaaggctgtagcttgcgtcgccgtcgatcctgggggtggggcgggcgggcacgcgggtttcgatgtcatagaggtccgccaccagccggtcgctgccgggcaggggccgggtctggtcggcgaagcggcgggccgccagttgggcctcgcgggtgtcgcggccggtcagcaccagaatgctgcggccgccggtgctgcggatcaggcgcagcacgccgtcgccggcatcgcccggatcctcgcccaccagcccggcaatggccggtgccgagcccaccacgatcacccgccgggggccgtcggcagaggcgggggccgacagctggcgggccagccgggtatcgtcggtggcgtcgatcatctcgaaggacggcatcgaaaccccggtgcggatcgccagcgcctgggcggcgatcgcggccgccgtcatcccgccatccgaccggaagccgtcggcgaccacgatcgcgaccggatcgtccaccagggccgggtcggtgatcaggctgtcgaaatcggcaaggctggggccgtcatcggcgacggcgagcatcagacgcgaggcctgattgtcgagccgcgcccagagttcataggtggacgggatgtcgcagagcagccggtggcgctgtcgggcgatgacatccacccggttctggccgaccgtcagcatctcgaccggcagttcgatccgtgcggtgaccgggccgcgatgggcatccagcggcagacgggccaccggctgaccgttgatccagacatccagcgccgaggcatcgggcgaggtctcgaccgaattgctgtagaccagcttcagcaccgcgtgatccaccgccaccgcatcgggcagcaggaccgagaagcggccgaccgcatactcgcccgagagcagcgtgccgcggctgccggtcgggtccagcggcaccagggcgtagccgagcatgtcttccggcaccgccggcaccggctggggggcgggcgtgggtgccggggccgacgccgccggcagcgatgtcggcggcacggtcacccgcggtgcctgcggcttgggcgccgccggttccggtgccggtcttggttgtgatgccgggccgggggccggcggcgaggcacgccgcggctgttccaccatccgcggtgccggtgcgggttccgccggcgccggggccggagcgatgaccccgcgataggcgccgccggcatcggccggggtctgcccccagagcttcagatccaccggtccctgtgactgggccatggcgggtgcggcgcccagctgcagtgcaagcgcgcccagcgccagaagccggatgtggctgcggcgggcacgggcacgggccggtgcggtgaatgatggatggatggccatctgcgtcgtcctccggctcagctggtgcgcggggcggttgcgctgccgctccagccggtgggcggcgtaagatttccgtccggcggcacaccctcttgcgcgctggccggctcggtctgcagccgcggcggcgggggtggcgccgggttggcacggaagcgcgatccgcccagcacgaagccgagcgatcggaagccgtaggcagcactcagacggatgaaatgggcaacgccgcgcaccactcccggccgcctgtgacggcgcgagagcagttcggcccaaagcgcgctggagccatagaccagatcgacgatggcctctttggcggcgtcggtttcgggcatgaagcgcaggccgatctggatgttgccggcatcgtcgggccgcccatagcgcatttcgaccggcaccgggcgggcctcgccggtggcgaggtgggcgggcgccgtcagctcgtcgaccagaagttcggcgaagcggccggccaggcggcccttgggcgcctggcgggcggggatggcgagccgggcgccgccctgcgacaggtccagcagggcgccttcatagagcgtgccgtcgatcaggatccgtgccgggcgcttcaccatgacccgcggggccgcgcgatgctgggcgtgctcgcagactacccccaatgccgcagaggcgagcaacaggttgaacgtgttccagaaggtcaccaccagcagcacgtcgcgggtggcgggctccatccaccagcgccacaatgctgcccccattcccagaatcagcaggccgaccacccccaccagtggctttgccagcggcgagacatggtcatgggccagcgtctcacccttggcggtgaccctgaagacgggcttgcgcgggtcgatcatcgtcttgacgatcgcgaccgaggtgtgcagcgactggctgagttcgtagagctccgagatcaagggccatcggaaccggccgttgagcgcgttctggatcatcagcgacgcgacgagataggtcagcgtatagccggcaaactccgccgccgtcgcccgatagatttccagaccaaagaacagatagaacagcggtgcaatcaggaacatcagccgcgagaacgggaacagccagaacatgctgctcgccagatagcacagccgctggggcagccgcaggccgcgcttgatcagcgggttcttcatcatgaagatctgggtcatgccctgggcccagcgcgagcgctgaccgatgaaggcggcatagctttccggctgcaggccggcgatcagcggtttgccgtaatagacgctgttgtagccgcgggcatgcaggtcgagcgcggtttcggcatcctcggtgatcgacaggccgctgaacccgcccacttcttccaggcaggcacggcgcagcagggcggccgatccgcagaagaaggcgccgttccagcggtccaggccgcgctggatcatgccgtagaacatctcgttctcgctgggcatgcgctcgaaggtcttgaggttgcgctccagcggatccgggctgaggaagaaatgcggggtctgcaccaggaacagcttcgggtccttgcggaagaagccgacagtggcgagcaggaagtcgcgggtgggcacgtggtcggcgtcgaacaccgcgatcaggtcgccatgggtttccggcagtgcggcattcagattgccggccttggcatgggcgttggtttcccgcgtcagatagtgcacgcccagccgcgcgcacatcaccttgaggcgctcgtgccgttcacgcgccttcagcgcctcctgcggatcggccgacatccgcttcatgtcggtcgacccgtcgtcgagcagatagacgttcagcctgtcggccggataccacatccgctttgcgccgatcagcgtcgtctcgatcagcccgtcatcctcgttgaagctcggcacgaagacgtcgaccgtcggcagttccgccggatcttcgggcaaaggcgggctcatccgcgtcaccgggtcgatgacgacgaagttgttcacgaagaacatgacgatcgcatagacctcggccgcatagagcaccaggccgggcacgaaggcgaaggggtcgtccagcggcggcagggtggacagcgtgcgccagcacagatagcgcgccacgatgaagccgccgatcatcaccagcatggtgcggcggacgctggcgtcctcgtgcgcccgggtgcctttcagcaccgccatggccgccagcagcaggatcatgagcacgatctgcgccggcaggctgaccggctgtgccgcggccgccagcagcgcgaccagcgccaggacccagatcagaccgagcgcgaggcgcccgaagcgttgtgcgaccatcctgtcaattccataccgggtccagggtgatgccagggacacggatcgtcgtcgacgttccgctgcgatgtcgggggctgaccggtgcgatgaccagggtatggactgatatgaacctcgagaaacataaaataccagtaaaattttccgaagaatcttttgaatgcccgcgtgcccgccatccctcgatgcatgatggcgcatcgagcgatgggcccgtcaagtcaacattgcgtaagacagcagaccatggacacgccctgcgctgttccagccacactcgacggcaagcgcatcgatcagcgccggacggctcagatgctcgaacaggcgggcgatcacggctgcgtcggcggcaaaggccgcgcgcgcctcttcggcccgcagggcggcatcggtgtcgagatccagggccgccacccgtgcggcgagcgccgtcatggcgaaggtgacggccagccggataccgggcagcgtttccggcgtcgtcgtggggagcggggccgccgccggcgcgtggggagaggccaggagctgatggtcgatccaggcatcgagcatccgggcgaggcccgacggggcggcccggcgccgccaggccgcgtcgcgtgcggccctcaatgcatcaggatcgtcttgccctcggatatcgagcgcgagcgtcctgcgatcgagcgtcacacccagcgcgatctccagtcgcccggtcagccggtcgagcgccggccgccagacgccgccggtggcatggaccagggcgcccagggtcagcagcaggcgtggttcgtcgagcgggtcgcctgccggccgaggcagacggtcgaggatcgatcgggcaagcgccgctgcggcagcgggtttttcggcctcgccaaaccgggcgaccgagccggtgagcgcggtgagcgcgcgcatgcgctgatcggccggcgcatcggccgccagccgggccatcacggccctcagcccctctccctgaggggcaggagggccgacaccgtcccgggcggtggggtcgagcgccagtcgggcgatttccgggcaggcgagctgggcgatgcgcagccggctgccgtcggcgaagctcgccacccggcgcgggaagccgccacaggctttggagagcacgtcatgaccatgggctgcgtgcagccggcaccagccctgatccagcgccacacaggcaccgtcgcgacgggccatgctgcggcccgcatcggcatcggtgctggtgagtgccgccagctctgccggtgggaacaggtcctgccagcgcgcccaggtctcgtcgtcgacttgcatcgaccagccggcgcagcaggtgtcgccgcaggcggggccgatgcacgtgaaggcatcgagaacgggttgattgcgcgggctgtcctgctccatgcggtccggacgagacgggttgggctcagcctgcgatcagcggctggcggatcggatatttgggattgtgcagcacatgctgccagccccggcgcgcctccacatccaccaggatcggggcccggcggttgatggtcagcagcacgccgccttctacccggtggctggcgaccaccagcagcacggcggcattggtgcgtgcgatgcccagatgggccagcgcctcgtccagatcctcggcatcgatggcatcggtcttcaccggcaccggcagcaccagcatcgacaccttgggattgtcgatcgagaccaggatcttcagatggtcgatgcgttcgtccgcgacctcggcgagggcgaagcggccgcgaccgccgaggccgaccaggccgcggggaatttcgatggcgcgatcggggtcgatggcgatccggccgaagcgggtgtcgagcaccatctgtgtatcgggggtcatcggggcatcgggggtggtttcggacatgtcgggcgacatccggatagcatgggcgacagccgtcagcatgacacgctttccttcgcttgagcagtccccgtatgggctgtgccgcaatacgggggagaatcgggtgggcgcagggggaggcccctgcgggagcgcttacttcagccctgcgcgggcgcttacttcagatagtcggccagcgacatccggttgatctgcgacaccatcatgtaagaggcatccagaatggtctggtcgttggacatccggatggtggccgaggggatgtcggtattctcgatcgccgagatggcttcttcctgcgtcaccttccggtcttcgtggccggtgatgatgctgtcgagccgggcctgattggtgcccacctcggcgcgataatcggcgagtgtcgcgatcgcgtcattgaccatggtcaaggcggtttccgccatcgcggtcgatccggtctggccggcctcgatcgccgccttcagcgagccgatcagttgctgaaagcctgggcggtcggcattgatgccgtaatccatggtgatctggtcgtcgagtcgggcgctgagttcaacctcgtcgcccgcgtaatagctggcatccgggtcgccccagatcgccggatcggggaccgggacggtcaccggtttggtatcggtgcgcgagccgccgaacagatagcggccgtcctccgacacgttcagcgcaccggtcaccgtgtccagcagcccctgggcttcctgttccagcggcaccgcatccgacagccccgaggtggtcgcctgcatcagcagggtgcgcaggctgctcgccgcatcaccgatggccgagaggctctgatcgatcagggtcagccggcgatccacatccttggcattcgacagatagttgtcgatccgcgtcgcctcggagcgcaggttcagcgtcttttccgaatcccccgcgatgcccgcatagttctgggcgaccttgccgctggagatctgcgtgttggtcgcataggtccgggcctgaacctccatcacgttgttcaggctgcggttcatctgggcgtagttggtgacgcggatcatgatcggaaacctgcatcgagaggatctggcggaaccggcgggggccgggcgtcatgctgaatgaaggggccggccaggtcagttgccgacgatgttgagcagctcgtcgaacatctgcttcgcggtggtgagcacgcgggccgatgcggtgtaggcgttctggaacacgatcaggttgctcatctcctcgtcgatgttgacccccgtcaccgaggcatcgcgataggagagatcttccttgaggatcgccgaatcgctggcgcgggtagaggcttcagccgacacgctcgcgatgttggagatgatgcccgaggcatagccggtcagcgtgtagttgccgcgggcgagcgaacccacgccgggcatcgcctgggcggtgttgacaccgaccgccagcgcctgggcgttgcggttgtcgcccgaggtgatggcgacgtcgcccgcaagcagggcggtgtccttcagcagcccggtcgcgacccggcccggatcggcgaccacggccttggatacttcgatcgtcgcggcatcgtcgccgtcgaacaggttgttcagccccagatgatgcgacaggccgcgcaccgtaccgtcggtgtcggtcacctggctggtgctttccgacagcgcgatgcccgaggcggttccggtggcggtcagcgtgaacttgccgtccacgatcgaggccgagacataggggccgagcgcgctggcattgatggtgtcgcgcaggtcgccgatgctggtgacggtggaaagatcgatgtcgagcgggggggcgaccagcgtaccgtcggctgcgaccgccgcgatgcggaaggtgccggtggccgagagcggcgtggtcgccgcgacatcggtcgacccggtcagcgacgaaggcgccggccagccggtgccctgattgtggatggcgttcatccgctcgaccagattgtcggccagggtgtcgagctggccgctgagcgccgccagatccttgtcgcgcacctgaagcaggccggcgaggttgccgcccttgatggtggaggtgacctggtcgctggtgccgccggtcgccagtacatcgccgtcgttcagctgttccagcgtgtcgggatcgaccgccaccgccttgatcgggccatagacggcgtcggcacccggctccatcaccggcgtataggtcagctggcgcaggctttcgtccagcagggtctggccggcgccggtatagatcgcgatccggccgttgctgccgctgacgatttcgacatcgatctcggcggacaggctcgcgatcgcgatgtcgcgcttgtcctccaactccgaggccgattcgcccagcgcattggcgcgctggatgcgggcgttcagatcatagatctggcgcagcgccgcattcgcggcctcgaccgagtcgccgatcttcgaatcggtgtcggcgcgcacctggccgacctgggcggcattggtgttcagccggtcggtcagagacttggcggccgagaccagattgtagcgctcgctgcccgactcggtggcgttggcgaccgattcgagctgggtgaggaaggcatccagatcggccgagatcgagttgctgccgccgacctcgccgaacatgctctgcacctgatccaggatcgaggcgcgggtgctgtcgcgcgcctcgtcggaagaggcgcggcgcagctcggcacgcagatagttgtcgacctcgcgctcgacgccggtcacccgcacgcccatgccgtagccgccgatggtcgccgattcctggacgaccgtcttgcgggtatagcccggcgtgttggcgttggcgacgttctgcgacgtcaccgacaaccccgcctgggccgcgttcaggccggtggtcgcgttgcggaaggcggcgtcgagggagagcgacatggcgaagggctccggcggctcggggtctggatcagatgctggtgttcacgctgatcgcacccgcccggatggtgccggcgcggcctgcggtgcaggtgcggccattggcgccatagacggtggtgggcgcctgggcccggacgatggcgctgcgcacggcacccaggatccgttcgttgagcgagcgggccgccccgatccggcgcaggttttccttcaccgcctcggcgaagcgcggggcgatttcgcccaggcgcgcgaaatccggggtcgcccgcaccgccgcctgatcctgccggccgagcagggcatagagctgctcgtagccgcggcccaggcgctgcttgtcgccctgcagcgcgcgcatccggtccatatccttgatcgccagcgccgcggtttcctcttccagcacccgggtcagttcctcgaccacatgggccaggtcggcgaccagggtggcgacttcgggatcctggcggctggcggcggcacgaatggcggcggcgaggccgtcctggccggcggtgatgatgtcggtgggtgcgggcatgacgaaactcccgaagggacggcaggacagctcaggactgggcttcctggatgcggatcaactggtcgaggacttcggccgaaagaccgatgccgcccgcctgggccatggcctggccggtcttttcggccagcatcgacttctggaagtcttccgccgcccgggcgccggcgccgtcgcccatgccgggcatcagatcgatgccttccagcatggtcgacatcagccgcgacaggaaaacgccttccagggcttcggtcttgtcgcgggccttgtcgatgtcgatgctgcggccggtggccagctggttcagccggccgctctcgacgcggccttcggcatcgcggctccgcgtgcccgaaaaggcggtgggaatgagcggggtggcaagggcgccggagctgctgatcgacatctgaccggtcctcacatcacttcgatttcggcctggagggcgcctgcagccttgatcgcctgcaggatcgagatcatgtcgcgcgggctgatgccgagcatgttcagcccgtcgaccagttcctgcagcgtgacccccttgggcagcaccgccagtttgcgatcctcgccctggtcgacctggatattggtgcgcggcaccaccgcggtctggccctgggagaaggggccgggctgcgagacctgcggggtctcggtgatccggatggtcaggttgccctgggcgatggcgacggtgtcgatccggacgttctcgcccatcacgatgatgccgctgttctcgtcgatcaccactttggcgacctggtcgggctggacacgcagctgttcgatctgggtcatcagcccggcgacgtcgccctgccactgcgccggcacctggacccgcacgctggcgggatcggtcgccttggcgatggcgccgcccatataggcattcacggcagaggcgatgcgctgggcggtggtgaaatcggggttgcggagcgcgatggtgacctgttcgagcgagtcgaaggcgaaggtcacctcgcgctcgacgatggcaccactggcgatccgacccaccgtcggcacgccctgggtaatcgaggcgccctggccctgggccgagaagccgccgacggcgacctggccctgggcgacgctgtagatctcgccatcggcacccagcagcggggtgaccagcaaggtgccgcccaggagcgattccgcatcgccgatcgccgagacccgcacgtcgacccggctgccctggcgggcgaagggcggcaggttggcggtgaccatcaccgccgccacattgtcggtgcgcaggcgtgatccgcggctgttgacgcccagacgctccagcatggccaccaggctctgctcggtgaagggggcgttgttcaggctgtcgcccgtgccgttcaggcccacgaccaggccgtagccgaccagcaggttgtcgcgcacgccttcgatatcggcgatgtccttgatccgcgactgggccagtgccccgcccggcagggcgatggtcgccacggcgaccagcgacgccgcgaacacggcgcggatcgcgcggagtgcgcggcgcgggcggtcaggggtcagatggcgggacgcggacatgggcggatctgctccggttcggggggcttcgcttcggcagtgcagatgcgagaaccgtgccaggaccgaagcctttgccgtgtcgtggtttttatggtgcgacccgggcagggcgggcagaagcggccacgggggtcgcggcaagcgctgcatggtgcccggcagaaactgccgggttcccgctgcaacagcggggcggcggatggctgcttgccgccggggcttggcacccggcacatgcacgccgatatacagatgtgggtgccggttgttataaacgtcgtatgcagcccgcggtccccggtgggaccgcttcaggcagtggaggctgacgaggcaatgaaggtcacaggcgtcggtaccggcgcgcccgcatccaagagccgtcggacccagggtcgcagcggcagctccgacgatttcgcgagccgcgtcgacgacggaggtgagacccgctcgaccgcggcgcccgccaaggcggggccgctgaccgccatggacgccctgctggcattgcagggtgtgccgggccgcggcgaggatgccgatcgtgatgcggccgagcgcggcggtcagatgctcgacctgctggacgacatccgcctgggcctgctggacgggcgggtgccgaaggcggcgctcggccagctccgcagtctggtcgatgccgagcgcggcaaggtctccgatccccgtctggcagaggttctggccgagatcgacgttcgtgctgccgtcgagcttgcgaaactcgatcgtatcgggtaactacaggcccgaccggacgggccgccgtgttcccccgcgggccggccgccaaccggaacgcgagcgaccacctgcccgcggccgtatcgtgggtggatggcctctctgaggggagaccaggatggctgtcacgctgccgcccgactacttgccgtccgaagacgagccgttcatgaatgatcggcaggtcgagttcttccgtcgtcgccttctggcatggcgcgaggaaatcctccgggaatcttcggaaacgctgcgcaacctgcaggaagacagcctgcaggagccggatattaccgaccgtgcctcggcagaggccgattggtcgatccatctgcgcacacgcgaccgtcagcgtaagctgatttccaagatcgatgccgcgctcaagcgcatcgaggatggttcctacggctattgtgaggaaacgagcgagccgatcagcctgaagcggctgatcgcacggccgatcgcgaccctcagcatcgatgcccaggaacgccacgagcgccgcgagcgcagctatcgcgacgactgaccgcggggctacgcaccagaggcggggcgcgtcaccgctccgcaaccatgaagatataaggggcgcaccgatgccgggaacatcggtgcgccccttattttttgcaggtggctggatttcttgcagatggctggggaaccaagcgagctgaagggtggtccggcgatgaatgtgatgccatagtcgtgtgacggttgcatgcggggaggggatggtcccgcagggcaggtgccgggaacacgtggggggcgtggctgccgatggacggtcgtgcatggccttgaccgggccgacgggggaatccgatccgacgatgtcgatggccgatccgacgatgtcgatggaccggcgtcgtcggcgtgagcgccgttggctgatcgtcgtcgcctcgctcggcgtcgtgttctcgatcttcgtctggtcgatcgcccgacatgaccggcttcaggccagccgacatgctttttccgagatcgcgacggccaccgcggccgcgatggcgctcgatatcgaccgccatatcggcgtggccgacgatcttgcggccctgttcgcctcgtccaacgaggtttcggccgacgagttcgagcgctatgtcgtctcggcccgcaggcgggcgccggcgatcagcgctctggcctggtatcgcggccagatcgtctcgcccttgcgggaggtaccgctggcgccgggggagatgctgcccaatgacgtggatctgatggcggcgcggctggagcggcaggtcctggtccaggcgcgggatgcgatcgggccagaggacgaaaccgggcagctgtcgagcggcccgcccgtggagccgtcggtcatgacgcggctggtggaacgggccctgttttctggcgcgacggcggtggaacccttcggccatccggatgcgagcgggccggtcaccgggctgctgttcgccattccggtccgcaccggcggcagggtcggcgggctggacgtggtgatcggcctgatcgacgccatgcggctggtcgacgatgtcggccggcgtaccgatgacctgacccgggccggcaagctcagcctgcggccgatcgagcgcctgccttcgggtgccgccgtgtcaccgagaatttatgaccgcatgccggaaggatccgacccctcggcctggacccgggtccgggccgtggaggtgggcgaccggctgttccggatcaagatcgcggccggcagcgacatacccggacgctggacgatcgaagtgccggcgctggccgtgctgctggccggctttgccgtgaccggcatggccgccgggctgctgcggcgcacccagcggcgcgctgcgatgctggaagacgcgcgggcgggtaatctggccaccctgcgtcagctggaggccgaaatcatggcccatgacgacaccgagcggcggctggtggaaacggtggagcgcctggcgatcagcgagcgccgcttccgcagcaccttcgatcatgcggccgtgggcatcgcccatctgagcccggccggcacgatcgagcgcagcaacagccgcttcgccaccattttcggcctgtcgacccagaccctgcgcgggcggcgggtggatgatttcgtccatcccgacgatcgcccggactggacggtcggggtcaccgccctgctttcggggcagacggatgtgctgtcgaccgactgccgggtgatccgcgccggcgaagcgatctggctgcgggtgacggcaagcctggtgcgcgacacgctcgcgggcggcgatgaccgcctcaatcatgtcatcatcgtggtcgacgacgtgaccgagcagaccgtgatgatgcgccggctgagcctgagcgagcgcagcctggcctcggcccagcgcgttgccggcctcggcatcgtggaatgggacccggcgacggatacggtgtggtggtcggccgaaacctaccggctgttcgatcgtccgcccgcttccggcccgctgcccttcgaacggctggcggactatgtcgtggccgaagacatggcgctgctcgaccgggcgctggcccatacggtcgaaacgggtgccgcgctgcgcatggatctgcgcatccgtcgtccgggggaagagccccgctggctgagggtggaaggcgccatggaggtggatggcggccggcgggtattgctggccgccctgctggacgcaaccgccgaccgggtcgccgcccagaccctgcgccgcgccaaggaacaggccgaggctgcgaacgaggccaagtcgatcttcctggccaatatgagccacgagctgcgcacgccgctgaatgcgatcatcggctttaccgaagccatgctcggcgggctgggcggcgcgccctcggagcggcatcgcggctatctgaccgatgtgctgtcggccggccggcatcttctcggggtgatcgagagcattctggatctgtcgaagatcgaggcgggcaaggcccggctggatgaaagtcatgccgatctgggcgctatcggccgcgaggcggtacggctgatcacgccgcaggcggagacgcgcggggtggaggtttctctcgacctgcccgatccggcgccggtggtgctggccgaccggctgaagctccgccagctggtgctgaacctgctgtcgaatgcggtgaagttcagcgacaccggcggcgccgtctcgctctcggtcgtgcggcgcaaggaaggcggcgtgatgctggaggtcgtggatgacggcatcgggatggaccccgagcagatcgccatcgccctgcaacctttcgagcagctggcggcggggcgcggccggggcggcggcacggggctcggcctgccgcttgcccgtgcgatcgccgaactgcatggcggccggctggagatattgagccggcagggggtcggtacgacggtgcgggtgaccctgcccgcggagcgcacgctcggactggacggtgcgccagagccgccggcgacggccgtaaaaaccatcggccccggagatgtctctccggggccgggtggccgtctgcattgatctgccgctcgggtcagaagggcagcaggatgtccatgacctgggtgccgtagcgcggctgctgcacgtccgagatctggccgcggccgccataggcgatgcgggcctcggcgatcttgtcgtgcgggatgctgttgtcgccggcaatgtcttccggccggactacgcccgccaccaggatctcgcggacctcgtaattcacccgcatctcctggcggccgttgatgaccagattgccgttgggcaggatctgggtcaccaccgcggcgatcgagatcgcgaccgcctcggtccgctgcacgccgccctggccgacattgctggtcgacgaacccagatcgaccaggctgcccggatcgatcggctcggccagcaccttgcccagctggttttcgacaccgaagaagccgtcgaggccgatcttttcgctgttggtgcgcgaccggttggtgcggttgttgatctgggcgcgatcgttgatcgtgaccttcacggtcaggatgtcgccgacctgcttggcgcgctgatcgtcgaagaaggcgcgggcgccggccttccacagcgagttgggcgcgcggctgtcggtgcgcaccggcggcatcggcatcgagaccggcttgtagccttccgtctgggtcgggttgtcgatcggcgacaggtcgggcgccttgccgatgtttgcaatgcgctcaccggcattgcaggcgccgagggcgagggccaggccgaggacggcgacatgggcgccaccgaagcggcggccggtccgggcaggggcagaggtgcggggggtgcgggccgtcgtcatgatgcggtcctcggatctcgggaagcctgggaaaggaaaaagctcgggcagatgcggcagtggtcagttgcgtgccaggctggggccggcatcgcccacttccaaagtgccgtcgggggcgacccggccgtagacggtgttgcggctgcgcgggttcagcacccggacggtctcgccttcgccgccattgtccagcgcctggccctgggcggtgagcaccagaccgccgcggcggaagatcatggtgaccatctcgcccttgcggatcagctgtggggtgccgacgtcgcgggccatcagcggccggccgggatagcccgggcggcgcagggcctggccgatcagctggttggggtcggtgacctgctggttggtcagccggcggcgttccacctcgatcaggtcgatatcgcccgcgccgatgatggcgccgcgcgccagccgttcccgcagcaccggaaccgagaccaccgcggtcgcgcgcccggcggccaccaccaccagcggcgccagcccctcgccctgatcgacctcgatccgggccgagaagcgctcgctgcgcgggtcgtagatgaaatccgccaggcgcggcatcacctcaagcccttcggccacgatgacctcgggggcgcggccggtatagtccagccggtattcgtctgccatgccggcaccgggcgcccggtcgagcgcatcggtgatcagcgcgtcgatctgctcccgcgggatgcgctggccccggcgggtgatggtcacttcttccgtgccggtcgacggctgccaggcaatttctgcccggcgggccatgccgtccagctggcgggcattgatggtcatgctctcgccgggggcgggggccggaaaggcgatcaggctgccggtctcgggcgccaggccgtcgaacagatcggccaggcggacctgggcgccgccgacatccgatgcggcacgcagaacgaccccggccatggccgggaccacggcaacgccggcaagcagcaggccaaggccggcggcgcggagatgacgggtgaggcgggcggtggggcgggtcatggcggccgggctccggtaacggaagaggcggaagaggaagggggcgatcagcgcagcttggtgacggtggagtacatctcgtccgaggcggtgatgaccttcgaattcatctcataggcccgctgggcggtgatcaggttggtgatttccttcaccgggtcgacgttcgagcgctcgatatagccctgcagcagggtgccgtagccggcggtaccgggcacggcattggcgggctcgcccgaagacggcgtctgggcgaagaggttattacccagtgcttccaggccgccctcgttcgggaagatggtcagttccagctggccgacattctgcggatccacctggccggccagcttcacctgcacctcgcccgtcgggttgatcgagatttcggtcgcctcggccgggatcacgatctgcggctgaacggtgaagccgtcggcggtgacgatcgcgccctggggcgacagctggaaagagccggcgcgggtataggcgtcgtcgccattgggcagcgccacccggaaatagccgtcaccctggatcgcgaggtcgagcgggttgtcggtgacctccagcgggccctgcaaggtgatgcggtagaccgaagcggtgcgcacgccgagaccgatctgcacgcccgacggcacgatcgtgcccacatccgacgaggcggagcccacgcggcgctggttctggtagagcagatcctggaattccgggcgccgcaccttgtagccggcggtgttcatgttcgcgatgttgttcgcgatcacgtcgacattggtctgctgggcgaccatgccggtggctgcgatgctgagcgatctcatctgcctggcctctctcttccgatcctgtacgtcctggggtcagccggctcaggcctgacggagaatgcgctcgacggcgcggcgctggttgtcgtgttcggtgtcgatgacgttctgggcggcctcgaaggcgcgcagcagcgtcatcatccgggtcatctccaccaccggctggacgttggagccttcgatcatgccctgcacgaccttgggctcgtcaatgtcctgcggctgcgagtcggtggcatagaggcccgactgggtcttgcgcagcaggtattcgctttcgaaattcaccacccggatctgcgccaccgggcccgcatccgttgcgaccgtgccgtcggtaccgaccctgatcggaccgtcgttcagcggcacggtgatggtaccgccgcccgccgccgtgaccgggtcgccggtcacgctcaccagccggccgtcgacatcggtcgagaacttgccgttgcgggtgtagcgggggccgaagggggtctcgacctggaaatagccgtcgccctcgatcatcacgtccagcggtgcgccggtctcgatcggccggccctgggccaggttgcggacgacggcgacgtcgcgggcgaaatgggtcttgggcgcatcggacgggtcgtggaggaagtcggtgaacatcatccgctcgccgcgataggccgtggtctccgcgttggcgatgttgttcgccaccagctccagctcgcgggccatcgtcatctgacgcgacagggcgacataactggtgttctgcatcggatcggcctcgaaacgctttgctgccggcatcccggcggggtcgctgaacctctatgcagatggcgtgccaaactcgtaacttattgaaagatatgaaatttgatgaatggatctgcggcaggaagccgactcggcccctgccgggcggcaggatctgcgggtcgaccgccggccggtccggaaaaaattgccggttcgtggtgcagcgcaagagcttgttaaccgtgttccgattagggtacggctgaacggtggagaggacggccgcacctgcggatcggactgcaccggggcttgcagctccgtcagaggcggacgatctcgtatatcagaggcacgtgcccggatctccgacgggacggacagaagcgggaagcttggaagatggctgacgaggcagtcggtatggacggcgagggcgaggggaagaagaagggcggcaaaaagctgatccttttcatcctgctcccccttctgctgatcggcggtggcggagccgctgccttcctgaccggcatgataggtggcggcggcgaggaagcggctcatgcggagggcgatgcggccgggcacggcgcagcggccgccgcaggcggcggccatggcgcggccccggccggccagcaggcccgcgatccgctgaccgcggtgtattacgatctccccgaaatgctggtgaacctgaacaccggcggcaaacgtgtgagtttcctcaagctgaaggtttccctcgaactccagaagcaggaagatacgcccctggtcgaaaaagtgctgccgcgcatcatcgacagcttccaggtctatctgcgcgagatgcgcgtcgaggatctgagcgggtctgccggcatctaccgcctccgcgaggagctgctcgaccgggtgaatgtggcggcccggcctgtcgtggtgaacgacgtgctgttccgcgagatgctcgtccagtaggcggcgggcggcggggccccggccacgccgcctctgccggaaggagaccaggtccatggccgatcccaacgacgaagacggcagccccgacgaagacgccatcgccgccgaatgggaagcgatgatggcggccgagggctccggcgagggcggcggcgatcagggcgatgtcgatgcgctcttcgccgaagagggcacgcgtgcgctcagccaggacgaaatcgacagcctgctgggcttcgaccagggggatgagggcgacgaggaacgttcgggcatccgggcgatcatcaacagctcgctggtctcctacgaacgtctgccgatgctggaggtcgtgttcgaccgcctgcaacggcagatgaccacctcgatgcgtaacttcacctcggacaatgtcgaagtctcgctcgacagcacctcgtcgatccgcttcggcgactatctgaattcgatcccgctgccagcgatgatcgcggtgttcaaggccgaggaatgggacaattacggcctggtcaccgtcgacagctcgctgatctattcgatcgtcgacgtgctgttgggtggccggcgcggcaccacgatcatgcggatcgagggccgaccctatacgaccatcgagcgcaacctggtcgaacagatgatccgggtggtgctgaacgacctgtccgcggccttcgatccgttgagcccggtgaacatgaagttcgagcggctggagaccaacccccgcttcgcgaccatcgcccgcggcgccaatgccgcgatcgtggcacggttccgggtggatatggaggatcgcggcgggcgactggagatcctgataccctatgcgaccctggagccggtgcgcgagctgctgcttcagatgttcatgggcgagaagttcggtcgcgatacgatctgggagactcatctcgctcaggagctgtggtatacgaacgtgaccgtcgaggctctgctcgacgaacagaccctgaccctgggcgaggtgatgaggttcaaggtggggaccaccctgaagctgaatgcacggccgaattccgatgtgctggtgcgctgcggcagtgtgccgctggcgcgcggccgtctggggcgggttatggataacatcgcggtccagctcaaggacagcgtgcgcaagtcgaagatgacacgatgagcttcagcctgggcatgattctcgacgtgacgctggtggtgctgctcggtgccaccatcggctattgcgtcgccctgcaccggcgcctgggggagctgcgtgccgcccagagcgagctgcccaagctgatcgacaatttcatcgaagccacccgtcgggcggaggccggcatcgccgggctgaaggcggcgagcgccgccaccgccgacgagatcgggcccaagctcggcgaggcgcaggtgctgcgtgaggatctggccttcatgatcgaccatggcggcaagctggccgaccggctggaagccgctgtccgggtggcgcgggtggaagcccagagccgtgctgccgcccccctggcggccgcacggcccgagtctgccgagcggggcgggcctgccgagcggagcgggccggcgcggcgcaacggcgccgccgagcccctggcccatgatttcgacgacgaggacgacgaccggccgttgcgcgcggagcggccggcgacggcaccggaacccgcacagccgcgcgcccagcgcagtcgcgccgaaaccacggccgcgatcctgcgcatgctgaaggggggtgactgatggcctctctgatccgcaggcggcggacgacggcgcctgcaccacacgccgctgccgcgaacccgaggccgagtgttgccgccgtgcagcgccgctcgggcccgctgggcctgcgtttgctgccggcgacgatcttcgtggcggcattgatgctgtcggtgcgcgtggtcgacattttcgacggccgggatccggcggtggagatcggtgtcggcggcgcgcccgccgaggcccaggccgtgccgccgaccccgcccgagggcaagcccggcaccgaggggggcgctgccccggctgaggccgcgccggcccagcctgccgcgaccgagcctgcaccggcacccgaccgtccgatcgcgaccgatgccttccgcacccccgacgtcccgtcggggagcgaggggtccgagccgatcgacgtgagcaagctgacccgcggcgaggtggccgtgctgcagcgcctgtccgaacgtcgccgcgagcttgacgaacgtcagtcccgggtcgacgagcgcgagcggctgctggcggcgatggagacccgcatcgacgacaagatcgcccagctccgttccatccagaccgagatcgagtccctgctcggcaaggtcagcgaggcacaggagagcgaatatcagcgcctggtccgcatctacgaggcgatggagcccgaagatgccgcccggatcttccagggcctggacctgccggtgctgatgcaggtgatggaacgtatgaaagagcgccgcaccgcgccgatcctggcccagatggacccggtccgcgcacgtgaggtgacgacggaactcgccgagcggcgcaagctgccgcccggcgcggaaggtgcagtggagggcgggacgctcgcaaccccggctgctcccggaaacggcaactgaagaacgaacggagttggaccctaatgagtgtcgacctcaacatgccgatcctgatcgtcgacgattacaagacgatgctgcggatcatccgtaacttgctgaagcagctcgacttcgtgaacgtcgacgaggcgaccgacggcggcatggccctgcgcaagctgcgcgaaaagaagtatgggctggtcatctccgactggaacatggagccgatgaccggtctccagctgctcaaggaagtgcgcaaggacgtgaagctgaaggacacccccttcatcatgatcacggccgaaagcaagaccgagaacgtgctggcggccaaggaagccggcgtgaacaactacatcgtgaagccgttcaacgccgagacgctcaagtcgaagcttgttgcggtcctcgggccgttctgatttcaggcgggttccggtcctttcgcaggctcatcgggagcaccgtgctatgaacgtcaaaggcaatctgcgtgccgacctgcagcagcgtatcgatacgctgcgtgccgaacgcggcgagaacgtgcagctctcggaagtgaccgaagtggtcgaggcgctgctcggcacgatggatggcgacatcaccgcccaggagctgcagctctatggcgaactgaacgaactcgcgacctacatccagcgcgccaagctcgaaatcgccgagctgagcccgcatgagatccggaccgatcacattccgtcggccaccgacgagctggatgccatcgtgggtgcgaccgaggttgcgaccagcaacatcctggatgcagtcgagaccatcgagaacgtgctggatggcctggaaggcgaggcggccgaccggatgcgcgatcaggtgacccgcatctacgaggcctgcaacttccaggacgtgaccggtcagcgcatcggtaaggtcgtcaagacgctgaagtatatcgagatcaagatcgacgccatgatctcggtcttcggcgatatgggcgaggcggagaaggccccggccgacccgtcgcacaagacctggaaggacgtggtctcgcgcgtcgacgacgatcagaccctggaagggccggcgtcgaacgacgatgcgatccgccaggaagacatcgacgcgctgttcgattgagaccagaggctcagatgctgcgatcggcgggaagctgagggagacggggaatggaggatgaggcgccacgccccaagcggcggcacgccgacggcaacgtggccctgtatctggggctctacctcattctcctgtccttcttcatcatgctgaacgtgatctccaaggtcagcgaagagaaggttcagtcgacggtcgacagcctgcagtcgaccttcgcctcttcgaccgccaccgatggccggctcgaccggatcgcgatcctctatggcccgggcaatatctcggaagccttccgcacagccctgttcgaactgctgcaagcggcgatcccgcgcgcccgggtgcaggccttcgacaatggcaatgtgctgcaggtgcgcgtgccgatggacgaggtcttcaccgagggggagccccgggtgcggccgcgggtttcggacctgctcgaccgggtgagcgatctgctctccacccgcgggcccgaggtgcgcgaagtgacctttggcctgccccgcggcccgggcggtgatgtcgaccggcaatccctgctccgcgccggggtgctggcccgcaccgccgtcgccttcggcatgcccgaacggatcctggcaaccggtgtcggcgaccacagggaccccgaactggtgatcgagttccgggcaggctctccgccgcagatcgacaccgaaggtgcgggaggcgcgcgatgagcggtgtcgacgatcagacaggtgccgaggacggtccggtccatggtgagcccgccaaggccgactggatgtacacgttcgccgatctggtctcgctgctgctcaccttcttcgtgatgctgttcgccatgtcctcccttcaggacgaccgtttccaggagatcgcaagctcgctcggcgcgcggctgaacctgacccaggcggtgccggccccccggccctcggcctcggtcgacatgccgagcgtgctgatcccgcgggcggtggatctggattatctgcgccggatcatgaccaccaagctggcccagctgcccatggcggaacggatcccggatctggaactgcggcgtgagaacggccgggtggtgctgtccctgccggccgacagcctgtttccgcctggcagcgccgatctggtgccgggggcgcgccgggtgctgttcctgctgggtgaaagcctgtcggttttcgccaaccgggtgagtgtcgagggccacaccgatccgatccagatccagaacgaccgctatccgtccaactgggaactgtcgatcgatcgtgccgcttcggtcgcacgggccttgcgccagagcgggtacacgaagacgatagcggtctatggtcacgggtcttcgcggttcgacgatgtcgatatccgcctgcccagggccgaacgctatgcgaagagccggcgggtcgacgtgctgatcgacgaaccggaagcggagggcttcggatcgtgagggatctgaagggagggtgtgggcccgtaacgcggctgacggtcgcgctggcggtggcggcggggttgtgcctgccgtcgatgcctccccgtgccttcgcccagcaggcgcctgccgccgccgcggcccggccggatggggcggccgcgcaaaccctgccgtccatccgcgtgcgcaccggcctgcatcccacgttcggccgcatcgtcttcgactggaccggccgtgtcggctatgaagtgaaggtcgagggcaatgccctcaccattgtctttcaggaaccggtgacgatcgacgtcaccgatgtgccggtgcgccttggccgctatgtcgcagcggccgcggttgagaccggcaatggtcgcactgcggcgggttttaccgtcaaggccgatgcccgcatccgccatttttatgtcggcaatcgcgtggtgatcgacatctacgaacccgccgatgccgcggcacgtgccgccgggcgggagccgatcgccgacatcgcgaccctggtaggcgagagcccggccccagcgacgccgacaccaccgacgccggcgcctgccatgcccgacgggccggtgccgccggttcagatccagacggcgccgggtgcgacgccgggcggtgccgggacctcgggaaccacgccggcggcgcccgctgcccccagccctgcgacgcctgcccctgccggtggcctgccgggcctgctgcccggttttcaggccggctccggcagcaccgaggcctcgggtgtcacgatcatcaccacgcccgccgatcgcggtgtggtgatcgatttcgactggggcggcaatgccccggccgcggtggtgttcgaagcttatgatgccatctggatcgccttcgaccggccggccaatgtcgtcaccgaaagcctgaccgggccgtcggcggggcagatcgaacgggtgctggtggtcgacaatcccgaccgggcgctggtgctccggctcgacacccggccggggctccggccgcacgtccgccgcgacgaggggatctggcgggtgcggctgctggaagacgcccccttgcccaaccagccgctgacggtggccggcggcacgaccggcgggctggtggtggatggcagcgacggtgcagcaccgctcaacgtcaccgaccccgtctcgggcatccacatgattctggtgccgatccgcgcgtcgtcgcgcggggtggtaccggcccggaaattcgtgcccttcgagctgctggaaacggcgcagggcgtcgcgatacggccgcggccggataccctgccggtcgccagccgccgcgacggtgtggagatcggcggtggtggcggcctgccgatttcggccgaggcactggcgccggccgccttgccgccggctccggcggccccggtgcaggaggccgataccgaggcggcccggctgatgactgaaatggcgatcggcggccgcgatccgttcgatttcgcccgctgggtgcgcacccccgatctgatcaccgagacccgccaggccctgcagcaggcgatcgtgtcggtggcgccgccattgcgcaccggaccgcggctgacgctggcccgcttcctgctggccaacggcttcgcggccgaggcggcaggggtgatcgaaaccgcgatcgccctggagccgggcattgccgatcgggtggatgtggtggccctgaagggggcggcggcctatatgcaggggcattacgacgaggccgagaccgctttcaacgatccgcgcttcgaccaggatcccggctatgcgctgtggcgcgcggcggtggcggccgggcgggaacgccatcaacaggtgggcgagtatgcctcgggcggcgtgaaggtgccggccgatttccccgaagcactcagggtgcggatgctggtccagatcggacagtcggcgctgaccagcggccggctggaaatcggccgcgagatcctggacaatctgtcgtcgatgaacctgtcgccgtccgatcgggcgatgaccgactatctgtcggggctggccgacaaggcggccggcaatcccgaggcggccatccagcgctggcgcgccattgccgatcagggcatcgatcgcaaggtctcggttctggcccgtctggcgcagatccagactgaggtggagaccggcgcgatcaccgcatccgacggggcggccgcgatcgacaagctgcgcttcgactggcgcggcgacgagatcgagctgcacatgctgcagcttctgggcgagatgcacgagaaggccggcaactaccatgatgcgctcgccgcctggaaagaggccgtgacctattatcccgacgccccgcaatcggcggcgctggcgaagcgcatgagcgacaccttctcgtggctgttcgtcgatggcggcgcttcgaaactggcgccgctggatgcgctggccctgttctacgactatcgcgagctgaccccggtgggcgaacgcggcgacgagatgatccggatcatggccgacaagctggccgcggtcgatctgctcgacgaagcctcggaactgctccgccatcaggtcgccttccggctgagcggcgccgataagtcgcgggtgggcgcccggctggcgttgatccgcctgctggacaacgaccccgccggtgcacgccaggccctgcaggacagtgtcaccgccgacatgaccccggcgctggtcgaacagcgccagcggctggaggcacgggcgctggccgatctgggcgaatatcccggcgccttcgcggcgatccagggggatgacggtgccgaagcccgtcggctgcgggccgaattcaactgggcccaggagaaatggggcgatgcggccaccgcctatcgccatgtcatcgagccggtgctgaacagccccgaggctcgggtcgacgacgtcaccgcgcgcgaggcgctgaagaccgcggttgccgccgtgctggccggcaatgacgagttgcgccgcgagctgcgccagaagctgggccagcgcatggccggcaccaccgtcgccggcgccttccgtttcgtgaccgacccgatcgcacggccggaaagtgccgatttccgcgcggcgctctcgcaggtcggcagctatgagagtttcctggccgcctatcgtcagcaggtcgcgacccagcgcctcagcacgatcaactgatcggggcgcgtccccttgatcccggctgccgctttgcggttccgtctgccgcggcgaggctttaggatgcgcgcctccggtcccgggccgtctgccgccgggatcgcatgtcctgtccctgccggagcttcgtccgcatcttgtccgcgcccgccgatccgtcccgcaatcccgcctggccccggcctgagctgatgatcaccgagggctgggccgattacgccctgctcgacagcggttatggccgcaagctggagcgcgccggtcggatgaccgtcatccgtcccgagccccaggcaatgtggagcccggcgctcgacgaggcggcgtgggagcgggcggatgcgatgttcgatgccgaccggacatcggaagacgagggcggccgctggcgcttcgcccgcggcgacatgcccgagacctggccgatgacattcgaaggcgtgggcttcctcggccggttcacacccttccggcatctgggcttcttccccgagcaggcgacgcaatgggcctggatgctgccacgtatccgcgcgcgggtcgccgccggcggcccgccgccgcggctgctcaacctgttcggctataccggcgtcgcctcgctgctggccgcctctgccggggcagaggtcgtgcacgtcgacgcctcgaaaaaggcgatccatcaggcgcgcgagaaccaggcggctgccggtctcgatgatctgccgatccgttggctggtggaagatgcccgccgcttcctggcgcgcgaggtccgtcgcggcaacacctatgacggcattctgctcgatccgcccaaatacggccgcggccccaagggcgaggtctggaagctgttcgacgatctgccgccgatccttgccgatgtcgcggccgtgaccgcccccgatgccatgttcgtgatcctgaccgcctatgccacgcgcctcacctcggcggcgctggccgggttgatgaccgaaaccatgggccggctgcaggggcgggtgttctgcggcgagatcgccacggccgaactctcggccggccgggtgctgcccaccgcgctcttcgcccgctggatgtccgatacggcgctgatggccgagcccgccgcccttcgcggagcctgagacatgaccttcgaaatcgatgcgaggccggtgagcagcctgtccaatccggcggtgaagcggctggccgggctgcacctgaagaagaaccgcgaggcgaccggcctgttcctggtcgaagggttgcgggcggtgatcgaaggcgtggaactgggcttcacgctggaggaggtggtcttcgtcgaccggctgcgcgatctgccgcccgggcggcggctggcgaagctgatcgccggcaccggcgcccgtgcgttggaggtgacacccgaggttctggtcaagatcgcccggcgcgacaacccgcagaccgtgatcggcgccttccgccgccgggaattcaccctggccgacgtccggcccgaacccggtgcgctgtgggtggtgctggaagggatcaaggatcccggcaatctgggcacggtgctgcgcacgctggatgcagtgaaaggagccggggccatcctggtcggcgacacctgcgacccctggtcggtggaagcggttcgtgcaaccatgggttcgctgttcgtgaaccgcatcgtgcgtgccccgatggcggccttcctggactggcgccgcggctggaccggcacggtggtgggaaccgcgcttaccgcggcggtggattaccgcctggtcgactaccggccgccgctgctgctgatgatgggcaatgaacaatcgggcctgccgccccagatggtgggggcctgcgaccggacggtgaagattccgatgctgggtcgggccgacagcctcaaccttgcggtatccaccggcatcatgctttacgaggtcgtgcgctgccgccagccgctggcagaaagctgaccgggcaagcggaaggaccagcagatgaccgaggccgccaccagccgcgcctttgcggccctggccctgcctggggcgatcgatcttctgaccgctgccgccgaaggccggccgctcgggccctcggcggtgcgggatgccttgctggatgccgggctgctggtcggggcggaagacggcggcttcaggccggcgcgtgcggtgctgcttgacctcgccgatctgatcacgacgccgctgacggcggggcaggatcccggtttcgccattccacgaatgggttagcccagaaatcgaccgcggtgtcgcagctgcttgaccgcttgagacgaccggtcatattgttcgatcaatccttccgcccccggggtgactgccatgccgcgaaccaaggacagcgccgacattccgaaccgtctcctgaaggcggggcgcgatctgttctggcgcgacggctataacgccaccggcatcctgcagatcaccgagaccgcgggcgtgccaaagggctcgttctacaatcacttccccagcaaggaagcctttgcggtcgcggtgatcggccagtatggcgaccatctgcaacggtcctgggatgcgatggtcgccgccgccccgccgggggcgcaggccaccatcgcccatgtcttcaacgagatgatcgcctggcacgagcgcgcgcccgaccggcccggctgcctgatgggcaatctggcggccgagatcacgctgtcgagcgacttgtgtcgcgaggcgctgcagacggcgcatctggcctggcgcggccgtctggtcgggctgatccgcgaggggcaggacaagggggagctgcgccgcgatctgccggccgggctgctgtcggggctgatctgggatgcctgggaaggcgcgctgctgcgcatgaagctggaacgctcggcggagcccgtgcggcaaagcatgacattgctgctggggcagctgctctggccccatcatcaggccgacccgcatcgggccgcctgacgcatcacaacgacaagacggccataacgacaagacggccataaggacaagacgggaggaacgggatgacgcagcgcctgtcaggcagggccgcgctggtgaccggcggcggtgccgggatcggtcgtgccaccgcactcgcttttgcccgcgagggcgcgcgggtctgtgtcgccgatatcgatgccgccgccgccgcggcgacggcggacgagatcacggccggcggtggtgaggccttcgggctggcggccgatgtccgccatggcgatcaggtgagccggatggtggcggaggcggtggcacgcttcggccgactggacatcgccttcaacaatgccggcatagagatcgaaaccggcccgctggtgcgcagcgacgacgagatctatcagcacctgatggacgtgaacgtcaagggcgtgtggctgtgcatgaagcacgagcttgcgcatatgctggatcgtccgggcggcggggcgatcatcaacaccgcctcggtggccgggctggtcggcgcgccgggccgtgcgctctatgctgccagcaagcatgcggttctgggcatgaccaagagtgcggcggtggagaacggccgcaagggtatccgcatcaatgcggtctgccccggggtcattcgcaccgagatgatggcccgggcggtggagcgccggcccgatcacgagccgctgatggccgccatgcacccgatcggccgggtgggggaggcagaggagatcgccaatgcggtggtcttcctcgcctcggacgacgcggccttcgttctgggccatgccctgacggtcgatggcggcatgaccgtgatctgataaggatcagctgcggccgagccgcacccccgcggccgacagggcgatgccggccagcatcagaggggtgatcggctcacccagcagcagccaggccatgatggcggtggcagagggcaccaggaagaacagcccggccgcgcgggcagccgcaccacgccgcatcagcgcgcccaggatcgcgattgcggcgattgaattcaccagggccagccagaccaccgcgccggtcacctcgacggtccagaccatatggccggtttccagcagcagggcggcgggcaccaggaccagcccgccggccgccgtctgcaccatgccggccagcctgaggtcaagcccggcgcagaaccgcttctgccagagcgagccgaaggaaagaccggcgagccccgccgccaccagcagataggcgtggagcggtgcctggcccggatcccccaggcgctgccccaccaccagaccgacaccggccaccccgagcgccagccccgccagatgccgccgccccggccattcgcccagaaacggcccggcggccaccgtcaccaccaccggcatcagccccatgatcagcgccgccgtgcccgccggcacgccggccgccatgccgccatacagcccgccgaactgcaggccgtgcatcagcagtccggtgacggcggcatggaccagcagcatcggccgcgccggccgccggatgcgcaggacggcgacgatgccggccatgaccagggtggcaagggcgaagcggatcacgctcatggtcagcggctccagcccgcggagcgcgatcgcgccgccgatataaccggtgctccacaacagaacgaaaccgctcggcatcatccggtcggccagggggagggtgggggcctgggtatgcgatgcggtgcggatcatggcgcatcctcgggagggcggggcagggccgttcgtgcggcaccgcccgatggagaacacgcgcagtgtggttcccaaggtaagcgcttgtaaaatcgaatggcgtgatccatcctatcacgctccgttataggttttccctgcgacaggccgccggatgatccgccccgatctcgacatcaccctgctgcgctgttttctgacggtgctcgacgccggcggtttcgcccgcgcggccagcctgcttggccggacccagccggccgtcagccagcagatccggcggctggaagatctgctgggccaccggctgatccagcgcgcctcccccggacgcagccagccgccgcagccgacggcggccggggagcggctggccgaacaggcacggcggctgatcgcgctgcatgacgggctggtggccgacatgctggggctggaggagctgccggccacgctgaggctgggcgtgcaccagcatgccagcgacgagatcctgggacggctggttgcggaagtggcgcggctccgccccggcacgggccttgatctgcgcatcacccacaatgcccagctgaccgcagaaatcgcggcgggcgagttggatctggcgctgccgctggcgatcgcggtggatggcgctgcggaagccgggggtgggggcggcctgccgatcgcgatccactggcgtggggggccggagacgtcaggggcggcggccctgccgctgatcgcattccggccgccctgcattttccggcaggcggcaatcgtggcgctcggccgggctggacgccgctggcggcttgtgcacgaggcgactgatgcccgatccctggcagcagcgctctcggccggtctgggcgtcgccgccgtaccggatgtcggtcgctatgatgacattccgcatgcgcccgccgggctgggcctgccggctctgccgggcgccatgctgcgccctctggcggtaccggggttgggggcggatcttgtcgccacccttgcgggcctcgcggcgggaggctgagaccggcatcagcggcccgatcttcccctcagcgcagccgtacccctcgccacgcgcctgccgtgatctggcctccgacagcgagtgaactttcgtccagaagggccggaagggtctgggttgcgaaagcagcggcctgctgaaccgtgtctccttcggcaacacatccggcaactctggtcggctgaccactcgcttgctgccatacacagagtgtattgaatatgaacaaatagcttgcccgcgccagaatatcgcggctgatcttgtagggttgctgacacgcggcatgcgtcgtctgggccagttgccgcatatggcgccggcaggaaaaggcggcctgcatcagtatggtaccctgagcgtccgtcagcagcgcgatcgcattggtctgagcataatcgccgagaagacgaggtgtggcccaggccgtcatctcgagcgtaccgctgccatccggcacgggctgcagggatgccctgagcccgccttcgccatcaccgacgcgtgaaacgggtgtcgagagctcgacggggcccgctgcaacggcactttgtgcagcgaacagaggcaggcatatggtgagtgccttcatgaccgcagacacgcgcccgcggcatgtcgtcatcccgtggggctggttgttgccgtacatacccggaacctcccgacgtcccatgttcggaggatatcaggtctcgacgcataatgcagggccgatcggaaggtcgaggccctgttcaaggggtcaacccgcgaaactgcgcaccaggcttcccgcaatgagcgaccagccgtcgatcagaacaaagaaaatcaatttgaacggcaatgaaatcatcaccggcggcagcatcatcatgcccatggacatcagcagcgatgccaccagcatgtcgatgatcaggaagggcaggaagaccaggaagccgatctcgaaggcgcggcgcagctcgctgaccatgaaggccggcaccagcacctgaaggggaacgtcttctaccgatgccggttcgggatcgagcgccgccatatccacgaaggccgtcagctcgcgctcgccgacatgggcggtcatgaagtcgcggaagggcgcggaaatccggtcgaaggcttcctcttcggtgatgtcttcggccaccagcggcgccacgccctctgtccaggcgcgctcgaaagtgggcgtcatcacgaagccggtcaggaacatggcaaggccgatcagcaccgcattgggcggcgtctgttgcacgcccagcgcgctgcgcagaagcgacagcaccaccacgatccgggtgaaagacgtcaccgccaccagcagccccggtgccagcgacagcacggtgaccagggtgacgagctgaacgatccggccggtgaagccgcccggatcctcggcccccagatcgacggtgaccgactgggcaaaagccggatgactgccggccagggccgccagcaggaacaggatcagaactccggcaagctgtgcggtcttgtgccgcacgccctgcttcaccgatcgaactccggtgggatccgccgccccggctgaggcggaaaaccacgccgccgtccggttccgcgccggtcgacgcgcagcaccggctcgtcctcgtcatcgtcatccgcatagtcgcgcgcggcgacgggggcgcctgcggggcggaagccgggctcggtcccccgcatgggcgcgggtgcagcggccatgtcgggcgcctcgatggcccgctcgatcaccagatcaccgtcgccaccgatcagcagcagatgttccacatcgtcgcggcggatcagcaccagccgccgcttggggtcgatctggcggctttcgaccagggcgagccggcggccgcgggccggggcgccggcccgatcgccccagcggcggatcgccagggcgacaaggccgatcagcccggccacgagtgccagcccggcgatcatctggagaatgtcgttaaaggtcatgcaaacggtccgggagtacaggggaaggcgggggcaggggcgggaaggccggtacaggggcggaaaggccggggttgcggtgcctcgtcgcggtcagcgattgcctgtgcggccataggcggctgtggcgcgctggcgggcggagaacccgcccatctcgcgggcggtttcatcgaaaacctgccgcatctcgcgctccagaacgttcagcgcgtcgatcaagcccagcatgcgcgggcgtactgactggccgctgccgggcggcaggctcgccagttgctcgcagaaccgggtgacccgcacttccataccgtgcaggtccacggcatcgccgcgggccaacatctcgcgggcgacggaaatctcggcggcgatggcatccagcgccgccaccggatcctggatgtctccgaggccggttccgcgatcgtcgtcgccctgatcaggcgtcatcacccgtcttcctccgtcggtatccacgttcagcgtacacgtcgttcagcggtcgccgccgcccagactgccgttcaggcggtagagatgggccaggatctccgccaccgccgcaaaggcggccggcgggatcgggctttccggctccagcgcctcaaggatcgcggccaggtcggcatcccgccggacggggatccccgaggcgaaggccatggcgaggatcttttcggcaagggcgccgtggccggccgccagcactttgggcacgtcgtcgccggtggggtcgaagccaagggccaccgccacctggcgtggctgcttctgggtcatctcggatcatcccgtcgggctgacacagcccttcgtctggcagaccggggccgtcgtctggcaacagatttcatgatgatcccttccaggcccataagcaactcagagagccggtcaacccgctcagccggcctcgtcgggggcggggccgcgggtcacgaaggccggcacgtcttccggcgcgccggtctgcccggcttcgtccaggcccagcgccgcgcggttttccgcctggacccggtcataaacctcgcgcctgagtacggtcgcgtcggcggggaaggtgaggccgagccgcacggtcttgccgcgcacctcgatcacggtcacctcgatctcgtcgttgatcaccaccgcttcaccgaccttgcgggtcagatagagcatgctcgccccttccatgtccggggcccgttgccggcaggccttggccagccggatcggggcgccggttccgaaccgtcgatttccgcggtctcaccgccctctgcagccggcgcgcgcatctgtcgcgcgcgtccttctcttgatccgcgggcgccgcggttttacgtttccttaaggccgccggcatatcctgttgatcctgcggcgaccttcctgccacgatgcgggacaggcatccggaagcggatcctgctgccggccttgccggcccgcctcgcgcgcttcctgaagatatccgatcggaccgggcccgacgatggacataacgcgcataccgctgttctcttccctgaagaagcggatgggctggctgaccgaacgtcaggcggtgctggcccagaacatagcgaacgtcaacacgccgggctacaaggcacgcgacctgaagcccgtcgatttcggtgccatggccgaacgggcctcggggctgcggatgaccggcgcctcgacgggcggcggcagcagcatggcggccggcggagagctgcagatggccgcgacgaaaaccggccacatggcgccggccgtcgcggatggcggctaccgtgcggctgaagaccgcaagccgctcgaggtcacgatcgacgacaacaagatcaacattgaggatcaggcggtgaagcttgccggcaatgccagccagttcacgcttgcatccaccctctacaagaagcatatggacatgatccgcacggcgctgggtcgcggtggcggggcggggtgaggccatgacggatcatcccgctgacatcggccaggggaggcttgcctcatggacctgatgaagatcacgcggatctccgcggccggcatgcaggtgcagtcggaacgtctgcgggtggtggcggaaaatctcgccaatgccgacagcaccggaaccacgccgggctcggaaccctatcgccgtcggacgatcagtttcgccgaggggctgaacaaggaactgggcctgccgacggttcgggtgtcgcgctatggtgtcgatcagtcgccattcgatcgcgaatacgatcccggccatccggcggccgacgagaacggctatgtgttgcgccccaacgtcaacccggtggtcgagatggtcgacatgcgcgaggcccagcggggctatgaagccaatctcagcgtcatcgagaccacccgcacgatggtgcagcgcgcgctcgatctgctgcgctgacacctgacctgacacccggccccggccggtatcggcccagaacacggacggatcagacccatggatgccaagttcgcctcagccgccgccgcctacgccaatgccgcccgcggcatcaaggcgccgggcaccgagggcggtgaccgggccggtgcttccggcgccttcgccgacatggtgagtgacgtcatcggccagagcgtaaaggccggtcaggcgtcggaacggtcggcgatgcaggcggtttcgggcaccgccagccttcaggacgtggtgacctcggtggctgccgccgaaacctcgctgcagaccgtggtggcgatccgcgaccgggtgatcggtgcctatcaggaaatcatgcgcatgccgatctgagcgcggctttggcctgcgttccgttcctctctctcttccgcttcgtcttccccagttccggaccggccggccatgacgcccaacgaggcaatcgatatcgggcgcgaggcgctgtggacgatgctcaggctgggcgcgccggtcatgctggtcgcgctgaccgtgggccttgccatttcgctggtccaggcgctgacccagatccaggaaatgaccctgtccttcgtgccgaagatcatcgccatcgtcgtggcgctggtgatcttcctgccgttcatctggacaggcatggccgactacacccgcctgctctacgagcgcatcccggccatcggcgcggcgccatgacgcccggagggcctggggcatgaccgacctgctcggggtcgaggtcttctcggtcctgctggtgttcctgaggctcggcgccgccctgatgctgatgcccggcatcggtgagaccaatgtctcggcccgggcacggctgatcctggccctgctgctgtcggtggcactcgcgcccgtgatcgaggccgagctgcccgttacgcccgaccagccggcggagatcctccggctcgcttttctcgaagccgccgtcggcatcctgctcggcctgatgctgcggcttctggtggcggccctgcacacggcgggcgtggtcatctcgatgcagagcggtcttgcgaccgccatgatgtacgaccccacccagcaggcccagggcgccttgccgggcaatttcctgaccgcactgtcgctggtgctgatcttcaccagcggcatgcatctgatgatgctgggcgccgtgatccacagctaccagaccttcccggtgggcgagccgctgcccttcggcgatgcggccgagatgatggggcggctgctggaccaggccttcgtgctcgcgacccaggtcgcagcgcccctgctgctggtcggcacattgttccaggtggcgctcggcctgctggcgcggctgatgcccaccatccaggtgttcttcatcgccattccggttcagatgctgatcgggctgtccgtcatggcgatcaccctgtctgccgcgatgctggtctggctcgatcgggtcggccagcgtctcgacatgctcctgccctgaatccgggatcctgagccatgagcgagcagagcgaagacgacagccaaaaaaccgaagaccccacgccaaaaaagctcgaggacgcgcgcaagaagggtcagctgccgtccagccaggaaatcaatcactggctcatgctggttgcggtttcgatcgcgatcgtggcggtgcttcccggcatggtccgcgatgtcggtctgggcctgcgcgggttgatcgccagcgccgatacctttctgatggacccgagcgccgtcggccatctgctcagggcgctggccattcagatgctcacctggctggcgctgccggtgctggtgttcatcatcgccgcccttgcctcgggcttcgtgcagcgcggcggcaacgtctcggcagaatcgctgaagcccaaattcgaaaagatctcgctgatcgccgggctgaagcgccagttctcggccaaggcgctggtcgaattcgtgaaggggctgctgaagatcatggtggtcgccggcgtgtcgtggctggtggcccggccgcggctggaagatctggatctggtgccgcgcgaagcgccggcggcattgatggaacggctggccgacgatgccttcgtgatcgtcctggcggcggcctgcgtgatgaccgtgatcgccgcggccgactatgccttccagcgctacaccttcatgcagcagatgcggatgtcgcagcgcgaggtccgcgacgagatgaagcagagcgaaggcgacccgatcatcaaggcccgcctgcgccagatccgcatggaacgggcccgcaagcgcatgatggcggcggtgccgaccgccgatgtcgtggtcaccaacccgacccattacgccgtcgccctgaaatacgacccacccaagatgcatgcgccgatggttgtggcgatgggcgtggatgcggtcgccttccgcattcgcgatctggcgctgcagaacgatgtggccgtggtggagaatccgccgcttgcccgcgcactctgggatacggccgagatcgaccgggaaattccggtcgagcactatcaggccgtggccgaggtgatcggctatgtcttccgggccaaagggcggcgcgtgcgcggatgacccgtgctgtggcatgatgcccgaacggcatccggccggagaccaggacgggcgagcagggcggtatgagcatggaagcattgaagggcgcgacccaggcggtgatgcgcgatctggtgatcggcatcaccggcatcgcccttctggcgggcagtaccggggtcgaactgggcggcatgccggaaagcggcatgaccacgctggtcgatgtcgccggcctgatcctgatcatcttcgccggcgccggacttgcccgtacggcgatgctgcgggctgccgccatcgacacgccctccgcggtgaccgccgtgccggatcatgtgcctgaggtcgtgcccgaggcggaagagccgctgcgattgccgcagccgccgtcgcagctgcccgccagccatggcggtgggctcgatctggacatcgtgccgatcgagccggcggaagggcgcttccggcgcctgttcgatctggcaccgatcggcatcgccctggtcgacaatcgcggcggggtgctggcgtcgaatgccgcgctgatccgcctgaccggcgaggacgggctggagcccggatatgccttcaccgatctggtggtccatgaccggcggtttgccctgtccgacgccttcgatgcggtcttcggcggcgccgagcggatcaccgcgccgatcgaggtctcgtttcgccagcgccccgaccgggtcgcctctctgctgctccgccgggccgacgaagatcatctggctgcggccctcatccacgtcatcgacgtcaccgagcgcaaggagctggaggtccagttcgcgcagtcgcagaagatgcaggcggtgggccagctggcgggcggcgtcgcgcatgacttcaacaacctgctgacggcgatgatcggcttctgcgacctgctgttgatgcgccatccgccgggtgatgcgtcctttgccgacgtcatgcagatcaagcagaatgccaatcgcgcggccaatctcgtccgccagctgcttgccttctcgcgccagcagaccctgcagccgcgggtgctggacatcaccgatgtcctggccgagcttacccatctcctccgccggctgttgggcgaggcgatcatgctcgacgtccatcacggccgcgatctggcgccggtcagggtggatcaggggcagctggaacaggtgatcatcaatctggcggtcaatgcccgcgacgcgatgccgagtggcggacagctgtcgatcgcgacccgcaatttcgcgagcgaagacacgctggcgatggatcgcgactggatgatggccggcgggcgcgagcgggtgccgaccggcgattacgtgatggtcgagctgcgcgataccggctcgggcattccgcgcgacatcctgcccaagattttcgagccgttcttcaccaccaaggcggccgggcagggcaccgggctcggcctcgccaccgcctatggcatcatccgccagaccggcggcttcctgttcgtgcgcagcgagcccggccgcggcaccgccttccgcattctgctgccccgtcacaccgaggtggaaaccagcgggctcgaaatcgatctcgcccccgaagccgcgccgccgcgcaaatccgagatcgcaggttccggcggccgggtgctgttcgtggaagacgaggatccggtgcgtgcctttgccgcccgcgccctgcgtcagcggggctttacggtggaagaggccgaaagtgccgatgtggcggcggcccggctggacgaactggtcgaggccggcatcgacgtgctggtcaccgacgtcgtgatgccgggcatggatggcccggcactggccgagaaagtgcgcgagaaggtgccgggggtctcgatcgtcttcatctcgggctatgccgaagacaccttccgccgcaagctcggcgacgatccgaatgtccgcttcctgccgaagcccttcaacctgaagcagctggttcaaacggtgcgcgacgccatggacgaagcggcaggctgaccggtcctgaacggcgatggcccgccatgcctggggagggcagggcgggccatcgaccggtgaatgcgacgccggggcctggacggggccgcggggaggggacgggatgcgcggcgcatcgggccccggcgcctgctgacggcagggagcgacgtcacgtcgcgcgcgtgcgccgccaggtctcttcgaagccgttccaggcggtcaggaatttctccttacgatcctcgaactgtcgatcgggcgcggcctgaagccgctgataactctcggtaacctcctgccaggatctggtcaggtcggtgcgggcccggtcggcaccataatcgtcctgaagctgaagctcgcggacgcgcatcgacacctcggcgtcccagcgctggatttcggcactggcagcctgttcgaagcggatgcgttcctgggcatcgctcggcaggtcgcggctgagaggggcagactggccggcaagcggatcggtgtcgggtgtcgcttccagcgtctgcgagtcgatcgggtccggtcgatccatcacgtcctggccgaaggcgggtgtcatggtcgcgaccgcgccggcgcaggcgatcgcaagcgccatggcgagcaggctgtccatccgcttgatggtgctgtcggtcattacacgaccctccgtgacgaggtccggcctccggtgtgaggcgcggggtagccaaaactgttgcgtcggggcagttcgcggtccctcgaccggcaccgatcctctgctggcgccacggcgaaccacccctcgatccggatgatgcctgcagggcggggcgtgcggacacggacaaagctgtgacagaagcggggcggtaccctgtcacgctgtgacacggccatttttcacggccctgatcgtcctgctcgacgggaggcttgcaagccggaacaaaaagagtacatagtgattgcaggcggcggtgcttgcatcgggtgaccgcctgtggaacaagaggggcgtggccatggtgcccatggttcaaaccgaactgcgcctgacaggcaaggacgagatggacaagcagaaggcactcgaagccgcgctcggtcagatcgagcgcgcgttcggcaagggctcggtgatgaagctcggccagcaggaaaaggtcgatgtggatgtcgtgccgacgggctctctcgcccttgacatcgctctcggcgtgggcgggttcccccgcggccgcgtgatcgagatctacggcccggaaagttcgggcaagaccacgctcgcgctgcatgcgatcgccgaagcccagcgcggcggcggcacctgcgccttcgtcgatgccgagcacgcgctggacccgtcctatgcgcgcaagctgggcgtgaacatcgacgagctggtgatcagccagccggataccggcgaacaggcgctggaaatcgccgacacgctggtccgctcgggcgcgatcgacgtgctggtggtggacagcgtcgcggcgctgacgccgaaggcggagcttgagggcgagatgggcgacagccatgtcggcctgcaggcccggctgatgagccaggcgctgcgcaagctgaccggctcgatctcgcgctcgcgctgcgtggtgatcttcatcaaccagatccgcatgaagatcggtgtgatgtatggcagccccgaaaccaccgcgggcggcaatgcgctcaagttctacgcctcggtgcgcctcgacatccgccgcatcggcgcggtgaaggagcgtgacgaggtcgtcggcagccagacccgcgtcaaggtggtgaagaacaaggtcgcgccgcccttccggcaggtcgagttcgacatcatgtatggcgagggcgtgtcgaagaccggcgagctgatcgacatgggcgtcaagcagggcatcgtcgagaagtcgggctcctggtattcctatggcgaccagcgtatcggccaggggcgtgagaacgccaagaccttcctgcgcgacaaccccgaaatcgcccgcgaggtcgaaaaccgggtgcgcgaggcctatggcctgggtgccaacaagaccccgctctcggtggtcggcggcacggccttcatggcgtctgacgacgaggactgaaaccctctgggggacggcgtgatcaccacgggtggtcacgccctgaacgcccgcgtggacaatggcgggcggcacgggtaaaacgtccgaaccctgggagcggctgaacctgaatggccgggcctccgggtggggcggcgacgcatggggatcctgggatccttggggtcgccggcaccgcctgcggggctcgttgccgttaaggccgaaggggctgttgaagccaggggcgcagatggccggaaacaatccggcccggccccccgttccgtcgatcttcacctgcgtttgcaacacgggatgacgttttccaccatgaccagcgcgaccgagatccgccggaccttcctcgacttcttcgcgaagaacggccacgaggtggtcgcgtcgagcccgctggtcccgcagaacgacccgaccctgctgttcaccaacgccggcatggtccagttcaagaacgtgttcaccggcgccgagaagcggccctatgaccgggcggcgacctcgcagaaatgcgtgcgcgcgggcggcaagcacaacgatctggacaatgtcggctatactgcccggcaccacactttcttcgagatgctgggcaatttctcgttcggcgactatttcaaggaacaggcgatcgatctggcctggaacctggtcacgcgcgaattcggcctgcccaaggaccggctgctggtcaccgtctatcacaccgatgacgaggcggcgggctactggaagaagatcgccggcctgtccgacgaccggatcatccgcatcgcgaccagcgacaatttctgggcgatgggcgataccggcccctgcggcccctgctccgagatcttcttcgaccatggcgaagacatccccggcggccctcccggcagcccggacgaggatggcgaccgcttcatcgagatctggaacctggttttcatgcagtacgagcagatcgcgccgggcaaccggctcgacctgcccaagccgtcgatcgacaccggcatggggctggagcggattgcggccatcctgcagggccagcacgacaattacgacatcgacatcttccgccggctgatctcggcctcggccaccgccagcggtaccgaaccggacggcccgttcaagatgtcacaccgggtgatcgccgatcatctgcgctcgtcgggcttcctgatcgccgacggcgtgctgccgtcgaacgagggccgcggctatgtgctgcgccggatcatgcgccgtgccatgcgccatgcccataagatgggcgtggccgagccgctgatgtaccggctggtgccggcgctgatcgagaccatgggcgaccattatcacgagctgcgccgcgcccaggccctgatcaccgagacgctgaagctggaagagacccgcttccgtcagaccctcgaccgcggcatgcgcctgctggaagagaccacccagacgctgggtgccgacgagaagctgccgggcgaggtggccttccgcctttacgacacctatggcttcccgctcgacctgacccaggacgtgctgcgtgccgagggccgcggggtggataccgccggtttcgaaacctcgctcgcggaagcccgcgccaaggcccgtgcctcgtggtcgggctcgggcgaagccgccaccgaccgggtgtggttcgaggtgcgtgacgccgcgggcgccaccgaattcctgggctatggcgccacggcggccgacggcgtggtgcaggcggtgctggtcgacggcgccccggtcgatgccgcggaagccggcagccagatcgccctggtggtcaaccagacgcccttctatggtgagagcggcggccagatgggcgataccggccggatcaccggcgagggcgggcttgagatcgaggttaccgatacggcgaagaagctgggtgacctgatcatccatatgggccgtgtggttgcgggccgcgtggcgaagggtgccgcggtgcggcttaccgtcgataccgcccggcgcgatgccctgcgcgcccatcactcggcgacccatcttctgcatgcggcgctgcgtcgccggctgggcgatcacgtcacccagaagggctctttggtcgcgcccgaccggctgcgcttcgatttctcgcagccgaccccgatcgcgcgtgaggatctgaaggcgatcgaggccgacgtcaaccggctgatccgcgccaatggcgaggtcggcacccggctgatgacgcccgacgaggcgatcgcccagggcgccatggcgctgttcggcgagaagtacggcgacgaggtccgcgtggtcgacatgggcagcctgctcggcgaagacggccgcagttcggcctattcggtcgagctgtgcggcggtacgcatgtcacccgcaccggcgatatcggcctgttcaagatcgtctcggaaagcggcgtcgctgccggcgtccgccggatcgaggcggtggcgggcgatgcggcgctggcctatgtggagctgcagcaggaccgtctggccgaggcgtcctcggtgctgaaggcaccggcggccgaactggtcgaccgcattcagggcctgctcgacgagcgcaagaagctggaagccgaggtggcgaagctgcgccgcgacatcgcgaccggcggtgccggcggcggcgaacagatcgagcagatcggcgatgtccgcttcgccggccgcgtgctcgacggcgtgccggccaaggaactccgcggggttgccgatgcgctgaagaagcagatcggctcgggcgtgattgcgatcgtgggcgtccacgagggcaaggccggcgtcgtggtcggcgtcaccgaagacctgaccggccggttcagcgccgtggacctggttcgcgccgcggccgaggccatgggcggcaagggcggcggcggccgtcccgacctggcccaggccggcggccccgaggccgacaaggcggccgatgcggtgaaggcagtggcggcggcgctcgccggctgagcgtcattcggttccatcattcaccaggggggcggcaggtgatgacctgccgcccttctgcatccggcctcatcccttgctggtgtggttgccctcggccacccagatggtgttgccccagtcgctttcattgcgcacggcgctgaacagaccgctgttgccgtactggtcgtagatcgtgaaccgggtctcgtaataccagttgtcatagcccgagttgtagctgctgctgtgcagccgggtcaggcagacggcattgcggcgctggttgtagcggatattgatgccgatctgagaaatataggcggtgttttcaggcccgaactgccagatgtagtgccagttggggtgcttgtccttcgagatgatcgaccagttcgacggcccgctcggcgcaccgctgatgtcggagcggatgatgtagcagccctgttcggtgatggtgaagtaatagttgtcctggtcccaatccttgccgttcgccgtatcctcgcggtcgagacgggtgttgctcgaattgtaaaagatcggggtcagtgcgcgcagcgcgacgctgtatttgaagttgccggcaggggcgctgaaatgctggtcggcgttcagcgcgtaaccgccgtccggcagggtgatcttgctgccgatggtgatggcacgtgaccgcgcatcggtggcgcaggtgacgtaataggtcgtgacttcctggacgaactgggcgaagcgcgccactgcgttctgtccttcgggcagggtgtggaactggttgaccgaggtgccataggcccagcccgagggcagggactgggcagtggtatagtcgagcagggtgatgctggtgcgcgccagcacggccgggctcagcggcactacggtgctgttcacatcgatcggcgtgaagtagatccgcacaccgatctggttgaggccgttgccgtagatcgagccggaggtggcgccggtttcgaacacgatgcggaaatcggacaggccgctccaggcgtgctgccagtcggcattgttctcgccccaggccgggtagtagcggccctggctgctgccgtcgaactgggcgatcatgaagtcgccggcggcatagatgtggttgttgtcggcatcggacgggcggacgacgaagatgtcgcctttctgggcgtcattgccccagactttcgggttctcgtaggtaccagcggcggcttgtctctgcacggcgtccatctggcggtctccctttgacatgcgggtggggttgcggaggaggggtgattaccgatagccggtgtcgggcacgcgtcggcggatgctgcgcgggctgagcggcgggtcgccggtcggtgcaccgacggtgaatgtcagccggtccgcattggtctcggcgagcggaacgccccgggtggggacctgggttctgccgctgggcgaacttgccgtcacgttgtagaggcgcccctggttgtcggccgcgatgaatctgtcatgcagcggttgcgcgccgatctggttgtcctggcggaagcgctgaacgacgtcgaagcgttcgcgcatgcgctgctccgggttccagtcaccgatcgtcgtggtgacataacgggtggaggtgacatggtcgcgctgctgtcctgcagggcgggcgcggtcgttctcggccggggacagatgcgggtattcgctggtccgggccgttcccccgccctggacgtcggtaggcctgccattgtcgaaacccgtccggggcgattcgacgcccgaggttgcgcgtacggtctggcgaccttccgtagcggcttcccagggtctgcgggccgcccgggcctccgctgcccaggcgcgcgcagccctgggcgcgccacggccgcccagtccttcgcgctggatcgttgcgacacgttctgacagctccgaaaggctgttgctgacccggcggccgaccgtgctgccgagttttcccaggccctccatcgcacccggagcgccgaggcccatcgacacccagcccaggatggcggaggcctgcggtgccgcgtcctcaagggcaccactgacgatgccggtgatgtcggcggcaagacccagcccaccgatcacccccaccgccgaggcgccggcgctgatccccgcgatcacgccttccgccgcgatcaccggcgcagcagccagaccgaaggtggcgacggtggcgaggatccccacgatgccgagaccgataccgatccaggcgctgacgctcagatgccctgtcggatcggccaggttgatggggtcgcctgcgcaataggcgtagcgattgatgccgcccgggccgaaggggctccaggaatcaggcgtggtgaagcgcatcagggccggatcataggcccggtagccattgcccagatggatcatgccggtcgccggatcctgccgttcggcatcgaagccgttgggtacggcggtcgagatcggccggaagccatagggggtataggcgaagctgccgataccggcggcgagcagcacactccccttgccgtcggtgccgtagagcgtcgtggcggctccgcttccgtcgcggcgctgaccaagggcgaggcctgccaggctggggaagcgcagtgagccgccgctctcgatctgattggtgagcaggctgccgcgatagtggagctcctggccaccgccagtcgggccctgaaggatcagccggtcggtggcatcatagccatagtttgcggtcgcaccgccatcgaccgtgatcagccggccgagcgggtcatagcccagtcggcgtccggcggcatcgaggatcatccgtccggcgctgtcataggcgaggtcgatccgagccggatagccgggatgggtgtgggtgacccggaccagccgtgtgggatcggtcgtatcataggtgaagacggcggtgtcggtgccgtcggccagggtggtggtgcagcccagcacattgccgagcgcgtcataggtgagcgccagggccgagatggggcgccccgagacatcggtcggcggctggctgccggtgcagctgtagctcgtcaggcggttgcggctgtcatagccgaaactctcctgccggagcgtggcgccggcctgacgggtggtccggctctggatctggccgttcgcccgccagctctgcgagatcgagaggctggcggcgcccgagatttcccgactggtctccaggccgaaggcgtcgtagccgagggtggtggtgagcgtgcggccggtggtggggtcggtcgtggtccagctcgacgggcgcccgaaggcgtcgtagctgaggctggcggtcaggccgggatcggtgatgctcgtgttccggccaagcccgtcataggcgaagcgctgggtggtgccgccgacatcggtccagtgttgcagccggccctgcagcgagtgcagatatgaggtgctgcgggcgggcgcatcggtggccgtccgggtggtttcgcccttgagcaggcccgacgggtaataggcgatgtcgcggacggcgccgccggcctgggtggcgtcggtcagtaggatgcccgccggcgcataggcataggtctgaaccatgccgcccgcgctgacgcgcgtgcgggcgaagccgagggccggctcccaggcaaagctggcggtgacgccgtcggggcgggtttcgcttgcgggaaccggccggttgccgtcgtaggagaagctgctggtctggccgcccgtgacggccgtctgcttgcgtcccagaccgtcgaaggtctgggtgccgagagaggtgttgcctacccgcaccgcagtgatcagcgtgccgttggaatcgggtgcatagcttttggtgaccaccgtgccgtcgggcagggtggtggcggtcacacgatcccagtcgtcataggcataggcggttacctggccgagttcgtcggtgcgccggcgcaggcggccgatgccgtcataggtgcaggtgatggtggcctggagcctgccgtcggcggcgtagcgccgggtcgtcgtcggcaggcccataagattgcaggtggtgatctgccatccctgtcctgcgccgaccaggccggtctgcgtctgcagggtcaccggatcataggcgctgcgctcctgatgaccgtcgggcagggtgatgatgtcgttgccgccccagtcgtcatagccgaaacggctggtgcccgagacggtggtctggccgctgccgccatccggccgcagcgtgtcgagatcggtggcttccgtcacccggccccaggcgtcgtagcttcgcgacgcgatggtgatccagccctggagggtcccgtcggcatccgccatctcgcgccggacttcccggccaagcccgtcggtccagtagcgggtccggacgccgcgggtgtcggtgacggtggtcgccgaggtcttctgcgggccggtcagcaggtcgtaggcatagctctgcacggtttcgaagccggtaccggggctggccgtgctggtcaggatccggccgagcccgtcataggtgtagcgggtctccacaccccagggatcggtctcggagaccagtcgggcgccataggtggtctgtacgcgccggcgggtcaccgtgaagccgtcatgggtggtgatggtcgcggtctgaaccagatccccaccctggcgggtgaaggtgaaatcggtgcgccggtcataggagggcgggttgccgccggggacatggatggtctcggtcagccgcgacatccggccgaattcggccgatcccgtgtcggtgacataggcataggtggcactgtgaagcagccgcccgtcgcgggacagatcttcccgcgtcttcatcaccgcgcttgcgaccggcgtccccgccaccacgcccagctgaccatagatatagctggtcacttcgacaggggcgtcgtagccggtggtgggcggggtgacggtgcaggttttggggaaacggacgaagccgttcgggtcggcggggcatttgcccgcctcgccaccggccggataatagacccagctcgtggtggtgccgtccggcgtcacctgcagggtcatgttgcccgcgccgtcgaattcggtggtggtggtttcggtgcgtgacgactggccgccattgccggcataggtcacggtgctcgatcgcggcagctggaactgtgccggctgatccttgaactgggtgccgatccgcgcgtaatagacggtctcggtggtccgggcggccttgccctgactgacgacctctttggtcatcagatggaagttgttataggtccgctcgatggtcatcgtccggtcgccgcagaccgatatctcgcgggaccagtagctgtagctggtcaggacatcgtagagataatcagaatccgggctccagcgaccgccgctggccgaggcgcccaggtagttggttgaagaataagtgtaagtccgggcgatcgccggctgatttccctgcggatactgggtgtagctgtcgacccgcggcagggcgggcaggcccgcacccgaggggaaggcggcgccgctggccagataagtcacccgttcgatcagcccggtgggcgactgaagttcggtcagcatctgccggccgccgaccggattgtaggtcaggctccaggcgagggcagggttttgggcggtattctccacccggctcagatagttaccctggaaggagaggcggagcgtgtagcttccggcctgtcccggccagacggtgagcgtgctgaccgaggtgccgtaagtcgcctgaaacagaaccgtcgtctcgtccttcacctgggtcagccgccgggtggttcccgactgatcccaggtcagatcgaggcgccgtccggtcgggctgtagatccggccaggcaccttcacggcgaaggcgtcgttgcgcaacagttccacatcgccggatttgtgcgtgatccggtaatagccggcgtatggccccgtcgtgagcttttcgaagcgcaccgtgtcgagccggttctgctggagcgagacaccattggtcgtctcgttgaccttgaactggtcccctgtcgacaggatcagcaggcgttgcccactgtcgtagcgcgaaaggccgagcgaaaatccctggccgatgccgggtgccgccgcgcccagcgggtcatagcgcagcgcaagatcgatcgagggcccgagattggcgttcccgatcagtcgcgcgaccggcagggtcacgctgtaaagcccggttcgcggatccacgccgccctgcaatgcgctggggaagttgaaggcttgcgagtagaaatcggccatggggctcctcccgggccggcattcatgcgccggtcgcgttcgttcgggtaacaatggggtagtcacttattcgtagctttttatcaaaaataaaatcgcaaaggtagccaaatatgaattaaagaaaatatttctgaaaagataagaaatctatggtagataatgtgcccgcacggaccccccgcacggaccccatggggagccggcggtcagttccagtcgtcgggctctgccgtcgtgaccctgagcaggcggaagccggccttcagataggccccgaaggcgcggggatggtcggtggtgtcggtgtggagcacgacatgggccgcgccggcttcgaacgccgtgcgaagcgcatggtcgagcaggaagctgccccagccgcggccctgggcggcgggggccaggccgaaatgcacgatctcggcagccggggccgcgggcgtgccatgggcgaggtccagctccacgaaccccagaatcgtgccggcggcatcccgtgcgatcagcacccgccggcccgggcggtccaggatcgcctgcagcgcatcgcgtgtcaggctcaggcgccgcgaccagccatgggggccgcccacggcgcgataggcggcaagataggtttcgacatcgccatcggcctgcgtcaggtgcaggtggggcggttgcgggcggggcggctgcgggtggtctggaccggatggcggccggtccatgccgaaccagctgaagaccacccgactgccggtcatgccgccgcctcggccgccagttgatccagcgccgcgacggggtcggcatccagggtgatggcgaccagcgtcggttccccgggcagatcggcatcgtggccgagcggcatggccgggtagagccggtgctgcacgccatgcagggcggcgcccgggcggtcgccctcgggcggcagcaggcctttcagccgcagcagcgccggccccatccgggcggccaggcgctctgcggcgcggatcacccgcgcctgcgaggtgccggccggcagccgccgggtggcggtggcgatgcgggcatcggcggtgtggtggtggccgtgatgatgatcgtgcccgtggtcgtgatcgtgcccgtgatcatggtgatgatgcccattccccggaaccgaacaggcgccgtcggcacagatccggcgatcggcctccgcttcggcggcaagccaggcgcgggcgctgtcgccccgggcttcgggcgcatagggcaggggggcgatcagccggtcgggatcggccagcgccgcctctcgcgacaggatcagggcgcccggattcagcacctgcagccgtgcagtcagcgccgccgtggcggcggccccggcgagatccgccttggtgatcacgatccggtcggccagaaccgcctgacgcagagcctcttcatgggtgtcgagctgggcggcaccatgttcggcatcgacacaggcaacgatacccgccagcgcgaaccgcgccgcggtcagcggatgggcggcgagcgtgtggatgatcggcgccggatcggccaggccggtggtctcgatgatcacccggtccagccggtcgatctgcccgcggacatgatccagatgcagccgcatcagcgtgtcggtcagatcggatctgagggtgcagcagatgcagccggcatcgatcgccacctgccgttcgccggccatgcgcagcaattcatggtcgatcccggtctcgccgaattcgttcacgatcaaggcggtcgatggggcgatctcaggccgctgccggaagatgtcggcgatcaggctggtctttccggcaccgaggaagccggtgatcaccagcacgggaatgcggcgttcggtcatggtgcgcctcatcgggaagggggcaccagaataggcaggcccgcaaccgtcgtcgagacgtgaccgcttgggagaatggccgtgttttcagatggcggacggcgccgtagtgttggggccacggcccctggggctgcacgggttggagatgacgatgttcgacaggatagccgtcctcggggcggggacgatcgggatgagctgggcggcgctgttcgccgcgagcggccgcgaggtggtcgtctatgaccccgccccggatacggaagcgcgctgccgccggctggtggcggccagtgccgacgcgctgagcgcgctgggccagccccaggccggcgacgacagccggatgcgtttcaccaccgaccccgccgaggcggtggacggcgccggtttcgtgcaggaaagcgtgcccgagcgggtcgaggtcaagcacgcgctctatgcccggatcgcggatcggctggcgccgcaggcgatcatcggcagttccacctcggggcttaccctcggccagcttcaggccggatgtgcggtacccgggcggctgatcatcgcccatcccttcaacccgccgcatctgatcccactggtggaactgatgggcaacgacctgacagatgcagatgtgatcgacaccgccgacgccttctataccggcctcggtaaggtctgcgtgcggctgcacaaggaggtgcccgggcatatcgccaaccgccttcaggcggcgatctggcgcgaagccatccatctcgcagccgagggcgtcgcgagtgtcgaggatatcgacaaggccgtggcctatgggcccggcctgcgctgggcggcgatggggccggtcagcctgttccatctgggcggaggcccgggcggcatccgcgccttctgcgaccatctgggcggcgccttccagagctggtggcaggatctgggcacgccgatgatgacgcccgaggtggtcgacatgctggccgagggcgtggcggccggcggtgatgcccgcccgatcgaggagctggcggccgagcgcgaccggctgatcctggcctatctgctggcgcgggggagcaggacgacgccttcgtcctgaactggccccctgtcctgaatactggccctgaaaagacgacgggcgcggcaggaaaccctgccgcgcccgcgatcttcagccgtctgccttaacggcaggtcctcaggaagccatggccttcttgaggttctcgtcgatcttgtcgaggaaggcgttggtgttgagccacgcctgatccttgccgaccaggatcgccagatccttggtcatgtggccggcctcgacggtctcgacgcagacccgctccagggtctcggcgaagccgatcagggcgtcgttgccgtcgaacttgccgcgatagccgaggccccgggtccaggcgaagatcgaggcgatcgggttggtcgaggtctcgcggcccttctggtgctcgcggaaatgacgggtgacggtgccatgggcggcctcggcctccacggtctttccgtccggcgtcatcagcaccgaggtcatcagacccagcgagccgaagccctgggcgacggtgtcggactgcacgtcaccgtcatagttcttgcaggcccagacgaaaccgccgtcccacttcagggccgaggcgaccatgtcgtcgatcaggcgatgctcgtagacgatgccggcggccttgaactggtcggcgaactcggcgtcgaagacctcctggaacaggtccttgaagcggccgtcataggccttcaggatcgtgttcttggtcgacagatacaccggatagccgcgctgcaggccgtaattcatgcaggcgcgcgcgaagccgcggatcgactcgtccaggttgtacatcgccatggcgacgcccgagcccgggaacttgaacacctcgtactcgatcgcctcgccgccgtcttccggctggaagcgaacggtcagggtgcccttgcccggcaccttgaagtcggtggcgcgatactggtcgccaaaggcatgacggccgatcacgatcggctgggtccagcccggcaccaggcgcggcacgttgcggcagatgatcggctcgcggaagacggtgccacccaggatgttgcggatggtgccgttcggcgacttccacatctgcttcagcttgaactcctcgacgcgggcctcgtcgggggtgatggtcgcgcacttcacgccgacgccgtgcttggcgatcgcctcggcggcgtccaccgtcaccttgtcgttggtcgcgtcgcgatgctcgacgccgagatcgtagtagagaaggtcgacgtcgagatagggcaggatcagcttgtccttgatgaaccgccagatgatgcgggtcatctcgtcaccgtccagttcgacgacaggattggcgaccttgatcttggtcatgcggacgatctcctcggcgatgcgcggcaccccgggggcgccgttgcgaccggggcggctcccgggccgggacggtccggggcggcaaacgccggtcgcgatcggcgcgcaacatagcatcgtgcgcggccgttgcaaaccggccgcaaacagcttccgcagatacggaagattgcgcgtgcacggcaccggcttgacccggggcgcggttcggaccacggtcttcggcacagccgcttcaccaccggaaggccctctccgttgaccgacctgttcagccttgtcgagcacccgctggcggtgaccctgatctggccgttcgcactggggctgttgctgccgccggcgctgcgctggctggcgggcggcgtcaccggctggcggatcgcggtggtggcggtgccgctggggctgctggccgggctggtgctgatgctgggccggccggcgctgccgcccccgtccagcacccagaaactgccctatctgctgacggccgccgccgcagcggcggccatgctggggctgctcaaccccaggcccgcccggatcgccgccatccccgccgctcttctggtggtgggcggcggcacgctctggatggccggcgcccggctcggccggtacgaaaccatcgatctggtgctgctgctgggcgggctgggcctgggctttgccgccctgctcggccggttgagccagagggccgaagccgacggcgccgggcgtcagctgctggtgatcctggcggcgctgggcctgggtttcgtggcgatcaatggcggcagtgcctcggtggggcaggcggggttcatggccgccgccgccggggcgggcttcctgccctggctgcttctgcccgggcgtgccgcattcggtcaggccggtgtcattgccgccggcggttcgctggcgctgctggctgcccatctggttctgtcgcggccgagcggtctggtcgtagcctgcctcgccatcctgctgctggtgcccttcgccgacggacccgcggcgcaactgtccaaacgtctcggcatcggccaggggcggttcggaaagccggtccggctggtggtgctggggctggtcgcggtcgtgccggcggcgattgcggtggcaatcgccatcctggtgggggcgggcctgccgtcctgagcggtcgggggcctcagccggcgttgaagcattccgggatgacgtttaatgttcctgcggacgggaatgcgtgaccacgcacgacgtgtggtccgcaaggggaggcgcaggtgacgtcacggaatatcgccatcatcgcggttgtggccgcgatcatcgccgccatcgccggatggctgatctggggtggggacgcgcaggacaaggccgtggccaccgcaccggtgccggcggtcccggcacccgccgcgccggcggcgacaccggcccctgcagcttcagcgccgcaggccctggcgcctcagaccgcagcgcctgaggctgcggcgtctcaggccgcggctccgcaggcatccgcgccccagacggcagcgccagagacggcgacctccgcgccggcacctgcgccggtcgccgaggccaccggccgtgacgtgctggtgaagccctccacgcctgaacccgttgcaccggcgaccgcgcccggggccgtcgccgaaccggcagcgcccagtttcgacatcgtgcgggtcaatccgcgcggcgacaccgtggtcgccggccgcgccgagcccaatgccgaggtggtgctgcgcgacggcggcaccgaaatcggccgcgcccgggccgacgagcggggcgaatgggtgatcctgcccgaaaaaccgctcaaccgcggcaatcgcgaactcgatctggaagcgaccctgcccgggggcgcgaaggtgaaatcgaaggatgtcgtggtgctggccgtgcccgacacggccccccaggcctcggcggcggcgggggatgcgacgccccagccggatcagccgatggcggtgctgatgccgcgcgacggcgacggcaccggccgcctgcttcagcgcagcgacccgaccggcgtgtcggaaggtccgctcagcctggaagtgatcgattacgacgatcagggccgggtcagcctgtcggggcgggccagggccggcaaggaagtgcggatctatctcgacaacgacctgatcgccaccgcccggcccgaccccgatcgcggcggcatctgggttgtgacgcccgaaggccggatcccggaaggcaaggcgaccctgcgggtggatctggtcgacgagggtggcaaggtgctggcgcggctggagaccccgttctcgcgcgcggcctcgccgatgatgctgcccgagggccagacctatgtcgtcatccagcccggcgactatttgtggcgcatcgcccgcgccacctatggccagggcatccgctacaccaccattttcgaagccaatcgcgaccagatccgtaaccctgacctgatctatccgggccaggtcttcgtcctgcccgggcatgacggctgatcagccgccgatccgcccccggcgggccgagatccgggcggcggcgacaccggccaggctgatggtcgccgccgtcagcccgacggccacgaagccatgggcggccatcaccagccccagaaccgcagtgccggtgctgatgcccagataggtgacggcgctcatcagcgccatcaccagcccgcgggcagtgccggcacgttcggtggccagcgtgttgagcgcggtgaccaccgtgccctgggccaggccccagaggatcagcgtcgcctcgaaggcgaccggccggcccaggctctgcgacatggcgaccatgtcgacggccagaaacgccagcgccacggtgagggcgcgatccttgccgacgcggtcgaccagccgggcgttgagcgtggagcccgccaggcccacaccataccagagcacgatggcgccggctgcggcggcaccgctgccctcaaggttgcgcagggccgtgccgatataggcatagatgccgtaaaacgacaccatattggcgaggttggttgcgagcagcgccgccacccccggccgggtgaccgcatggcgcagccgggccagaaaactcgccgcatcgtgaccgctgcccgcggcggggccggcggcatcgcgcgcgggcggctgcggcaggcgcagcacggcaaccgccagaaccaggataatcagcgccgccgcggtcagcgtgccgcgccagcccagatgttcggcggcgatgccggccaggggcacgccggtgaccatggtgatcgcccagccgaacatcacccggcccatcacccggccgcgggcggcgaagggcaccatgtcgccgacataggcatagatggtcggcaacaccgcaccgcaggccaggccagagagcatgcgcgcggccagcagcatgccgaaactctgcgcggtggcggcgacgatgccggcgatggtggcgatgaccatgccggccgcgatcagccgccgccggggcagatgcccggcgaacaagccgaagagcggtgccgagaccgccaccgccagcccataggcgctgatcgcgaaggcggcatcggtggcggccatgtcgaaatcgcgggcgatatcgatcagcagcggcgcgaccgcaaaggcctcggtgccgatcccggccaccgccgcgatcagcgccgccaccgcccagccgggcaggccggccggcatgtcggccgcaagggcgggggagggcgatggcgggcaggaactggacatcgggggcaccacgcatccgggggagggatcgcggcgcagaatagccgaacgcgcgttcggtggaaggggctctgttgaatgtcgtcatgttgttcgctaacattgggtccgtgcctcgattcgatgtatattttcaataaatcgtggaggaaccatgtacaccgtcaaaacgatttccgtttctggtttcatggattctaatcgtgagataaagatagatttatctccagatgctaattttattattggaagaaacggaactggaaaaacgacatttattaatttgataaatgctgcgctttccgccgatggacaagcgttgcttgatttgaaattttcgaagataacgttcttactttaaaaaaaacaatctagaattgtgcctcagatgacagtagaaaaatcgaatgattcagatggatttaagcaaataacctatatttttaaaaatggtagtaaggcaaatccggagaaaatgatccttctttctgaaatgagacggcggatagttatgatcaatagacaaagaaagacagatttttcacgggacaattacaccgaaattaaaagaaatttggataaacttttcaaaaaaacatggctttctctgcagagaggggctgattcgtttgaaagagatgaatttgactatgatgaaatcacatatacctcaggtgtagataagaaaatctcggaagtatcaaatgaactcactcgatatttctctaggttggataaaaaagtatcagatctgacgcttagttttcaaagaggctggcttatttccttttttgccactgagaagagcgtcggtacgatcctgcgaggtgatatcaatattgatgaagataaaaaggctattgaacagatattttccaaatttcaatttccacgagatagctatgcaagtcagcttgagcgtcatggaaagcttgctgagcgggtttttaaaggctttagggagaaagaaaaaattgaattcaaggattttttaattatgtatgacgtcatgaagttgcatgctcttgtcgagcagtggcaagatctgcaagataagcaaactgaaatttatagacctaagtataatctcgtcgaaattgcatcagaaatgctttttcagaagcgtttggatgttgattctagtaatacaattagagtaaaatctcataaagatgaggttatatctctaataaacatgtcatctggtgaaaagcagttaattattttcttggtggaaactcttttgcaagagcaggaaacatatatattccttgctgacgaaccagagctctctttgcatattgagtggcaagagcaacttgtcccaagtttacttagaattaatccgaatgcgcaggtgatatttgctactcactctcctgatgttgtagggaggtttcagaataatataataaatatggaggaattgattggatgacctttgaaagaacgaaatctgggcaggaaaatagagcactctttctaggagtggatattgtttgttatgtggaaggggagcatggtagcgcacgcttttctgaagacagctatttctggagtaaagttttttctgcttgtacaccggaactgagaataaaattcgagccgaggggaggaaagccaattctggagaatttggctaaaaatattatttccgaaaatattgcgaacacgatagttgcaatggatgctgattacgatcagattttaaaccaaaaaattgaagatcatagaattttttatacgtatggatatagttgggaaaatgatgtgtataatatcgaaaatatgatttccgcgataaaagcaatactttatatgacgaatgaaattcccgaagatgcattatcaaatataagaaaaatgcatgaagatataatgagaaggatgaaatggcctgtgagggcggattttctagcgatccaatccaagtcatctctattgcccagagataagccgggaaaaataatagaagaaaacagaggagaaataaaaataaaattaaacgaaatactgaataattgcaaatcaattaaagaaaaaagaaatagatgtcgcaattctattgtaggactccgtgatatacgcagatattgtgtagggcatatctatgcttacatatgtattcaaattataaaaatatttattaaagcaattaagcacaaaaattcttcaaatagtacacatatacaatccatatctattattgaatttgaaaaatttttggcgaggaataaagatgaaataagtcattattataaagatatgtgcagggaatacgaaaatatgagggaactctcgaaaaatatcattcgaaattaaaattgaatgatcgagatgaaatgtaatatagaaaatttcttaagacatatggcagtttgtaccgagatggtcattacctgagagccgccccctctgacgaggtgatcaggtgcggtgttgggtgccgacgaagaaggtgtcgacggccacaagggcacctgccgctcccggaatccgggcggaagcgttccagcaggcggatttgctcgtctaacgggggtagcttgcgttctgccatcctctttctcgagcaaattacccagcatagaaatcaggggattcccctcagccgtcagttgtgattcaagatagaggctggagaaggaggccagcctgtatggcgaaagctctttccgtcgacctgcgccagagggtggtggttgcggttgcgtccgggatgtcgtgccgtgccgcggcggcgcgtttcggtgtgggtgtgtcgtcggcgacccgctgggttgctcgggcccgtacacgcggtgatctgaggccggacaagcgcgggggcgatgtccgctcccaccagatcgacgcccatcgcgctttcattctggatctgatcgaggcggagcctgatctgacgctggcaggggtggttgaccgtctctcggaggcgacgggctatcatccgcgccctagccctatgtgccggttcttcaagcgccacgccgtgacgcgcaagaaagacggcgcatgcagccgagcaggaccggccccaaagagctgcgcgtcgtgaggcctagttcgatggtcagacggattttgatccggaacagcttgtctttattgatggatgcggctcatcgaccaggatggcccggatgtatggccggagcgcgtagtgccgcgcgccggtgccgcatggtcaatggaaagcgacaaccttcgttggtggcctcgggctgtccgatatcaccgcgccgtgacgctggatggcgctatgggcggtgctgacctcctcgcctatgtggaacaggttgtgatcccggccctgcggcctgacgatatcgatcagcagcggcgccatcgcccagccgggcagaccggccggtatctcggccacacgggcagggcgatggcgggcaggagccggatatcggcggcaccacgcatcctggggacgcgcgcgttcagcccgaggtgacggtccggtcgagcagggtgacggtcagcgtgtcgacgctggccgggttcaggttcagctgcggtgccgagaaacgttcggcgaaggcgaagttataggcctgggaacaggggttcagggcggctgcccactggttccagtgattggtgatgccggtgggccacagtgccgcgaacagcaggcccttgccgggcagggtggagaaccagtcggaacttgccatgtcaccaacggcaatcgtgccgcccgagccctgaaccgtcaccgccgagccgatggcgccgatgttcagcccggcgaagaaatcgcccagcacccagccccagacgtcgttgcccggggtctgaagcgcgccaccattcagtgaaaaggcggggttcgcgccatagctcgcggccgggttcagcaggttccagcggtcgatggtgatggtcacgctggaaaactggccggtgctgcccgagagtgtgatggtgccggctgcatcgatcgacgcggtcaaatcgtaggtctgggcctcgtagatcgggccggtttccttgtcgttgccggcgaaattgcccttgatcagcgcgatggtgccgccgccgaggctggtgaagcccgggaccggcgccgtcgtcttcgggccgaaggtttcgatcagcgcatcgtaataggacaggaaggtgtcatagggcgtggccggcaggccgggcatggcgtcggtcgacgggctgccgaagggcggatagctgttggggccgatgatccggacgaaattgcccgagccgtcggtgaccacgcccgaagcggggttgagcagctgctgcgccacgccggccggcagggcattgccgtcggcggcgaaagccgcgatcaccgcttttgcggctggtgtcgactggaccggatcgctgagggccgccagcgacgtatagacatcggcggcggtggtgctgccggtcagccccgccaggctgccgaccgatgtcccctggagcgaggtgtccaggctcatcgggatgctccagaaatcgatcgccgtcaggtcggcacacccggtcggcgtcccgtcgaaggtcagctcgaacttgtcgaagatgttgtcattgccggtcaggaccgacgcattcggatcgatggtgcaggtggtggcactataggccacatagatccggccgctggtggtgtcttcgatggtgaagctggtgatcgaggacagcgcataccacgtctgggcggtcattgcggcgccattgatggtcgcgctcagagaactgccccagaagcccagatagacatccgtgtccggcgtgcccgaattgttggtgacggtgagggtgatggacgccatcctgccgatccttctgtcaaatatgttgcattttgcaatacatcggggtgaggcaggtgagacaggccgcgatcgagggcgagggcggtccaacggacaggtttccgatgtatcgagcactttcatcttattcgcggaactttaccgcaaacaagagagatgtgaccgatcggcaatacaatttatgcgggaggtttaatcggcagagcaggcgatcgccgccggctcatcgagcagggcgagcgccgtgtgcaccagcgccgtcagcagggtgggttcgggccgcacgcgtgagagggtgcgcagccccatcagcgtgccgagcagatgggctgcgaggtcctccgggggcaggcgccgggtcacgctgccatcggcctgaccggcggtgatccggtccagaaagaaggcctcgatccgcctgagcgcatcggcaaccacctcgcggaagccggcatcatgcggggccacttcaagcgaggcgttgatcagcatgcagcccttgtgatcgggatccgagatcgaccgttccagcggttcgtcgaagaaggcggcgaggccggcacgtggcggcatggcagaacagcgacggatccgctcggcgatgccgcattcgatgtactggtcgagcacgcggccatagagggcgcgcttgtcgccgaaggcattgtacaggctggcactggtgatgccggtatgctccaccagatcccgcaccgaggtcaattcatagccacgggcccagaaacaccgggtggccgcatccagaaccttcgcttcgtcgaattccctcgggcgggccatgtcgaacgttcgtcccctcgtctcgatccctgcgatcggcatcttgccaatcgttttctgacgtgcattataaaacaagcgtcctaaaacacaagacggcgctccgggaacaggacagatgggactggcgatgaccatgcagcagacggcccccagagggcgcgggatcgagggcttcgcctgggcggcgctggcggtctcgatcttctccggctggttcgtggtcacccgcctggcagttgtccagagcctggaggtctgggacatcaccgccctgcgcttcggcatcggtgccgtgctgctgctgccggccctgtttccacgcggtcggccactccccgcccgggcgtggaaggaagggctggtcttctccatgctctggggcgtgcccttcgtgctgctggtggcggcggggctgcagctgacgtccgcagcccaggcggcttccatcgcccccaccgccatgccgcttttcgcgggggtgttgggggccattttcctgggggaacgccatggccggctgcgctgggcgggctatgccgcgatcgttctgggccaggcggcgctgatcctgatcggcagcgccatccacggcctgcccgactccggcggtatcctggcgctgctgggggcagccgctctctgggcgatctataccctgcggtttcgcggcagtctggtcaccccgatccagtctgctgccctgatctgcttctggtcggcggtgctgttcctgccggtctatctcgccgccggtctttccaatctgggcagcgccccggccagcgaagtcgtcgtgcagggcctgtaccagggtgtgctgatgagcgccgtggcggtgatcaccttcaaccgtgccgtcggcctgctggggcctgccgcggcgaccggcatcatcgccctggtgcccgtggtcgcctcgaccttagccgttccggtgctgggcgaactgccggccccggccgaggccctggccatcctgctgatcgtcgccggcgtgctgctggtggcacgcccggtgcggcggccggcctgaccctgagttcctccccccaaaagttcctcccccgaaaacagagagggtagccctcgtgatccgcttctattatcacccgaccccgaacccggcgaaggtggcgctgctgctggaggaaaccggtctgccctatgaggtggtgccggtcgatacccgcaagggtgagcagcatgatccggccttcctggcggtcaatcccaacgccaaggtgccggcgatcgtcgacctcgacggacctggcggcaagccggcgcgcgtcttcgattcgacagcgatcctgatctacctcgccgaaaaggccgatgccttcctcggtgcgcccgacgaccggccggagctgctgtcctggctgatgttcatcgcctcggggctgggaccgttctcgggccaggcggtgcatttccagcacgccgcccccgaggggctggactatgcccgcaaccgctaccggcgcgaggccgagcggcattacgaggtgctggaccggcatctggatgggcgcgactggatcgcgggcgacagctacaccatcgccgacatctcggcctggggctggctggagcgggccgagcgggtgctgaagggcaagaccgatccgctggccgactatcccaacctgaagcgcctcttccaggcggtcgatgcccggccggcagcggagcgggcccgcagggtggggagcgatcatgacttcaagaccgtgatcgatgaacaggcgcaacgcgcgctctacccgtccaactatcccaaagccgggtgaggcccgatatgatcgatctctattactggccgacgccgaacggccacaagatcaccatgttcctggaagagaccgggctggactatcggatccatccggtcgacatcagcgcgggcgatcagttcaagccggagtttctggcgatctcgcccaataaccgcatgccggcgatcgtcgatcatgcgcccgccgatggcggcgcgccggtcagcgtgttcgaatcgggcgccatcctgctctatctggccgagaagaccggccggctgctgcccacggaactgcgcgcccgcaagaccgtcaccgaatggctgttctggcaggtgggcgggctggggccgatggccgggcagaaccatcatttcgggctctatgcgcccgagaagctgccctatgccatcacccgctatgtgaacgagaccaaccggctctacggcgtgctcgaccgccggctgaagggtcggcgctatattgcgggcgacgactattccatcgccgatctggcgagctatccctgggtggtgccgtggaagcgccagcagcagaacctggatgatttccccgatctgcgccgctggttcgacgatatccgtgcccgcccggcgacggtccgtgcctatgagaagggcgagccctacatgtcgcggccgaccgtgaccgaagagggcaagaagctgctcttcggccagacggcggcatccaccggtggcggcggcagctgatcccggcgacggggtggggcctcagccccgccccatcagcatgcggtagcggatctggtcgaagaccacggccaggatcagcagggcgccgagcagcaccatctgcatgtaggagctgatctgggccaggttcatgccgttctggaccaggacgatgaagaaggcgccgagcacgacattctcgacccggccaatgccgccgcgcagcgacacgccggcgatgacgcaggcggcgatgctctccagcgcgatggtgccgcccagattggcttcgccactctcgacgcgggcggtgagcagcagcccggtcagcgaggcgatcagcgcgcagatcacataggcgaagaccagcaccttcttcgtgtcgatggccgacagatgcgccgccttcatgttgccgccgatggcatagacatgcatgccgatgcgggtgcggctcatcaccacccacatggccagcgccgccagcgccgcgaccagcaccggcaccggcacgccgaacagccggccgaagccgaagaggtcggcgaattcgaagggcaggccggaaaccggcacgccgccggtcaggaacagcgagatgccggccgcgaccgagctgacgccaagcgtcatgatgaagggcgagacgccgaaggcggcgacaccgatgccgttgaccaggccgatcagcatggcggcgcagaagccggcggtggcgccggccacgatcaccagccacacggcatccggaaacatctggcccagcgccgtcatcaccagcgccgagacgacagaggtgacggcgaccgcggcgccgaccgacaggtcgaaaccgccggtgatcagcaccagcatctggcccagagagaccagcatcagatagaccgactgccgggcgacattgaccagattgtcgacggtgaggaagcggtcggagaggatcgtgaacacgatcagtgcgccgaccaggaagaagggcaggacacccagacggacgaacaggcggcgcagcgggttggcggcggcgccccgggcggtatcggtcatgggcgcgggtcccttggtcatgccggtggcgggtgcgggcgtatcggtcatgcgacctcctcctcttccgcgaagaaatgcgcgaggacggccgcttccgagatgccgtcgcggccgagttcggcggcgatgcggccgcgggagaagaccaccagccggtgggcgaggttcatcgcctcgggcagatccgacgagatcaccaccaccgccttgccggcctcggccagatcacggatcagccggtagatcgcggcgcgggcgcccatgtcgacgccgaccgtcggctcgtcgaagacgtagagcgcgtaatcgcggccgagcccgcggccgaacagcgttttctgctgattgccgcccgaaagctgggcggcgagccggccgcgataggcgggcggcagctccacccgctccgccacctgttcgcaggttttgcggatgcgcggccagggcagcagcccccggccggtgagaccgggcagcaccccctgggccaggttgtcgcggacggtgaaggccagctgcagtccttcggtcttgcgatccggtggcaggtaatacgccccggccgccatcatggcacgggtcgaaatgccggtgacgtcgcggtcggacgcatccccgtgccagaccacgcggccggccgtgaccggcagcaggcccatcatcgcgcggaaggcgcgcgacttgccggaacccaccagccccgccactcccaacacctcgcccggacggatgtcgaggtcgatgccgttgacgccccaggcattcagcccgcggatcgtgaccagcggcgccccgggggcatgggcgatggcggggtagatttcgctgatggcgcggccggccatcagctcgaccagcgtcgcctcgtcggtgccttgcatcgggtaggtgccgatctttgtgccgtcgcgcagtacggtgatccggtcggcgatgcgggcgaattcctggatgcgatgcgagatgtagatgatgccgacgccgtgggccttcatcgccgtcaccaccctgaacagatggtcgacctcacgatcggtgagcgaggcggtgggctcgtccaggatcagcagcgacacctcgccctggagtgccttggcgatttcgaccatctgctgttcggcgcggctgagatccgacaccctgcgacgcgggtcgatgcggaaatcgagccgggcgaacagcgcatcggcggcccggcgcatggccggccggtcgatgaacggcccggtcttcagctcgttgccgaggaagatgttctcggccaccgacagggtcgggaccagggagaattcctgaaagaccgccgaaatcccggccatgcgggcatccgcgaccgagtggaaggcgaccggccggccgtcgaggcggatctcgccctcgctcggcgtcgaggcgccggcgagcatggagatgagggtggatttgccggcgccgttctcgccgaacagcacatggacctcgccgcgccggaggtcgaaatcgaccgcgttcagcgccgtgacgcccggatagcgtttggtcagcccccgggtttcgatcaggggcgtcgggctggtgtctgatgtctgggccatggtctcgggctgcctgctcgttgactgcgggggtgcgcagaccggcggggcgcgggatgatccggcaccccgccggtggagcggttcgggatcggcccggtatcagttcaccgagaagaccggcgagaagttctcgggcggcaggatgctttcgcgcgccaccttgccgatgttcttctgatcgaccacgaagatcttcgggccgacatgcttcacatagtccttgccttccaggatgcgcaccgcctggtcgacggcgatacggccctgaatgaccatgctgtcggccggtgccgcttcgatgaagccgcgtttgatgccctgatagacaccgggggtcatgtagaaggcgaggatgccgaccttgtcggtaaggccgcgttcccgcagcaggccctgggcggcctcggcggtcacggcggtgccggcgatataggcgacgtcgggcgtggcctggagcacgtcttccaccaggcgcagctgggcttccttgccggtatcgccataacgcggttccagcacctgaaccgccgagcccttgatcgcgtccatgaagcccttatgcgcggcttccacccagccggcacccgccggccccgggaaccagccgaccttgaccggggcggagccggccggatgcttggccgccagatactgaccggtctcgttgcccatggtgtagaacgacaccagcgacttggcggccagttcgggcgaggagatgccgttgatcacgtcgatcaccgggatcttcttttccgccagttccttgaccagattgttgagcccgtcatacgagatcgcgccgatcaccaccgcctgggcgcccgaggcgacgcaatcctcgatctggctgatctgcttgggcagttcggtataaccgccggcctcgaccacgttcagcttcacgcccaggcgcttcgcctcttcggtgacgccatagtcgacgcccagccagtaggcgtccttcatgtgcgggaaggagacgcagacgttccacggcttggacgccttgtcgagcggcacatagtcgatgtctttcgacgtgccgtcggccgagaaggccggggtcacctcggcggcgggatagggaaaccagtccgcggcctgggcagcgcctgtgaagagcgtgccggccagaagagcgatcgcgagctttttcatgacgtgagcctctgatgtcgtctttgaacgttcacgttgtttcgtgtttgttcttgttttcggctgtcttcttcttgctcaggcgggtaggcaggtggtctggtcctccgggcggtctcccccgcccggaggaccggtcatgggtcagaccagggcgtcgtgcaggcgggcgatcagcgaggcgcgatcccggcgggcggtgagcgcggtcgccatgtcgaccttcacgaagcgggtgggggtgtgcggctgcaactggccgatcagatccatatcggccgagatgacggcgcccagggtgaaataaccgccgcccgacacggcatcgcgatgcagcacgatcggctcggagccgccgggcacctggatcgaaccgtactgatagcagccgtcgacgatgttggaggggtcggagccggcgccgaagggctgctcgcgcggctcgaagctgaatggccggccgccgcggaaacggtagccgatgcggtcggcctcgggcgccaccttccagtcatcctcgaagaagttgcggccggcctcttcggtgatcagacgccagtagaggccgggcagcacccggatttcggccggcgtgccgggcaggcggcgcaggcttggggcaaccgagcggccttcgtcggcccccggcccctcgcccagcggcagaagatcccccgcggcgagcgcccggccctggaagccgccgagggcgccgagcgcataggtcgagcggctgcccagcgcctcgggcacgtcgatgccgcccgagaccgcgacataggcgcgggcaccggccttcagatagtcgaagctcagcacctggccggccttgaccttgaaggcggtccagccctggcgcggctctccgtcgagcttcggcggcagatcggcgccggtgacggcgaccgtggcgtcgcgctggaattcgagctgcggccccaggaacaccacttccagccccgcggcccctgccgggttgccgaccagcaggttggcggcagtgagcgagagggtgtccatcgcgcccgaaaccgggatgcccagatggaaatagccgggccggcccagatcctggacggtggtggcgaggccggggttcagaaccttaatcgccatcgagggcctccatcagccgggcgttggtgccgtcgatatccgccttgaaggcatcgagatcgaaggagaccgggcggatgcgcggaacataggtattggccgcgacctgagccgtgatcgcgtcgtactccgcacggtcgatcggcttccacttcacgatgtcgcccgggcggaagaagaccatgaagtcctgaaggtaggagatcgactgttcggggtcgtagatcggcatcggcgtgatgccgaacatctggtagccgccggcgccgcgcaccgaatagatacacgagaaacacccgccatagccgaccgtcagcttgggcgtatcggtgcgggggcgcagatatttcggcacctgcaattgccggtcgcgctccaccagctggtagaggaagggcaggccggccacgaaacccaccatcgacacgaaccagggcgcggaatgatgggcgcggatgaagcccgcggcatcgtcgaacccgttgatccgggcggcatagtccagatcggtgccgctcgggtcctggtggcgctcgcggaagcgcatcagggtctcgtgggtccagggatcctggtagtagaccgggatttcgatgatccgggtatcgagccgcttcggccccgcttcggccgcactttccagcgccttcagcttcgccatcatctcgtcgggcgcgatgatgtcggggtcgaatttgacctggaagctggcattggcggggcagacctcggtcaccccggcgatcttcgcggccttgaccgcgttgctcatggtgagcgccttgaagaaggcgtcgagcgacatctcttcgtccatttcgacgaagatgtgctcgtcacccccgaaggaatagcgcgtcttcatccggtcctcctatcgggtggcgaggccgtcggcggccagccaggcttcgaggaactgggtatgggtgcggccctcgcgcacctccggcgatgcggcgagggccgcatgcagcggaatggtggtcttgagcccgtcgatccggatggccgccagcgccgccgccatcgcgtcgatcgccgccccgcggtcctcgccggtgacgatcagcttggccagcagcgagtcgtagaagggcgggatctgatagccttcgtagatcatgccgtcgaagcggatatgcggggcctcgggcaccgacatcgcgcccaccagcccggggaagggcatgaagccgttggcgggatcctcggcattgatcctgacctcgatcgcatggccgtggaggcggacatcctgttgtgcgatcgtgagcggctcgccgccggcgatgcggatcatccaggcgaccagatcgatgccggtcaccatttcggtcaccggatgctccacctgaatgcgggtgttcatctcgatgaagtagaagcggttggcggcgtcgtcatagaggtattcgagcgtgccggcaccgcggtagctgacggatcgggcaagtgcgaccgccgacgcgcaaagctcggcacgggtggcctcgtccaggcaggcggcgggggcttcctcccagaccttctggcggcggcgctgcaaagagcattcgcgctcgaaacaatggatcgcgtggcggccgtcgcccaggatctggacctcgatatgccgggcatcgcggatgacccgctccagataaagcccgccatcgccgaaggccgcctcggcctcggacgccgcctgcggggccagcttgcgcagctccgcctcgttttcggcgatgcggatgccgcggccgccgccaccggcggtcgccttgatcatcaccggatagccgacggcttccgccgctgccacggcggcctcgacatcggcgagccggccgtccgagccgggcaccaccggcacgccggcggcgatggcggcggcacgggcggcggccttgtcgcccatcacccggatggtgtcggccgaggggccgacgaagatcagccccgccgcctcgacggcgtcggcgaaggcggcgttttccgccaggaagccgtagcccgggtggatcgcgtcggcgccggcggcctttgcggcctcgatgatccgggcggcgttcagataggaggctttcgccggggccgggccgatgcacaccgcctgatcggccagccgcaccgccagcatgtcggcatcggcttcggaatggccctgcaccgtggcgatgccgagggattgtgcggcgcggacgatgcgcaccgcaatctcaccccgattggcgatgaagagcttgcggatcgccatcgcgccctcagccttcaagctcggcgagcaccgcgcccgccatcaccggggtctcgttctcggccaggaagcgggtgatggtgccggcgacctctgccttcacctcgatgaacgacttcatcacctcgatcagcccgatcacctcgcccggcgcgaccgtgtcgccgtcggatttgaagggcggctggtccggggccgggcggcgatagaaggtaccgggaagcggcgagcggatttcggccatcgatgagggtccttccggctggcaggaatgcgggtgtggttcgggggcttgagaccgtggagatgcggggggggagagggagagaagggcgggtcgtgcgtggtcgtcaggctgcggcggaaacctcggcggcattggcgatgcggatgccggcatcgatcagcccggcgcggatggcggtgccgatcttgagtgcgcccggcgtgtcggaatggaagcagatcgattcgaactcgatctcgatatcgtcgccctcgacggtacggacgcggccctccaggcaggcccggacgcatttgcgggccacatcctcggggtcgagcgcgcgcatccggcgggcgaagacgatcgaaccggaattgtcgtagtcgcggtcggcatagaattcgcggatcactggcaggccggccgcgcgggcgaccgtgcaggtcaccgacacatccatgcagtagagataggtttcggggctcgatttcagcagcgcctcgaccagcagctgcgacagggtctcgtcgcgggcgacttccatatagagtgcgccatgcggcttgacgtgctgaaggcgaacgccatgacggcgggcgaattcgcgcagcgcccccagctgatagatgatgtcgttcaccagctcttccggccgcgcctggatcacccgccggccgaaaccctgcaggtcgcggaaacccggatgggcccccagcgccacaccgcgttcggccgccagccgcaccacccggtccatcaggttggggtcgccggcatggaagccggtggcgacattggccgagctgatcaggtcgagcaggacatcgtccggagcttcactgatcgtccagtggccgaagctctcaccgagatcacaattgagatcgaccagtcttttagccaagcgtctctctcctgctgcatgcgatccgacgcggtggcgtgataccggaacgcgcttgttcacgtcttcatgacaatatggtgatccaggatttaacccctcggcaatttctaaattatgagaatgcattatcgaaaaaatcgaacgcttgaatcttcaacggctctttcaaatccttcattctcatgcatatgatcgagggcgctgacccccgttcaggcatctgttccgaaaatgcggtgaggcattatctgaaaatcagaaggtgtcgcggatgtcgctcaacttccgccacgtgaagtacttcgtggccactgccacgctcgggcaggtgtcccgggcggccaaggaattgtcgatctcgcaatcggcgatcaccgcggcgatcaaggagctggaggccgagaccggcagccggctgttcgaccgcaccgcccatggcatggagctgaccgatgccggccgccgcttcctggcggccggctacaggatcctggccagcatcgaggaagcgttgcagccgggcaccgccgatgacgccttctcgggcacgctgtcggtggcggcgagctataccgtgctcggctatttcctgccccagcatctggagcggctggagcggcgctatcccaatctgcgcatccagctttatgaactcagccgcgagatgatcgaggacgggctggtcaccaaccgcttcgacatggcggtggtgctgacgtccaacgtcaacaatccggaactggtcaccgaaaccctgatgtcgagccagcgccggctgtggctgccggccgggcacccgttgctcggccgcgaccgggtgcgtttcggcgacatcgcggaggagccctatatcatgctgaccgtcgacgaagcggcgcactcggcgctcaaatactggaaccgcacccagcaccagccgaatatccgcctgcgcacctcgtcgatcgaggcggtacgatcgatcgtggccaacggccaggggatctcgatcctgtcggacatggtctaccggccctggtcgctggaaggcaaacggatcgagacggtggtgatggccgaagaggtaccgccgatgaatgtcggcctggcctggcgccagggcgttgatctcagccctgcgatgcgcctgttccgtggctattttgccgaggtctatcagacaccgcagagcatgctgcccaggtgatctgcatgtctgatgacaggtcactgcagatcggctatcagggaagcaggatggcaatgatgccgtcgtctgtcgtcgggggcgggatatgacgcgaaacgagatcacgaccgaaagccggaagcaggttcaggatcgtccactctggctgcggccggcgcttgaagtctgggcattggcgccggcgacccggttgatggacgtcgtcacccccgacggaggtcccaccacgtcctgatcgcgagcgtgtgagggcctgcatgatcgcgacactgagagaccttctgcggcggcgcccggaaggccctttgtctgcggccatggaggcagggcagcgcctgcatgtgaagaccggacaggcagccgcctgtgccggtcttttgccatgggcggcggtgaatgcccgtctgtcggcgcaggcgctgatggagggcgaggtttcggtgatgcgggcgggccgcgaggtgccgctggagatgctgacccgcctggttggcggccagcgggttttgctggatgcccagcttcagacgctctgccagggcggggccagcttggtgctgctcggcatgcataggcatgttcaggcactggccgcgctggccgccatggtcgagcgtcatgtcgaggccccggtcaccatcaacgcctatgccagctttacccgggatggcgccttccagatccatcgcgacggccatgacgtgctggtggtgcagatcgccggcagcaagcgctggttctgtcatggccggcgcagcgacccgcccttcggcggcgaaacggtcgatccccgccgcgatccgggcccgcccgaggcggagatggtgctggagccgggcgatctgctgttcgtgcccaaaggcgactatcaccgcgccgaagtggctgatgccggcgggcagtcgctgcatctgacggtggcgatccagcggccggacggggcggaggtgctgcgctggcggctgcgagagatggcggaccgcctggcggcaccggtgccgatggatccgtccgcaatgggtgcatatgaagcgcagctgaaggcggttctggccgatctgtgcgccgggttggatctggaccgcttccgggcggcgcaggccgcggcgcgcccgctggccggggccatggccctcgggctggccaccggggccgacggaccggaagatgcggttctggttcagcccgccctgcgccgacgcccggtattgccggcgacggggccggccgacatcagggctggtggcgtgacgacccacctgaatgcgcaggaatgcgcgatcctggcactgctgctggaccgcgacatcgcgacgacgggcgagatcctggccggcctgccgtccgaggatccggcggccttgcgtgccgcggtggcggcactcgcccggcgggggctggtctttctgacggcctcctgaccctttctcagcctgcccctcagctcagcgggcatgagggccttcggccacttcctcgacgatcttgtcgacgaaggccggcaggtcgcccggattgcgcgaggtgatgatgccctggtcggtgacgacctcctcatcgatccaggtggcgccggcattgcggacgtcggtcgcgatcgaggggtaggaggtggcggtgcggccgcgcagtgcatcggcttcgacgagcatccaggggccgtggcagatcgcggcgaccggcttgcccgaggccacgaaatccttcaccacctgcaccgcttcgggcacctggcgcagcttatcgggattgatctggccaccgggcaggaccagggcgtcgaaatcctcgatccgcacatcggcggccttcaggtcgacatcggcccggtcgccccaatcggtttcatcccagctgcggatgcggccggcttcgggggcggcgatctgaacctttgcgccgcggcgcagcagctcgtcccgcggataggtcagttccgcgcgctcgtagccgtcggttgcgaggatcaggatgcgggcgttttcgatcacgggcatgagtctctccttccgtgagaggggggagggagaccaacccgtgcgggcgatgcgggttccgatccgccggtcgatcagaccggggcgtgggtgcggcggtcggcggtgaagggacggcccgagcgcgggcgcggtcccgtcttcacggccacatccggcggcggggccagttcgtcatgcagccagttgaccacgggggcggcggtcagcgccatgcgggcgacctggccgacgatggcattggcggaatagggcggttccatcagctgttcctgattgaccaccacgatatgctggcgcggcgttacttccacgccgatgccggtccggcccgaccaggatttgcgcccgaccagcgacaggaagcgctggcggcgttccggcgcttcggccgaatagggcagcacgcccagatcggcgatcaggctgaggaagacgccctcgggggctgcgcgcagcgtgccggtataggcgatctcgcgccagcggaaggtgaagcgcagcggatcggtgccatccttgcgacggatctcaccatcctcgccgatcgatacgctgagcggcatgatcggcagcggttgggacgagatgaagcggatcagccgctcgcggcgcgccgcggcgctttcggtctgatggccgatatccgcaatcggatcgacggcgttgttctgggtcatcgtcggtcagtttcccgctgcgataccggtctcgcggcgatgccggcggcgtgatgcgctgccgacagtgccagttcaaaatatagggggctctgcatggaattgtcaggcatgtcatgatgcggaggacgcatctttcgcagccggttcccttccacgcgcattccgggctccatcttcgccaggtctcatgtttgacattcccgtccgccgacgtctcgacccgatcctggaccgtatcggccgcggcctcgccggtcgtggcgtccgggccgatgctctgacactcgccggtttcggggtcggccttgccgccgtgcccgcccttgccctgggagcattctggactgcgcttggttgcattctggttaaccgcatcgcagatgggctggatggtgcggtggcccgcgcggcagggccgaccgatcgcggcggctttctggacatcgcctgcgacttcctgttttacgccgccgtgcccctgggtttcgccctggccgacccggcggtgaacgcgctgccggcggccttcctgatcttcgccttcgtcggcacgggatcgagctttctggccttcgcggcgatcgccgccagacgcggcggcgtgccgccttcgggccaccgcggcaaggcgatccactatctgggcgggctgaccgagggcaccgagaccatcctggttttcgtgatcatctgcctgtggccggcgacctttccctgggcggcctggatcttcggcgggctgtgcctgatcaccaccgcaacccggatcgccgagggcatgcgcgtgttcagatgagggcggaggtatatccacagaaatgcacgagtccacggaaatacacagagctgacatcgatctgcaaaccagccgcggcaggatgacggccgtgcggcgatgcgcgcacggatcttcccctcccaaggacagacagccatgttcaagctcgtctccggtggcctcgccacgcttgcggccgctgcggccgtggtgcttccgatgaccttcgccgcgcccgcccgggctgcggatatcgacaattcggcgctttcccaggccgatttccgcccccatgcccgcaccttcggcctggtctataccctgccggcagaggtgaatgatcttctggaccgcaccatccgtggcccgctgagggaacggctgctggaactggacctggtggccgaggcggtgaagccgaacatcccccatgtcaccgtcgtccatgtccacaatgccgatcccgagacgccggcgcggatgctggaggcgctgccccggctgccgccggtgctgaacgtcaccctcggccggttctacaccaccgaggcggccaagggcgccggccacccctggtggctggatctgggcctcgccaaggaaggtgacggattcgaggcgatgatgggcttcaacaccaccgccaccgccgccctggcgccgctgcgcgacgggccgctgccgcgcgtgaccggtccggtctatgccgcgatgggcgatgccggcaagaagctggtccagaccgtgggcgtcagcggcgtgaatgtggtggacggtggcaaggagctgcgcagccacaacccgcacaccaccctggtctacagcatggcccgcttcacgcccgagctgcaggcggcgatgaaccagaccgccgaagccttcaaccagatcctgcccgacccgatcccggtcaacttcaagaccgtctcgatcgtcgagctgggttttgccggcaatgtgacccgcgagatctatcgcgtcagcctgaccgatggcgcggtgaccgagatcgccaccggccgccagctgccggcccgtcagcctgccgcccggaactgacacatgcttgcggatgaacgccatcagcggatccgcgccctggtggcgaccctcggacgggtcgccaccgatcgcattgcggccgatctgggcgtgtcgcgcgaaaccgtgcgccgcgacctcgtggagctggaggcgcgcggcgacctctgccgggtgcatggcggcgtgctggccccgcggccggcggccgagccgccgctggccgaacgcagccggatccgcccgcgcgagaagcaggcgatcgcccgcgccgccgcgctgaagatcgagcccggccagaccctgttcctggatgccggcagcacggtggcggaactggcggctgtgctcgccaccctgaccgggctgacggtcgtcaccaattccttcgaggtcgccggacgcatcgccatggccggtgccggcatgcgcgggctggaggtgatccagttgggtggccgggtcgtgccgggggcgggggccacgctgggcgccgccaccatcgcggaggccttgcgtcatcatgccgactgggcgttgctctcaccggttgccgtcgatgccggcgcgggtgccaccagccacgaccatgacgaggccgaactggcccgcgccatgaccgcccgcgccgaccgggttgcgatcctggccgaccatgccaagatcggccagcgcagccgggtcggctattgcccggccgagcggatcgatctgctggtcaccgacacccgcgcccgcgatctgccggcactggaggcgctgatcgatctggtcggcgaggtggtcattgcctgagccgtcatccgcggttcccgccatagctggcccgcaggaactcgatcggtgtcgtcggcttgcggccgagaagtttctccagatcgtcgctctggccgtcccactcgccggcattgacgccctgtacccaggccagcacgaagccggcaaccggttcgggcagtcctgccgccatcagccgggtgatgtagtcctggtccgggatggcattgaacggcaccggcctgccgctgatgtcagacagaatctgcgcaacatccctgaaggacacggccggaccgccgtagagcgaataggccttgttctcgtgcccactttcactcagcacgacggcatgcgcttctgccaggtcgtcgcggcaggcataacccgccttgccggcgccggtcggggcattgacaccggcattcagaagattgccaccggcatagagttcaatgttttcgagaaacggcggatgacgcaccagcgtgtaagtcaggccggatgccttcagtttttcttcgacgcggagatcttccccggttacctgcggaaggctgaagccagagccggccttgtggatgatcggcatgtagacgatgtgcttcacgccggcatgtcgtgccgcattgatgacgttgtcgtgctgggttgtccgatccgtaaaggccgtggcggaaacgagcatcactttctcgacgccatcgaaggcgcgcagaagtccgtcgtggtcgaaatagtcgccgcgacggatctcaatccccttcgaggcaaggcctgacgccctggcgggatcgcgggcaagaccgacaagatcgccggcaggcctgcgcttcaaaagatggtcgagagtcattcggccgatattaccggtggcgcccgtcacaaggatcctggtcatgatgttccctctataggctcgcgctcctgcgcgtcgacatcgtcgtccgatccaggtatgacagggcagactctcgatccagtactgacctttttgtaagtgtcggaaacaggagatcagaatgaccgggacaaatttccaatgcggcctggaagccgttctggccattctcggcggcaagtggaaaccgctgatcgtttatcatctggccggcgggcccagacgcaccggcgagcttcgcagactggtgaccggcgtgagcgaaaaaatgctgatccagcacctcaaggagctgacggaggacggcgtcatccggcggatcgatttccagaaggtgccgccgcatgtcgaatacgacctgaccggttttggcagaagcctggcacaggtcctcgcgccgctatgcgagtggggaacccgtcacactgccgaggtcgcaatgatcgtgcaaaagcgggacggggctgcgaagaccgcctgacaggcatgtcgcgtgtcgtaatcggcgccccctcgtatcaggcatctgcctttcgccgcgacagccggccggccacccgccgcacccaacggccgacccggtcgcccagtaccagcatcgacggggtcaggatcagggtcagcagggtggcgaagcccaggccgtagacgatggcggtggacagctgcgtccaccattgggtggacggggcgccgatcgcgatcacccggttcgggatgtcgacattgatcgacagcatcatcggcaccaggcccagcatggtggtgaccgtggtcagcatcaccggccgcaggcgctgcgcgccggtgcggagcgccgcttccacggcatccacgcccttgccccggatctcgttataggtgtcgatcagcacgatgttgttgttgaccacgatgccggccagcgcgatcagcccgatgccacccatcacgatgccgaagggctgagcggtcgccatcatgccgatcagcacccccagcgacgagaacacgatcgccgagaggatcagcgccgtctgatagaagctgttgaactgggtgaccaggatgatggcgatcaggaacagcgcgatgccgaaggcgcggctcaggaattcctgggccttgcgctgctcttcgtcctggcccttgaacttgacctcgacccggggatcgagcggattggccgccagccaggcgcggatctcgcgtaccttgttgtcggccaggacgccatcgggcacttcggcatccaccgtcatcacccggcgggcatcggtgcggttgatgatgccctgggtgggggcggcgcggcgttcgacgaaattgctgatcggcgtctggcccatcgcggtctggatgcgcagctggtccagccggtcgccggtgcggtcgatttcagggaagcggacccggatttcgacctcgtcatcggtatcgtccgggcgataggtgccgacattgacgccctgggtcacgaagcgcacggcattgccaacccccagcacatcggcgccgaagcggctcgcctgggcgcggtcgacgaccatctcccactcgatgcccggcaccggccggctgtcggcgatgtcgatcatgccgccgatctgatgcatgccggcgagcacatggtcgacggcgcccggcagggtttcggggaaacggctggccagttcgatctggatggccttgccgaccggggggccggcctcttcctcgcgggcctcgatcaccaggcccggatggtgcttcaggcgctggcggatggtttcgaggatttcactcgcatgcggacgggtgcgccagtcggcgaattccagattgatgatgccgatcacgtcctcgggcagatcctcgccgcggatggtgccggtgcgggtgtagacggttttgaagccgtcgagcttcagcacctcggcctcgacctcgcggaccagggtctccttttccgagatcgacatattgccgcgggcgcggacctggacctgggcattgtcgggttcgaccgaggggaagaattcgacgccgcggccgaacatgccataggcctgcagggtgacgaccgccgtgaccagcgcaatcgccaccaccacccaggggtagcggacggccttgtcgagggtgcggacataaagcccggcaggcccgccgaccgaacggatgtcgccgtcttcggccgcgcgcagcatctccaccacccggccgctcgatttcgccggcttgccgatgatgctgcccagcaccggcaggaagatcagcgccatggcgagcgaggcggacagcgtgacgatcagggtgatcggcaggaatttcatgaactcgccgacgatgcccggccagaacagcagcggcaggaaggcggccagcgtggtggcggtggacgagatgatcggccaggccatgcgggtggaggcctcgcgataggcctggatgcggtgcacgccttccagcatgcggcggtcggcatattcgctgaccacgatcgccccgtcgaccagcatgcccacggccaggatcagcgagaacagcaccacgatgttgaccgtcagccccatggcgtgcagcaccaggatgccggtcaggaacgagcccggaatggcgatgccgaccaggatcgacgagcgcagccccagcgccgccagcaccacgatcatcaccaggatgatcgcgctcgccacattgctcgacaggtccgacagcatcagctcgatctgctgcgacttgtcctggctgtacgagattttcacgccctcggggaagagggcggcctcggcatcggcgaccgcgcggacctcgttgatcgtgtcgatgatgttgacgccgatccgcttggtcacctccagcgcgatcgcgggcttgccgtcgacgcgggcgagcgattcggggtccttgaagctgcgctggccgaccgcgacgtcgcggaaggtcacgacccggccgtcgatggccttgatcggcatgtcgaggatgtcgtcgatcgactggatcagccccggcaccttgaccgagacccggcccgcctcgctgtcgagcgcgccggccggcaccagctggttgttacggccgaccagctggaccagttcgtcctgcgaaatgccatagctgtcgagcgcgcgcggatcgaccacgatctcggccagatcctcgcgatcgccggcgatgtcgacctcgagaacgcccgagaggccctcgatcttgtcctgcaggtcgcgggcgaggcggatcagcaggcgctggtcgacatcgcccgacagcgtcaccaccaggatcgggaacagcgcgacattgacctcgtgcagttccggttcctcggtctcgccgggcaggtcggccttggcgatgtccatctgctcgcggacatcgcgcttggccttttcgatgtcgaaaccggcctcgaattccagcaccaccgtggcatagccttcctcggcggtggcgcgcatctccttcagcccctcgacggagcgcagttcctgctccatcgggcggatcagcagccgctcggcatcctcgggcgagatgccgtcatggcgcatggtgatgtagaggatcgggatcgcgacatcggggtcgcgtttccttggggatgtcattataggcgaccgaaccggtgatcagcagcagcagcagcaggctgagcaccgtgcggctgcgtgcaagacaggcattgatcagcgtcttcacgagccggccccttcacgcgccggggccttggtggcgccggccgccgacagatcgagctggtcgagcatgcgctccacctcgggcggcagcggcaccaggccgcgcagctcctgcggctgcacctcgaccgcaatcaccttgtccccgggggcgacatagccctggccgaccacgatcacgcgcgcatgttcggcaagcccggtgacccagaccccggcatcgctggccgagaggatcgagaccacgtcgaaggcgacccggtcgtcgccgtccaccaccttgacacccacccggccgcgctcgtcgagcgacaggagggcgggggtgagcagcacggccgggttgcgatccagcggcaccgccacctcggccgtcaccccgccggggagcaggccgtcgggattgccgacctcgatttccacccggaaagtgcgggtctgggcatcggcctgacggctgatataggcgaccgtgccggtcaccaggctgccgtcggccagtcgggcccgggcctgctggccgaccctgatggcgccgatatcgcgttcggcgatgtcggcgacgatcagatagggctcgggcgccagcacccgggcgacctgagtgccgggcgagacatagtcgccgatctcgacatggcggcggtcgacgatgccggcaaagggggcgcggacgatggtgtcgtcgatctgctgctcgatctgggcaagctcggcgcgggccgcctcgaactcggccttggcctcggccaggcgcagctcggtctggaatcccttggcactgagcgatgaggcggccttcagttccgcccggcgctgttcgatcagggcctgggcgcgggcgcggcgcggctcaagatcgcgggtgtcgagtttcgcgatctcggccccggccttgacccggctgccctgggacacgggcagttcgatgaccctgccggcgctttcggctgccacatccaccacccggcgcatctcggtgcggccgctgaccaccagatcccggacctgggcggtcagcgtcagctcggccaccctgaccgtgaatggctccgctgacgccgcgggggccgcctccccggcggccggcgccgtcccggccgctgcatccgtcgccggatcggtggcggcatcggcgtcgaaaccgtattcgatgcggccggtatacatccaggcaccgagggcggcggccaggatcagggcgagcaggatggagcggttcatgaaggatccccgtcgttgcgggcggcggttgcggcaagagcttcgaccagggcagggccccgggtttcgacatgggcgagggcggcgccatagacggcgcgcccgaattcaagggtgaaacgcggcccgggcgggatctcgccctctgcctcggcctcgcgccggtccagatcggccaggatctcgcgatattccccggccttgatcttgagcgcgtcctcgatccgcgccggcggcagcagggcggcgaagaacatctgaatcatgaattccgagcgcacccgctcccgcgggcgcgtgcggcacagcgcctcggtgaagcgggtcaggccttcgggcgtgatcctgtagatcttcttgtcgggccggccttcctgctccacctcggtgaccgtcaccagcccttcggcggccagatcggccagggccggatagatcgagccgaagcccgccgcgtggaaatgcgcgaaggccccctcgaaaacctgcttgatctcatagcccgtggcctcgccgagcgtcagcacgcccaggcacaacgtccgcacgtccatggcgtcggcccgccccgtctccctggtggatcgtcccgtgatatcgatccgatatagccccgccgcactgtgccatggaggccgggtcgacgctatgtgagatccgtcacaaacgagggggatttcgcgcaacgagactgatcagggggtctgcgtcccggtttgcaagccggttccgatatcggtggcctggcctgcgatgtcgcagaccagccgttgaaagcgggccctgttgtcgcggtaccactgcacgacgccggccaggtcatcgaccagtctgtgctgtggcgcccatcccagggcgcggatccgtgaactgtcgatcgcatagcgccagtcgttgaacggccggtcgggcacgaaatcgatcacatcttccagcgcgtgaccaaagatgtcagcgatcatgccggcgatctcaatattctcgaactcatcttcggagccgatattgtaaatcccgccgatctcgccccgccgcatcagcagcacgatcgccgcggcaaaatcttccgctgccagatagtggcggcggtttttgcccgagccgtagacggtcagcttcttgccgcaatccagaagcattgcgaagcgcgggatgattttttccggatactggcggatgccatagatattgttgccgcgtgcggtcacgatcggcatccggtaggaatgcagatagccggagatcaccatctcggcaccggccttcgaggctgaatagggattggtcgggttcaggaacgtcgtctcgtcagccgccccggttctcacctcgccatacacttcatcggtcgagacatgcacgatgcgcttcacgcccatccggcgacaggcttccagtatcgtatgggtgccgtagacattggttctggtgaagagcagcgagtttccgaacgaattgtcgacgtggctttccgcggcggcatgaaccacatagtcggcaccggccaccacattgcaggcgaggtcgaaatcgcaaacatcgccaataacgagttccgcatcccctgccgcggtcaggtcctggatgtttctgacatccgccgcataggtcatcttgtcgaagatgaccagttggtgagcgggaaactggttccgaacatgatacgcaatgtgcgacccgataaaaccggcgccaccggtgatgacgatcttcggcattatccgagcgcctttccgaggtcgtgacagtagcggaggatatcatccgccgtctgccggaggccggtttttcccgtcagccgggacacatcgaggcgaaaggcatctgcctgccgcgggtcgatgacgcgcagctgtcccctgccatatccccggatcacggcaagagcaagctctccacacatgacgccggtgccggacgacagattgtaggtgccggtcaggcccagctccacgaccctgcccagctgggctgcgaagtgttcggccgtcacgaagtcgcgagaaacgaacgggctcatgtcgaagacgatttcgccggtgtcggccaatgtgttcagaatcagacccatgaaactccggcggccgggcatgtgctcgtggccgatgacgttgccgagccgcaggatggtgagacggtcggccggcagcatctgccgcagggccacctcggtggcgagcttgttccggccataggtatccaggccggaaagacctgcatcttcggatgcctgccattgtgcgtccgctgcataaaccttgcgtgaactcagcataatgtagtgggcacccgctgctgccacatgtcgggcaagacggatgtcgacactgcgtgcggggtcgtggggcaggtgcatgtcgtcgggatgccgggcgaagttgaccacgacatccacgccgtccatcaaatccggatgctccagcgcggtgtggcaggcgacgcggaggtgcgctccggccggcggggccccgacaaaggcacggcccagaagacttcggcctccgaagacgagaatgcgcatgcgatgtcagggctccgatgccgttgctctgtgccgctttacaccggcgcgatccccgacaccacccgcatctcggcccggagcggcacccggccttcggcatcggcgagggcggcgaaggcggtgcggatgcgggtttcgatcgccggacgggcctcggggcgggcgtccaggcggtggccccagctcatatccagctgcgggcgccagaaatcgtcggcgaggcgcgggcgtggcgagaagacgtgggtttcggcggtaaccccggtcaggccggcgcgggtcagcgcgtcgggcaggcgggtgcagctgccgaaacggaaggggccgagggcgtccggatgggcgggctccatgccaagctcggcctcgactgcggtgcccagcacctccagcatggtgctggcctcacgcgtggtccagatcatcagcgcggtacggccgcccgggcgcaacacccggcggatgccgtcggccaccgcctgggtgtgaggggcgaacatcacgccgaagcggctgaccacggcatcgaaactggccggggcgaaaggcagatgctccatatcggcggccgcgacggtcaatacctggcccagcccggcttcctcgccgcgcgcgcgaattgtgggcagcatcgccggcaccagatcggtcgagaccacgaaaccgtcgtcgcccaccttgcgcgccagcgtcatcgccggctcgccggcgccgcccgccagatccagcacccgcgcgccgggggtgacgcccgccgcctcggtcaggatctcgttgaagcgggtcgccatcgcttcgagcggccgggcccagcggctccaggtccgggccttggacgaccagagatcgctctgctggcgggtgcgttcggcatgggggggcagggtggtcacggggcgtgttccttgggaaacgggacaggtctgtcggaaatgagacaggtctgtcggaaatgagacaggtctctcgggccggttggccggcctcggtatcaggggtgcggcggattatgccacggtttacccgcctgcggcggggaggggcgcaccgctggccggcggcaggccctgggcgcgggcggcggcttcggcggctgccagtgcctcgggcgtgtcgatatcgcccaggcaggcggcgtcgggcatttccacctcgaccaccacatcctcatgggcgcggatcacgtcgcgggcgccgcggtcgccggtctgggccatcatctcggcgaaaaaacggcggtcgaacagcaccggattgccgcgcttgccctgccagaccggcaccacgatcagccggccctcgtccgggtcataggcatcgatcagcatgtcgatatggcggggcgtgatgccgggcatgtcggcgagcagcaccagcgccgcctcggctccctcgggcacgtcggcgaggccgatggcgagcgagcgagacatgccggcttccggctcttcgttcaccaccaccggcaccggccggccgccgatcgcgaggcgcaccgagggatcggtgttggtgacgacggtgagcgccctgagccggctttcgagggctgcatcgagcacatggccgatgagcggcttgcccatgatctcgcgcaccagcttgttcaccggcccgcccatgcgggtgccgcggccggcggccagtaccaccgaggcgacgttgcgcaccgatttgggcgcgccgcgccgtggcccgggtgaggcggcggcgcgcggcagcgggcgttcgcccacttccttcagcaggccgccgacgccgaaatcggcgatgtccagcgcctcgatcgcctcgcccgcagccgcgcgctgcagcacccggtcgaagccgttgatcttggggctgcgcgcacagcccggcgcgccgatcaccggccggccggccagccggcccagcatcagcagattgccgggatcgaccggcatgcccaggcgcacgatggtgccgccgatatcggtcagcgccgccgggatcacatcggcgcggtcgacgatcgccgaggcgccggccacgacgatcagatccatcggctcccgcgcgatatcggccagcgcccgggccagccgggtgcggtcgtggggcacgcgctcgatcaccggggtgcgcgcgcccagatgcatcagccggctgccgatggcccgggcggtctcttcatagatcgactgcttcagatgcggcagctcggtcaggatcagggcggcgtggatcacctgccagggggcgatgcggatcgccggccggccggccttcgcgatcactgcaagcacccggtcgagggcggccttgggggcggcgaagggaatgatcttgatcgtcgccagcatctcgccgctttcgcaggcggtatcgtcggcaagcgtggcgatggtgatcgcctcgtcgatccggttgatcgccttcaccagggcctcgtcgatccggcagaggccgcgggtggcggcatagagattgacccggccggtgaaggcccgggcgacgcgcgcattgggcccggccaccgcctgggcgaccagacgcgccgcctcgtcctcgtgcacgtcatcggtcccgaggcgggcgccgagcacggatgtgcggccctgtttgcggatcaggtcgatggtctccggatccagccggtgccccttcttcagcacgcggccgtcgaccgcgatcgcgtgggccagcagaacgccgtctgcatcgtcgagcggatgttcggagaaatccatgggcgtgatcggttcacatgctaaagggggacgggatggggtgaaaggcccggatatcagcccttgggcggccgccgcctcagtgcctcggcactgccgaggcgccggacagcgaccacttccgacaggatcgagagggcgatttccggtgccgtgcgtgcaccgatggcgaggcctacgggcgcatggatgcgggcgatgcggccggcatcaaacccggcctcttccagccgggccacgcgtctggcatgggtgcgggtgctgcccagcgcgccgatatagaacagcggcgcgtcgagggcgagcgtcagggccggatcgtcgagcttcgggtcatgggtcagcgccagcagggccgaggccgggtcgaggccgatctcgggcagcacatcctcgggccaggcgatccgggcggtgacgccggggaaacggtcgggcgtgaggaaggcgccgcgcggatcgaccacgaccatgtcatagccgaccgccgccgccatcggcgccagcgcctgggcgatatgcaccgcgccgatcacgatcagccgcgggcgcggcgcgaagacgttcacgaaccagcgccggccctcggcctcgacattggtcgcctggtcctggcggatcgcgtccagcgcggcattgcgcacggcggccggcagggcggcacccatgtcgccgccgtcggtcgccaccagggcggtggttgcggcatcatccagggcggtgaccagcgccacgccacggcgtgcggcccggtcttcggcgatgcggcggatcagtgtcgcgtccatcaggctgccgctcccctcaatccagccgttcgacccagacttccagccggccgccgcaggcgaggccgaccgcccaggcctgatcgtcgccgacggagaaatccatcagcttcggcgcggcacctgcgatgcaggcctgggccgcctcgatcaccgcaccttccacgcagccgcccgagaccgagccggcgaaccggccgtcggccgccaccgccatctgcgatccgggcaggcgcggcgcgctgccccaggtggagacgacggtggcgagcgccacgcccacaccctggccgcgccagtcgagtgcggcacccagaacgtcgtcgcccgtggccatatcggatccgccggtcatctgcgtcacctcctgatcgggactgcggcatcatcggcccgcaggccgcgccgccaggcttcaagccgcgggtccgcctcggccttcgtccgggtcagcgcggttgcaagcgctttgagcccggtcagattatgcactgcccggaactcgtggacatggggcaaaatcgcccgcacgccacgcgccgccggctggaagccgtcgaagcgcagcagcgggttcagccagatcagccgcggggtcagatgcgccagccgctctaccgcccggctcagactgtcgtcctcggcccggtccagcccgtcggtcaccagcagcaccacggcattgcgggtcagcacccggcgggcgtagcggcggttgaaggcggcaagcgccggcccgatccgggtgccgcccgaccagtccttcaccttgcggccgatcgcctccagcgcctcgtccgggtcgcggcgggccagttcgcgggtcacttcgctcagccgcgtgccgaacaggaagacgctcacccgctgtcctgcatcctgcatcatcgcatgcagcagatgcagcatcatccgggcataggcatccatcgatcccgagacgtcgacgatcgcgaccagcggcggccgggcgcggcgatggcggcggcgggccagcgtcaccgcctcgccgccggtgcggatctggccgcgcaggctgcggcgcagatcgatgcgcgggccgcgcggcgcggccttcagccgccggaccggccgttcgggcaggcgggtgcgcagcaggcggatcgcccggcgcgcctcggccgcctcgtcggcgctcatctgttcgaaatcgcgggtcttcagccgctcggtcgcatcccaggtcaggctggcatcgatccgggtctcttcgcgcagcttctcttccggcggcgggggcggcggcggggcatcgccggcaaaggcatcggccagacggcgggccagcttgcggccgtcgggggttcgctcgctttccacctgcggcagcagcagcgacagcaggcgctctcgcagctgcggatcgcgccagaacacgtcgaaggcctgttcgaacagcggcagatgttcgcgccgcttgaccagcgtcgccttgagcgccgcatgcacctgggtgcgcgaggccatgtcgacggcagccaccgccgcggctgcaaccagcacgtcgcccggaccgatggcgatgccggcccggcgcagcagtcgcgcgaagcggccgatattggccggcaggcggccgctggtgccgtcctggatcaagccggtctcgtctcatggctgcgcgccgccatgtcggcgcgagtctcggccagcaggcgggcggtttcggcgccggtcatgcgggcgatgtcgtcctggtatttcagcagcacgcccatgctgccgtcgatcagcccggggtcgaggtcgacggcatccagctggaccagggcattggcccagtcaagggtttcggccacgccgggggccttgaacagatcctgggcacgcagccgctgcacgaagccgacgatctgggcggccatcgcctcggcgaccgcgggcgtcttgcggcggatgatcgccacttcgcgcgcggcatccggatagtcgatccagcgatagaggcagcggcgcttcagcgcatcgtggatctcgcgcgtccggttcgaggtcacgatcacgatcggcggggtctcggcccggatggtgccgatctcggggatggtgacctggaaatcggccagcaattccagaaggaaagcctcgaagggctcgtcggcccgatcgatttcgtcgatcagcagcactggcgcgccggcagggtccgggctgatcgcgtccagcagcggccggcggagcaggaagcgttccgagaacagatcatccgacaggcgctcgcgcgcgccggcctctcccgcctcgcccgaggcttcggccagccggatttccagcatctggcgggcatagttccagtcgtagagcgcctgcgcctgatccagcccttcatagcattgcaggcggatcagccggcggcccagggtcttggccagcaccttggcgatctcggtcttgccgaccccggcttcgccttcgagcagcagcggccggccgaggcgcatggccaggaacagcaccgtcgcgagcgcctcgtcggccacataatcgccctgatcgagcagggccagcgtgtcggcgaccgaggcaggcagcgggacggggaggggaagagcgtcaagaccggctcctggaaaggatgggatggacaggcgggcaggaagctacgacccgtaatctggcgcgcggatctgtgcgcggcaagccgtcacgacatgcagagacggcagcacgggcacgtcatccgtgcccgtgctgcccgctatggcgtcgctgcgtcggtcttggggtcagccgagggccgccgccaccgcgcgctttgcgatcacgccgatcagatgggcgcgatagtcggcgccggcatgcatgtccgaattcagcccgtcggccggcaccgtgatgccgtccagcgcctcggggcggaaatcggcggcaagagcggcttccatcgcttccacccggaagaccgaggggccggcgccggtgaccgcgacgcggaccgagccgtccttcgcccgggccacgaacacgccgaccagagcgtagcgcgaggccggattcgggaacttcacatagccggccttctcggggatcgggaagcggacctcgcggatgatctcggccggctccagcgcggtttcgaacatgccgacgaagtagtcgtccgccggaatgctgcgctggtcggtgacgatctcggcgccgagcgccagcgccgccgccggataatccgccgccgggtcgttattggccagcgagccgccgatggtgccgcggttgcggacctgggcatcgccgatatgcgaggccagatgcgccagcgccgggatcgccgccttcacctcgtcggagcggccgacggcggcatggcgggtcatggcgccgatgaccagggtgtcaccgtcgcggctgatgccggccagctcggcgatgccgttcaggtcgatgatgtccgacggtgccgccagacgctgtttcatggtcggcagcagggtcatgccccccgccaccagcttggcgtcctcgttggcacccagcgcctgggcggcgtcggcgaccgacgagggacggtgatattcgaatgcgtacatatcggtgtcttccccgatgacgtcccggtaacccggcgcggggcgccgggtcaggaggtgttcactcggcagcggcgggcatgcgcgccgcctggatggtcgaccacacccggtgcggcgtcgccggcatgtccatgtcggtcacgcccagcggccggagcgcgtcgatcaccgcattgatgatcgcgggcggcgagccgatggcgccggcctcgccgcagcccttcacccccagcgggttggtggtgcagggcacctcgttatgggcgacggtgaagctgggcaggtcgtcggcgcgcggcatgcagtaatccatgaacgagcccgacatcagctggccgctgtcctgatcgtagatcgccgcttccagcagcgcctggccgatgccctgggcgatgccgccatggacctggccttccacgatcatcgggttcaccacccggccgaaatcgtccaccgccacgaagcgcttgatctcgaccacgccggtatcgggatcgacctccacctcgcagagatggcagccattgggataggtgaagttcacgggatcgtaataggcgctctcatccaggcccggttccagcttctcgtgcgggtagttgtgcggcacataggccgccagcgccacctcgccgatgccgacccccttgtcggtgcccttgaccgagaaccggccgttctggaactcgatatcgccttcggccgcttccagcagatgggcggcgatcttgcggctcttgtcgatcaccttgtcgatggccttgaccagggccgagccgccgaccggcagcgagcgcgagccataggtgcccatgccgaaggggatgcggtcggtgtcgccatggacgatctcgacctgcgaaagcggcacgcccagacggtcggccaccacctgcgcgaaagtggtttcgtggccctggccatggctgtgggcgccggtgaacacggtgaccgatccggtcgggtgcagccggacttcagccgcttcgtagaggccggcacgggcgccgagctggccggctagtgcggagggcgccagaccgcaggcctcgatataggtcgagacacccagccccagatacctgccgcgcgaccgcgcctcggccttgcgggcgtcgaggccggcatagtcgatcagccgcatggcgtcgtcgagattcttgtggaactcgccgctgtcgtactgcaccgccaccggggtctgatagggcatcatgtcggcggtgatgaagttcttcttgcgaagctcgatccggtcgatgccgctttcggccgcggccttgtcgaccaggcgttccagcagatagcaggcttcgggacggccggcgccgcgataggcgtctaccggcgtggtgtgggtgaaggccgatttcacctcgcaatagatcgccggcgtcttgtagagcccggcgagcagcgtgccgtaaagataggtcgggatcgagggcgcgaaggtcgaaagataggcgcccagattggcgaccgtctcgacatgcaggcccaggaaattgccgtcggcatccatcgccagccgggcgcggctccagtgatcgcggccatgggcgtcggtcatgaagctttcggtgcgctcggccgtccagcggaccgggcgttccagctttttcgccgcccaggtgacgatggcctcttcggcatagtgatagatcttggagccgaagccgccgccgacatccggtgccaccacgcgcagcttgtgctcggggatctgcagcacataggcgcccatcagcaggcggatgacatggggattctggctggtggtgtagagcgtgtactggccgctcgccggatcgtaatcgccgatcgccgcgcgcggctccatggcgttggggatcaggcggttgttgatcagctccagctccaccacacggtgggcattggtgaaggcggcctcggtcgcggcccggtcgcccagttcccagtcgtagcagagattgcccggggcctgatcgtcccagaccgaggcggcgccatcggccagggcccggcgggcatcggccaccgcgggcagttcctcatagtcgatggcgacgtcttcggcggcgtccttggccagttccttcgaggtcgcgatcactacggccacattgtcgcccacatggcgcacccggtcgggcaccagcggcgcatgcggcggctccttcatcggcgagccgtccttggaatggaccagccagccgcagggcaggccgccgatgccgtcggccgccatgtccttgccggtgaacaccgccaccacgccagggcgcgccagcgcggccgaagggtcgatgttcaggatcttcgcatgggcgtgcgggctgcggatgatataggcataggtctgccgcgccagctggatgtcgtcggtataacggccgcggccggtcaggaagcgccggtcctcggtccgcttcaccggcttgccgatcacctgttcggtcatctcgtcctcactcctcccgtcgcccggcaggatctttgcccgccgggtctgtcctggcggatggcggcggtcagccgcgcatcgtctccgcggcggactgcacggccttgacgatgttgtgatagccggtgcagcggcagatattgccttccaggtgcttgcggatctcggcttcggtcgggttcgggttgttcttcagcaggtcgaccgaactcatcaccatgcccggggtgcagaagccgcactgcagcccgtgttcctgatggaaggcttcctgcaccgggtgcagcgtgccgttggtggccaggccctcgatggtggtgacctcggcgccctcggcctggaccgccagcatggtgcaggacttcacggcattgccgtcgacatggacgacacaggcaccacactggctggtatcgcagccgacatgggtcccggtgaggccgagatggtcgcggatgaattgaaccagcagggtccgcggctcgaccgagcgttcgacacgctcgccgttcaccgtcaggctgatctggaccggcatgtataacctccccatcggtcggtagacggacagccgcacacgcaaggctgccgcaggtcacgcggtgccggcccgggcaggccaggcccaaaggcggacggggagaggggcggcgacattccggcggcgaacgtacagccgcgcgatcgaccaccgcgatggcgggaacgcgcaggggcacggctggggccgcatgggcggcgggacgaccgtcatcccgccgggtgttcctgactcaatcctcccccggtccggggccgggggtcttcccccttgttcgctccgatccggcaggaagagtttggcgccgccagggccggccggtcaagggtgatggcgggggaaaccggcgggaaaaaacggcggatttatgccgcactgcaccaattgcgaccgggtttgagaccggctcgccgcggttcaactgaacgtcggtcagtatccgcgggtccgttccaccgggtcgagcggcggccggccggcggcatgtcggcgcaggctctcggccaggatgggcgccatggtctcaggggtgctggccgccgcgacatggggcgtgagcacgatcttcggatgcgaccagaaggggtggccctgggggaggggctcgaccgcggtgacgtcgagcgtcgccgaggccagccggccgtcgtcgagtgcggcgagcagatcggcttcgaccacatggccgccccgggcgacgttcaccagatgcgcgccttggggcaggcgggccagcagcgcggcatcgatcagcccgcgggtctcgtcggtcaacggcagcaggttgaccaggcagtcggtgccggcgatcagccggtccagcccctcggcgccggacaggcaggtgacgcccgccacctgcctggcgctgcgcgaccagccggtgacggtgaagccgaggcctgccagcgcctgcgccgccgcggcccccagttcgcccagccccagcatgccgaccctgagcgcgccgcccggcacgctccgctcttcccacagaccggcggcctgctgggcgcgatagccggccgcatcgaccgaaaccgccagcacggcatggaccacgaagcgcaccatctctccggtcatcgccggatcgaccgcccggccgaggacgacatggtcgccgatcgccggatcgttcagcagatgctcgaccccggcccccagcgactgggcgagaccaagccggctcatgcccgcaagcgcacccgccggctgcttccagagcagcaccgcctcgatctcggacacatcccccagatcgggccagagcctgacctccagccccggcgctgcggccatgagcgcccgctgccagcgcggctggtcccagccgggcgcaatgatggcggtgacgggcaggcggggggtggcgctggttgtcatcgtatgcaggctccggcaggggagagacgcaagggggaaggcggcgcgcagcatagcgcgccgtcgccactgccgtcaccctcgtgacccgataccgttcaaagcctgaccgcagccgcgacgaggaaggtgatcaccgaccagcccgcatagaccagcgtctgcacccagggcttccgccgcattccgggcctgcccgcaactgcctcgtcccagggcccggtgagcagacgcgccacgaccatatagatcaacatcccggcgaaatacggcgtcagcgcctcgcccgttatcagacgcccccaccaggcagaccagaccatcagcagcacggccaaagcaaggacgaggtattcaggccaggagaggcgggcaggcgtaaacaaggtcttaagggcgcgccacatccgggtggcccctttgtctgagcatctgggcgagcaacgcagtccgggcgggcaagctttcagcatccatcaaaatgccagccgcaccacggcggccgccaccaatgtgaccgccacccacccggcaagcacccgcgtcttcacccagggctgccgctccgaaacgccccgccgcagaagcatcgccttgacgaccagaagataaaggcagaaccccgcgatatacgccgccccgatctcgccgccataaagcggcgtccaccaaacggcgaagacgccgacgatgcagaggagcagggaggtgaggcgttcgggtcggaagcagaggttgtgggccatgactcaattggcgttctttatgagaaggataatcgcccttttggagaaattccgggcgtggcaaaattcggacgcgcaccgctcactgacgagggggaccacgtgacgcccggtgtcacggctttgcgttccccccgccccgcgctatcctcgacacgacacccaatcccgaggatgccgcccgacccatgtccgagcccgtctccgcctatcgtgtgttgatcgtcgacgaccattcggtggtgcgggcggggctgaggcatctgctggcggaggtgttcgatccggtcgagatcgtggaagcgaacggcctggcggcgctggaggcgctgctcgacgagggcatgcggttcagcttcgcggtggtcgatctctatctgccggatttcctgggccaggaccggctggaccggatccggcggcggctggagccggcgccggtggtggccttcaccatgtcggagagcaagtccgatctgcgggcggcgctggcggcggggctgcgcggctacattccgaaatcgacccatgacgaggtgatcatcggcatcctgcggatgatccaggtcggcggcacctatttcccctatgaactgctggcgcgggatgccgaggcagaacgcgggcccgcgccgatcccggcggctgccgtgccgattgccggggatatcggtcaggctgaggcgggcgagggcgaaagcggtgccgcgctcaccgagcggcagatggagatcatggacctgctggcccgcggtcattccaaccagcagatcggcgatctgctggggttgaacctcaacaccgtaaagggccatctgtcgcggatcttccgccagctcggcgtggagagccggacccaggcgatcctgaaatatcagcgcatgcgcggcggctgacggctcagctgccggtcgtggggtccagccggtcgcggagatggtcgccgatcaggcagacggacatggtggtggccaggatcagcagaccggggatcaccgcgatccaccaggcattgagcagcaggccgcgaccatcgccgagcatctggccgagcgatgtcgccggcggctgcacgccgaggccgaggaaggagagcgcggtctccagcaggatcgtgcccgggaagttgagggtggcctgcaccaccagcggcccggcgacattgggcagaacatggccaagatgcagacgcgtgccggtgatgccggtcatccgcgccgcccgcacccagccggccgagccggtggcgagcaccagattgcgcgacagccgggcatagcgctcccagccgtcgagcccgaccaggatcacgaacagcaccagatcgttgccgagaaaggcgatcaccgccagcgccaggatcagagagggcagcgccgcctgcacgtcgaccagcatcatcagcagctggtcggccaggccgcggaaacgggcggcgaggaagccggcgcaggtgccgagcaccgccccgatcgccgtgccggcgaccgcgatcaggatcgacacccgggcaccgtagagcacgcgcgagagcaggtcgcggccgagcgcatcggtgccgagcggatgggcgagggtgccgccgaaacctgccggcgggcgcagccgcgcacccagatccatggcgagcggatcggccggcgccacccagggggcgcagatcgcgagcaggacgagtgctgccagaaagcccagggcgcagcggatcgaccagggcaggccgcgaccgtgcgccggcttcccggccttgagcggccggaacaaccgatgcagccggccggctgcgggcagggctgggatcggtctcatcggcgggcctctccggcaagggcggcgcgaacccgtgggtcaagccgggcatggagcaggtcggcggcgagattggccaggatcatggcgagcgcgatcatcaggatgatggtctgcaccaccgccaggtcgcgggccgccaccgactggaccagcagccggccgacccccggccagccgaagacgctttcgaccaccaccccgccgccgaccagcagtccggcttcgaaccccaggaaggtgatcaccggcacggcggcattgggggcgagatgggccgcgaccaggcggatgcggccgaggcgcttgccgcgcgcgaccctgagatgcagctggcccaggacatcgagcacggcgccgcgcacgaaacgggcgagcttgccggccatggccgtgccgagggtcagcgccggcagcaccagatgcgccgcggtgccgaagcccgacgacggcaacaccctgagccagagcgcgaagaccaggatcagcaccagccccaggaaaaaattcggcatcgcatagccgaagaccgccacccccatcgcgccccgatcgaccggcccgccacggcgaagggcggcgatggtgccggcggggatgccgatcagcaaggcgagggcgaaggcggtgccgcccagcagcagggtcgccggcagccgttcggccaccacgcccgcggcactgcgcccgtcgagcagcgagcggccgaaatcccccgtcgcgagcccgcccagatagcccagatactgctcgtagagcggccggtcgaggccgaggcgggcggcataggcgtcgcggatgctctgcggcgcatcctcgggcagcagggcatcgagcgggtcgcccgacagccggaggatcacgaaagtgagggtgatgcagatcagcgcggtgaccagggtgcgggccaggcggatcagaagggcgcgggacatcgcggatcaggcctcggccggagggggaaagtgacaggcggcgagatggcgcgcggtcgcgcgggctgagggttccgggcgttgccggcggcagatgtcttcggccagcgggcagcgcggatggaaggcgcagccggtgggcgggttcaggatcgccggcggctccccttcaaggcgcaggcgcggccggcgcagccccggatgggcgaccggcacggcatcgagcagggcgcgggtatagggatgggcgggggcgccgaacaccgcctcgaccggcccggtttccaccacccggcccagatagagcaccgccacccgatgggccagatggccgaccacgcccagatcatggctgatgaacaccatggcgaggccacgatcccgggccagcgccgccagatgattgaccacctgcgcctggaccgagacgtcgagcgccgagaccggttcgtccagcaccagcaccgaggggtcgaggctgagtgcgcgggcgagcacggcgcgctggcgctgcccgcccgagacctgatgcggccagcggtcgagcagggcgggatcgagccccatggcgtcgagcgccgcagagatgcgccgacgccggtcggccgggggcagccccgccactgccagcggctcgtccagctgccggccaagggtcatgcgcgggtcgaaggcgccgagcgtgtcctgaaacaccagctgcaccgcccgccgccgggccggcggcaggggcagggtgagggccgcgccgtccagcagcacccgccccctgtcgggcgcaatctcgccggccagcatgcggccgatcgtggtcttgcccgagccgctttcgccgaccaggcccagaatctcgcccggcgcgacctcaagatcgatgttcgagacgatcgcggcccggcgcggccgggtaaagaggccggggtcgcggtgccgcacatccaggccgagcccgcgggccatcagccgcggtgcggcggaggtgagggcaggcatagcggcgggccgcgccgccgatgtcgtaccgggaagcgtggtggccggggcggtcatgccggcaccccacaggcaaccgccccgccgcccgcagccggaagaagtttcggcggcatcattgagcagctttcggttgcgcgacggcagcgcggagcgaagtcgcagccggaaccgcgccgcccgggccggggcaccatgccgggaatggcggcaagagggctgccgcgcgcctgaagaccgggccgacaggccagaagttcggcggtatagggatgggcaggggcatcgaagatccggccgaccgggccctgttcgacgatccgcccggcatacatcaccgccatctcgtcggcgatttcggcgaccacgcccaggtcatgggtgatgaagaccagccccatcccggtttcggcggcgagaccggtcagcaggtccaggatctgggcctggacggtgacgtcgagcgcggtggtcggctcgtcggcgatcagcagggcggggcggcaggcgagcgccatggcgatcgcgacccgctggttcatgccgccggagaattcatgcggccaggcccgggcccgttccgccgccccggcgatgccgacccgttccatcagccggaccgcttcggccatggccgcacggcggctgagccccgcctgtgccaccagcggttcggcgatctgccggccgacggtcatcagcgggtcgagcgaggccatggcatcctgatggaccatggcgagcccggcaggggtggggccgcccgggcggaagggccggccgtcgatacgggcggtgccggataccacccgggcgccggccggcagcagccccatcagtgccagtgccgtcaggcttttgccgcaaccgctttcgcccaccagacagaacacccggccgcggccgatggcgaggtcgagccccgccaccgccgggccgcccggcacgtcgatcctgaggttttcgacggtgagtgcggtcatgcgaaggacaggttgtcggggcggaggtcgagataatagagcgggtaatgggtccagttgaccggccggcgcttgccgtagacctcgttgacgccgtaaagcaccacccccggcgcctcttcgtcgaagaggtcgagcaggtgctggaagatccgccggcgatcggcggcgtcctgcgcggcctgaagctcggcgatcccggcattgaaccggtccgacgaccagaagccgcgcttctgcaccgccgaatccggcccccaggccggcaccacgccgccgcccagcggatcgggaaagcggaaggcggccgagatcatccggacgtcggccccgggttccagcgcctgtttcatgctttcgacgaattccagctccagcggcacgccgatctgcgcccacatcgcctgaatgatctgcccggccgcttcggcgccgacgtaatagcccgagatcaggcgcatgcgcacgggcgtgccgccatagccggcctcggccagcagcgccttggcgcgggcgggatcgaaggggaaatgccggcggtcggcatcatagagcggcccgaaggcgggggtctgcaggccgttcggccggctgaaccgttcgccccagactgcgcggccgagcgcatcatagtcgatggcgtggttcagcgcctggcggatgcgggcatcggccaccgcagggcggcgggtgtcgtagaacagcatgtgcaccagatcgagcggtaccgccaccgcctcgacatcgtcatagccgtcgagctgcggcatctggtcgggcagaagattggtgacgatgtcgtattcgcccgagatcagcccggcgatccgcgttgcggcctcgggcaccacctcgatgcgcacctcgcgcgccgccggccgacccatccagtagtcgtcatgagagctgagcaccagccgggtatcgcggacgaattcggccagcttgtaggggccggcaccgaccggggccgtgcgcatggtctcgggcccgccggccgccatcgcctgcgcgcccacgatccaggcaccataggcggccaggcgctgcggcatcaccgggtcggggttccgggtgacgagatcgaccgtcagcgcgtccaccgtccggacctcggccagatggccgaacaggatccggccctcgggccagggggtctcggggccgatccgggctggagcgaaggtcgccgcgacatcggcggccgagagggtggtgccatcatggagcttcacccccgggcgcagcgtcatccgccaggtgaggtcgtcgacgcgggtgacggcggtggcgagctgcgggtcggtcttcgccgtgccgggcgtggcggcttccgccctgaagtcgcgccggagcgggctgtcgaacaggcaggtggtctgacgcaggccgatattggagatggtctccagcggctccagactggccggcagggcctgaacggcgatgcgcagaaccgggcgcggatcagcgcctgccgcctgcaccaccgacgagaaggtgccgggcagggcagcagtggcggtgccggcgccgatcaggcgcagcaggtcgcgacgggtgatggtcatggcgggaaggcctctcgtcggattcagatcggatcgatgcggatctgtgagatacggataagggaggtgctgatcaggcagggccggcgcgtctgagcgcccggacggccggataggcatcgtcatggtcgagcaggtcgttctccggcaggctggccgggtgtcggaaatccaggcgatggtggccgtcttccagcgtcagcatcgcccagccgacccgcttctcgccgatccgctcctggatgtgatcgggaatgatgaaggcggtggagggcatccacagatgctctaccccggccagcatcagccgtcgggcctggtgggcgtggcccgagatcacgaagcgcagatcgacgcccgccagcagatccagcagccgggcgcgcgggcccgccggcacatagcggacatgggcctcgtcatcggtcgggccgtcgcggaacagcggcttgtgcaggaacaggcccgtggggccgcgggcggcggcgagcgctgccgccagccagtcgaactgtgccgcctcggcggccagctccgtgccgaagagctgggcattcagcccgatcagccggaaacccgccgcctcggtcacccagtgatcggggccgaaagcggcctcccaggcggccaggcgcgggggcgtcaccgggctcgacacataggccccgggatggggcgggttgtcgcccagatcgtgattgccgggcacggccagacgcggcgccgacagcgcctgcagggcgtccagggcctggacgtgctcggccggatcacccgcgccgtcgacggtgacgtcgcccagatggatgatcagatccgggcgctctgcctcgatcagccgggcggcgacgtgccagttggcggtgaagccgcgggcgcgggtggcgatatgcgtgtcggaaatcagggcgatgcgcatgggcgcgaacctttcggccggtcagatccttccggcccccggcgcagcctgacgtatgcggccgcagcgaggtgacgcgccgaccataagcggtcatgatgtcatccgcgtgaccggcttagaacggcgcccgaaagccgtcatcgaaccgtcgtgaagagcatccggccccatgcccatcgaacctgcatgtccaccgaactgaccacggcccgcatcctgcaggtgaccgagcgcctgatggcgaccgcggatgatcccgatcggatcaccgtgcgccgcattgcggccgcggccggggtggcggtttcggcgatcaactatcatttcggatcgcgtgaggcgctgatggtggcggcgatggcgcgctgctacacccgcttcaatgccgagcgactgaaccagctgaccgcggccgtggatgccgcccggccgtcaccgccgccgctggatgcggtgctgacggcattgctggagccgtcggtgcgctggcgttacgacccgggctcggactatcgcgtgttcctgaacttccgcgccatcacccgccgcagcgcagatccggcgctgggccgggcgctttccgaagaggtcgaccatctgcggctgttcctggatgtgctggcccggatcgccccgcatctgaaccgggcggaactcggctggcggctgcatgccacactgggcatccgcgacaacgtgctgcgcaaccgcacccggctggtggctctggccggtactgccatcgaccccgacgacccggcgcgggttctggccgaactggtggcgatgacccgctgcctgtttctggcgccggcgggtggggtaggccggagtatgcggcggtgagcggaggcggagacggcgggacgcgatgatgttgtcacctgaccgaatctccgattgaatcaccggggccggaagtgcgtcaccgccgtcgggaggccccatgtcgaacgtcttcatctcgcatgcatcagtggacaagcccttcgtgctgcggctggccgtggggcttctcgcaaagggcattccggtctggctcgacaagtggagcatcacgctcggcgattcgctgctcgatgccatctatgacggtctggagcggagcggttttgtcgtggtcgtggtgtccgacgcggccatccgctccggctgggtcaacagggagctgaatgcggcactggcgcgggaagagcagaccggccgccgtttcgtgatccccatccggatcgacgacacgaatatgccgctcaaggtggcggaccggctttatgcgaatttcgcgacacgcggcttctccgaagctctggaggatctggcccgggtgctcgtctcgaaaggcgctgccgacatggcggtcccgccggagcgggaggtgctgcccttgcgcttcacccggccggtcgatctggacgcggcggtattggaggcaagttggaagcatatgcgccgacgccacccggaccttgtgctgtcgcctgaccagatcgctctggtcgaggatgaggactacggatcattgcgccggtcgctgcatcaccgcatcgacgggattgcgcaagacccggattacacgcccgaagtcgaaagacatctgaaggacatgaatgacctggcggcccggctggaggttgtgctgcgggcgggggtcgcggagctgttgaaccggggcaaggagatcgacgcggtcctgtggtttgcgaagatcatccgggcgcgcgcgctctacaggctgtggaccaccagaatggttgcgggcggtctggggcaggactggaaaattgccggtcttcacgatcgcacggatgcccgcgactttttcggaacggacgagctggcgctcgtcgatctgtggcgggacggggatcggaacggatacttcatcctctggctgccgcggcgcgacctcgcggacctgtaccgccatggtcggccgcagcgctattatgacggctccccgacgatgatgtcggagcacatctatgtctatccgcagatgctggcagagcatctctgtcatccgctgaagacccgcgagccggtctgggatctgtcggaggcgatgatcggcctccactgatcgttcccgtgcccacacgtcaggtgccttcgtaaagccgcggcgcgcgttcccagatcagcagggcggtgcaaccggtgtcgctgcgcaccttgtgttccgtgccgggctcgttgaccaccagcgtgccggtgtcgtaggtgccggcatcgtcgctctggcggccttccaggatcaggatggtctcgcggccggtatgggcgtggcgcggcacgtcggatccgggggcgtagcgcagcagggctgccgcaggtccaccatcggggctgcggtgcagccagtgggcctcgacacccgggcggaagggctgccagtccagcgccgcgcgggcggcggggtcgagcaggccggcgcggagcacggcgggaagatcggcggtcatgtatcggccctcaatccggcaagcacggcatccaccggtgccgcccagccgacgatgccggcctgggcggtgatcatggcgacggtcgcggccttgaattcggggaaatagctgtcggtggcgtcggtggcgagcaggcagtcgaagccgcggtcattggcctcgcgcatcgtggtctgcacgcagacctcggtggtgacgccggcgaagaccagatggctgatgccgcggcgggcaagctcgtcacccagagatgtcgcgtggaaagcgcccttgcccggcttgtcgatcacgacctctcccggcagcggcgccagttccggaatgatgtcggcgcccggctcgccgcggatcaggatccggcccatcggccccggatcgccgatccggagcggccccggcccacggccatgcttggcaggcgggcagtcggaaaggtccggcagatggcattcgcgggtgtgaaagacgggaagccccgccgcgcggaagccgtccagcaggcggcgagtcggcgcgatggacggccgcacccgggcgacatcattgccgagcgaggcaccgaaaccacccggctccagaaagtcgcgctgcatgtcgatgacgatgagcgccagccggtcggcggacgccgtgaaggcgtaaggggcggcatcgatggtgatggtaaccggcatggtgtggcagggctcccgtcagtggccggccatgtggcggccgatcgccacgcggtcggccgtggcgccggccgtctcgtggacgatgcggccgtcggagatgaccaggatccggtcggccagttccagcagttcgtccagatcctcgctgaccagcagcaccgcggcgccgcgattgcgggcgccgacgatctggccgtggatgtcggccaccgccgagaaatccagcccgaagaccgggttggcggcgatcagcacctcgacctcgccgccgatctcgcgcgccagcaccgcccgctggacattgccgcccgacagcgctgcgatcggggtgtcgggcgatggcgtgcggacgttgtagcgggcgatcagttcccgcgccgccgcccggatcctgcccttcgacaggaaccagccgcgggcatagggcgcctgatcgaagcggcggaaggccatgttttcggcgacactcatgcggccgacgcaggcattcttcagcggctcttcgggcagcaggcacaccttgtggcgcagcatctgtgcccgctttgcggcatagggcgcgccgtcgacggccatgtgtcccgcctcggcccggcgctggccggccagcacctcgaccagggcgctctggccattgcccgacacgccggcgatgccgacgatctcgccgcgtcggacctggagcgagacgccgcgtaaggtgggttcgccggtatcgtccagcgcttccagatcgcggatgtcgagtgccacctcgcccggggtgcccgcaaggcgggcggccggtgccgccggtgtcgcctcgccgatcatcatggccgccatccggtcgacatccagatcggcgacccggccgccgccgaccagccggccgcggcgcagcaccgacacctcgtcggcaaaggccagaacctcgcggaatttgtgagtgatgatcaggatggtcagctcccccgcccgcgccatgtccgccagcaggccaagaatgtcgtcggcctcgtcgggggtcagaaccgaggtcggctcgtccaggatcaggaagcggacatcgagccagatctgtttcaggatctcgaccttctgcttctcaccggcggcaagcgtggcgacgggcgcatccagcggcacccggaagggcatgcgggccatgaaggcttcggcctcggcgcgcgccgccacccagtcgatgatcgcgggcgtatccgcccgggccatcaccaggttttcgagcacggtcatgcccggcaccagggtgaagtgctgatagaccatgccgatgcccaacgcatgggcctcgcgcgggttggaaatcggcgtttcgcggcggccgacgatcaccgccccctcttcggggcggtaatagcccatgatgcatttgaccagggtcgacttgccggcgccgttctcgcccagcagggcatggacgctgcccgggcggacccgcaggttcacgccgtcgagcgccgtgaaggcgccgaagcgcttggtcatcgccacggcttcgatgccgagcgcccggatctccgggccgtcatcggccccgatcggtaccggggcgtccggtaccgcttcgatctctgccgccgtactcatggcagagcctcgatgaaggcggtggagctggagaccgagccgaaaacgccgccctgcatcttgatcatgcggatggcatgatcgtgattggcccggtcggtggcgccgcagcagtcttccagcagcaggcattcgaagccgcggtcattggcctcgcgcatcgtggtgtggacgcagacatcggtggtgatgccggcgagcacgatgttgcggatgccgcgggtgtgcaggatcagctccagatcggtggcgcagaacgatcccttgcccggcttgtcgatcacgggttcgcccggcagcggcgccagttcggggatgatttcccagcccggttcgtcgcgaaccaggatccgcccgcaggggcccggatcgccgatgccggcgccgatgcgctgcgaccgccagagcttgttggccggcaggtccgacagatccgggcgatggccttcgcgggtgtggatgatgtgatagccccgggcccgcatcgccgccagcaccgccccgatcggcccgatcggcgcccgggtcagcgacaggtcgtagcccatcttgtcgacatagccgccgaccccgcagaaatcggtctgcatgtcgatgatgatcagcgcggtgttggcgggggcaagcctgccgtcgaagggccagggatagggatcgcccgggatggtgtggagatcggtcacggtcattctggacatcctcggttcaggcgagcgtggggcgggatcagcgggtgaccgacagctcgcccggcgcgccggccaggcggcggcgcgaggaagaggcgaggaccatgatcaccagggtcagcagatagggggcggcgttgaacaggtagtagccctgggtgacccccaccgcctggagcgcggggccgagcgcgctggcgccgccgaagagcagcgcggcatagaagcaccagatcgggttccagcgggcgaagatgaccagcgccaccgcggtgatgccctggccgctcgacaggccttcattccagctgccggggtagtagagcgacaggaaggcgccgccgacaccggccaggaagccgcccgtcatcgtcgcccacatccgcacccggtcggggtcgtagcccatggcgcgagcggcatcggcgctgtcgccgaccatgcggatgatcagcccccagggggtggcgcggaaggcccacagcatggcgaccgccagcagggcgccgatcacgaagagcacgttcacctccagcgccgcgcggatctgcggcacctcgctccagaagcccaggctgatcgccggcagatgcggggcggtgggctggatgaagggcttgcccaggaagaaggcgaggccggtgcccagcagcatcagcgcgatgccgaccgcgatgtcgttgacccgcggcagggcgcagatcagcgcatgcagcaacccgaaggccgtgccggcgaggcccgcgaccagcacgcccgcccagggcgagccggtgagataggcggtgccgtagccgctcatcgcgcccatcaccagcgtgccttccaggccgagattgatccggccgctcttctcggtcaggcattcgcccaggctgacgaagaggaagggggtggagatgcggatcgcgcctgcgatcaccgccagcggcacgccccaccagcccagagccgcgtcttccatgggatcaggcctttccggtggcggccggtgccgcgggggcggcgttgcggcggcgggggagagagggcaggcgcagccggccatagagggtttcactggcaagcagcaccacgaacaggatgccctgcagcaccagaaccgtggcgtcgggcaggtccagccggcgctgaagcaggccgccgctggcaccgatcccgcccatcaggatcgcgaccgggatgatggcgagcgggttctggcgggcgaggaaggcgaccagaatgccggtgaagccataaccggcggcgagcgtggcattggcacggccatggacggccgcgacctcgaccatgccggcaagtcccgcagcggcgccgccgatcatggtcacggcgacgatcagccacccgaccggcaggccggcggcgcgcccggcgcggacattgccgccgaccatgcgggccgcgaagccgaaggtggtcttgaacatcagcacccaggcggccaggcagaagaccacgccgatcacgaagccccaatgcacgtccatgccgggcatgtcgccgatcatgaagccatcgccgatcgcgggggtggagggcttgttcaggctggccgggtcgcgcatcggcccttcgaccatgtggttcagcaccgcgattgcgatatagaccatcagcaggctggaaatcgtctcgctgacgccgcgggcatggcgcagcccgccggcgacgccgatccagaccgcaccggccgccatgccggccgccgccatggccagctgcaccaccagcaccggtgccccggcatcggccagcggcaggccggcggccatggccgccagcccgcccagcaccagcgccccttcggcgccgatcaccaccagccccatctgggccggcagggcggtgcacagcgccaccagcagcagcggggccgcacgctgaagcgtgttctgccacgagaaccaggtgccgaaggcgccgcgatacatcagctgatacagctcgatcggatccacccccaccgccgccacgaaggcgccgaacagcaccatgctgaccgcgaccgccaacacgggaatggcgacggcctcggccgcctgccggagtttcgggtctgacatcgtccgggcctggagcatggcgctgtgcgacttcctgacggcgatggaagaggatgcgggggggagggggcgagttggggggagggggccgatcaggcggtggcgccgatcaccccctgaccaggtagtccatcttttcaagcgcgatgtcggtctggccgtgggtggtgccggcggcgatcacggtgccgcccttgttgtccctgatcgggcccttgaagatcgcgaaatcgccggccatgaactgcgccttgaccgcatcggccgcggcgcgcccggcctcgggcgccgcggcaccataggccgaggtcttgacgatgccctctttcagcccgccgcgaaccagcgacgggatgtcggtgccggccagcacgtccttcacgaagcggggataaaggctctcccagttccattcggcgccggtgagatagcccttgggcgccagcggcgcctgggtggcgtgatagccgcaggtgaacatgccccggcgttcggcggtctccaccaccaccttggggctgtcgacatggcaggtcacgacatcggcgccctgatcggccaggctgttggtggcctcggcctctttgaccggcatcgaccagtcgccggtgaagatcacctgggtggtgatggcagggtcgaccgagcgggcaccgagggtgaaggcgttgatgttgcgcagcacctgggggatcggcttggcggcgacgaagcccagcttcttcgtcttcgaggcatgaccggcgacgatgcccgacagatattgcggctcgtcgatataaccgaaatagctgtgggcgttcttggggtgaccctcggcccagaggccaccgcaatgcaggaaggtcacctccggatacttctccgccatcttcatcacatgcgggtcgtaatagccgaaggaggtgggaaagatcagttcggcgccgtcgagattgatcatgctctcgatggtcttctgaacctcgatcgtctcgggcacgttctcttcttcaagcaccgtgacgttcgggaaggcggccttcaccgcggcagcgccctgggcatgggcctggttgtagccgaaatcgtcgcgcggcccgacatagatgaagccgaccgtcagcttaccggccgccagcgcccgcctgaacggcaggcccgcagtggcgccgagcacgccgagggcgccggcgcccttcagcagcgtgcggcggttgaggaaaagatcatgggccatgacgagagcatcctcctcgggacgggcgggctgtggggccggacgggcgatgggggctgatcggccgtgtctgatccgccgtccgcaagccgcgtgccaagcgcctctgtccgtcgcaatggattgattcaaaaagaagaagccgacagttgcgccgtcaacacagaggctgaccgcatgtgtttgtctattttatgtgcattaattgcatgcaatgattaatttataatcatatatagggatgatgctcgaaatatccggggaagctcttcggaatttttggattaatatattgttttaaaagagaaaaatatggcatttgctgaattggcattttgcatgcaaattcgtatgcagcttctggcccccgcatcagcagtcgaaggcccccgatgaccgatcagatccgacccgccgccgacggcccgccaggcgggctgcgtcgcagcctggctgatacccttgcccgtgcgattgccgacgacatcatcgaaggccgcctgctgccgggcgtgcggcttgacgagcatgaactggctgcccgcttcgatgtctcgcgcacgccggtgcgtgaagcattgggccaggtctgcgccatgggcctggccgaacgccgccccaatcgcggcgtgctggtgatggtgatgtccgaggcccggctggaagagatgttcgtggccatggccgagctggaggccgcggcggcccggctggccgccctgcatatgactggcgccgaacgccgcgggctggaggcgctgcatctggacagcgccgccgcggtgcgggccggcgccaccgacgactatgccgccttcaacacccgcttccaccaggcgatctatgccggcgcccataattcttatctggaggagctggtcgggctgacccgcaagcgcctggcgcccttccggcgtgcccagttcaacgttctgggccggctcgcctcgtcctgcgaggaacatgaccgcatggtgcaggccatcctgcgcggcgatgccgaggccgctgcggccgagacccgcgcccatgtgctgacggtcagcgccgcctccgtcgcctatgtcggcacccgcgcccgcagcaccgccagatccgaccagcccgtttaaggacgtcgcccgatgaccgacaccctgcctgccgccttcgacgttgcccggctttccgccgcctatgccgcgggcgagaccgaccccgtgacggtggtgcggctcgccttcgagcggatccgcgcctggcccgacccggccgtctggatcctgctgcgcgacgaggcggatctgctggccgaggcgcgggcgctgatggcgcgggggcctgcggggctgccgctctggggcatccccttcgcggtgaaggacaatatcgatgtggcggggctgccgaccacggccgcctgtcccgaattcacctacacgcctgaacgttcagccacggtcgtggcgcggctggtggcggcgggcgccctgctgatcggcaagaccaatctggatcagttcgcgaccggtctggtgggcgtgcgctccccctggggggcgccccgcagcgccttcgatgccgagtatgtctcgggcgggtcgagttccggatcgggtgtcgccgcggctgccgggctggtctcgttctcgctcggcaccgataccgccggctcgggccgggtgccggccgccttcggcaacacggtggggctgaagcccagccgcgggctggtcagcgccgccggcgtggtgccggcctgccgctcgctcgactgcgtgaccgtcttcgcccagaccgccgatgatgccgctgccgtgctggatgtggccgccggctatgatccggccgacccctattcgcgcccggccccctggcccgcgggccagcccctgccggcggcgccatcggccttccgcttcggcgtgcccgctgccgatgcgctggaattcttcggcgaccggctcaacccgccgctcttcgcggcgtccgtcgcccggctcgaaagcctgggcggcgaggcggtggagatcgatctcgcgcctttccttgaggtcgcgcgcctgctctatcaggggccctgggtggccgaacgcaccgcggcggtgggcgatttcctggccgccaaccccgaggcaggccatccggtggtgcgcgggatcatcgatggcggccatggcgtcaccgcggtcgaggccttccgcgccatgtaccggctggaagagctgcgcaaggtctgcgatgccgtctgggaggccgtcgatctggtgatcaccccgaccgccggtacgacctacaccgtggcggcgctggaggccgatccggtgcggctgaacagcaacctcggctattacaccaacttcatgaacctgttggactatgccgcggtggcggtgccggccgggtttcgcgatgacgggctgcccttcggcgtgaccctgttggcgccggctttcgccgatcgtcggctgctggcgctgggcgaccggctgcaccgggcagccgggctgaccgccggcgccacggggttgccgcttgggcctgcgggcccgcgcggaccggtggaggccgggcgtacggtcgatctcgccgtggtcggcgcccatatggcggggctgccgctcaatggcgagctggtcgcggccggggcgcagttcgtgcgggcggcgaccacggcgccggtctaccggctgtatgcgctgaaccagctgtcccccgcccggccggggctggtgcgggtggacgagggcggtgccgggatcgcggtggagatctggcggatgccggtggcggcgctcggccgtttcgtgaccggcatcgccgcgccgctgggtctgggcacgctggtgctggaggatggcggcacggtcgcaggcttcatctgcgaaggggcggccgcatcggaggcgcgcgacatcaccggccatggcggctggcgcgcctggatggcgagccaggccgcggcctgatgtcgaagatgcggaggggcgcgtcagccggcgatcagccggcgcgccgtctcctcgtcgtccaccatcggcagcaggtcggccaggcccgacatggtgatggtctggcgcacctgatcctgtacgccgaccaggatcatccggccgccgcggcgggtgaccgccttggcattggccagcagcaggcggatgccgatcgaggccaggaaggcgacgtcggtcatgtcgacgatcacgttcttcgcggcaccgcaggcggtggagacgggcagttcggcagtggcgctgccggcgacgtcgagacggccctcgagcacgatccgggtgacggcatcgtcggatttgtggacggagatctgcatctgggcgtgctcctggtcggaaaggtccggcggatcatgcccgggaatcatgacagtttcatgtcggtattatgtgatgtcgaggtggggagagcgctcagcctcgccgcgccgccgcatcggccaccgccagggcggtgggcgtgttgatgttgaggaagggatcgccgccatcccggcgggccgggaagtcggcggcaaccgcccccaatgcggccagcgccccgccgagagaggcggccctgccgccgccggtggcgcaggcgcgggcggtatcggccagtgccgagaccctgggggccagcgtcagcggccagagcgagaccaccggatggatgcggccgaaactggccgccaccgccggtcgcggcggcccgcccgccggcagggcggcgagcaggccgcgcaccagatcctcgggcagcagcggcgcatcattcggcaccacaagcagagcccgtgggcagggatcgagcgtcgccgcccaggcaaggccggcctcgatgccggcgatcggaccgatgggggggcctggctgatcgatcagcgcccgcagcgcgcccgaggcgcagccgggtggcgcgtcgccggcaatgcgggggagcgtgcgcccggcgcggatgctgatcgccagatggccgacctgcgggcggatgcggtcgatgacatggatcagcatcggccggccggcgagttccagggcgcccttgtcgaccccgcccatccggacggcctggccgccattaaggatcagtcccgcgatctccgtccgtgccgtcatcgcctgtcccttctgcggtgtgcggggcggtgcatgccgtcatcttggcattccccggtcgccggggccagccatccgcgctctggacgcaccagggcaaggccgctatatcacggggatcgtgacgcgccgcgaggggacgacccttcgcccgatatcggcccgggggccgatgtcaggaccggcgcctctgcggggacgaccctgcgcatcactgcgggaggtctccgcgcatgtcctggatcattctcgtcatcgccggcctgttcgaaatcggctgggcggtcgggctcaaatacacccatggcttcacccggctctggccctcggtgctgactgccggtgcgatgacagcttcggtggtgctgctgggcctggcgctccgcagcctgccgctcggcaccgcctatgcggtctggaccggcatcggcacggtcggcaccgtgctcttcggcatcttcgtgctgggcgaaccggcaacggcggcgcgtctggcctgcatcctgctgatcgtctctggcatcgcgggtttgaagatcctggcatctcattgaaattaaattgcgtttttaggctgcggcgggaggtcgcagccccgaacggcctggaacgcagaagaagtttttgtcaagacgtgaactgcgcgggaagggcgcccaagtggatcaatagaggctgcggcgcctcggctgcagccctgatccagatggagaccgatcatgaccaaaggttcgccgaccatcactttccgcaacctcgaccgttccccggcgatcgagacggcgatacacgatcgggctgagcttctctaccgcatgggcggtcgtatcgagcagctccagatcgtgatcgaggcagcgaaccggaccgccgacgatcgcgtgcagggcctgacggtgcgggtggaaatggcggtgcccgggccggacatcgtggtcactcgcatccgcccgcgcgtctccggccccgacgacgtggtgcaggtcgtccgcgatgcgatggataccgcccgccggcagctggcggcccggctgtcgcagcgccgcggcagccgtgagcgccggatcgcctgatccccgccccggacggcacggaacatctttgatcaccaaccggcccgccgacctccggcgggcctttctgttgccggcgtatgcgcctgtcccgcgatgatcaaatcccttgaaaaaccatacgtgctgatataaccctcacagaagagatgcgccgctaaattcaaccataagaatgtatgatcgcagcagacgggtacggggcagcgcatcatcgggcgggcacgtcagacagggcgaggggacggtcagatgacggaaacggcaacgggcatccgccgcaggcggatgcggcgggtgatggcgtgtggcctggcggtggcgtcgatgctgctgggactgggcgatcgggccgatgcggcggggcaggcggtacgcttcgcccattgggtgcccaccacccatgcgctgcatcagggggtggaagactgggcgaaggcggtcaccgccgagtcgaagggcacgctcgaggtgcaggtcttcccggccgaacagctgggcaaggcgcgcgatcattacgacatggtcgccagcggcatcgccgatctggcgctggtggtgccgggctacacccccggccgcttcccggtcgtgtcggtgctggaactgcccttcctggtgccctcggccgcgcaggcggcggcccccttcgacagctggtaccggccgctcgccccccgcgaaatgcccgaggtcacctattgcctgggcatcgttcaggaacccggcatcctgcatagccgcaagccggtagtggtgcccgaggatgtagagggcatgaagctgcgccccggttcggcgctggtcggccggctcttcgcctcgatgggcgcatccgccgtgtcgatcagcgcgcccgaagcgcgcgaggcggcggcacggggcgtgatcgatgcggcgacgctcgcctacggcaccctggtctccttcgggctcgacaaggtgctgaacaaccatatggatctgccgctctacagcgtgccggtgctctaccttgccaatacccgctggtatcaggggctgagcggcgatgccagggcggcggtcgacgcccattgctcggtggccgacgccgtgcgtcagtccacggcctggggcgattgggaacgtgccggccgcggcgttcttgccgccctgcccaaccagaccttcaccaatcccgatgcggcgcagcgcgcgctctgggccgaaaccggcaagcccttccgggcgcagtggatcgccgatgccggcgccaagggggtggatggtgccgcggcgctggccgagctggaagccgcgatcgcggctgccgcgccgcccgtcccacgctgatccgatgcaggcggcgttgatgcaggtggtgaccgtcaccggccgccttgccggcgcggctgccgccgcagcactcggccttgcggtggttgcgggtggggtgacggcccttgcccgctatcttttcggctatgccgtgcccgacgggttcgatctggtccggctgaccggcggcatcgccgcctgttgggggatcgccgccgccatcgcggccgacgagttgatccggatcgatgtcgcccgggccctgccgcggccgctggcggcggtggtggcggttctgggcggggcgggggcgctggccggtgccgtgctgctcgcccggtccggcgtgctcggcaccgatctgctgctgcgttcgggcgaaaccacggccgatctgcagctgccgctctggcccgcccatctggtgatggcggcggggctggtggtggcggcgttgctggccctgctgcggctgctggccccggtggagggggaaggggacaagactacatgatcgatggcgggattgccgccctcggcggtttcggcggtctgtttctgctggccctgctgcgggtgccggtgggcttcgccatgctcatcgccgggctgggtggcattgcggcgctgatcggcgtcgacccggcggcggcggtggcggtgcagtcgccgctgcgcacgctgaccggctatgacatgctgctgatcccgatgttcatcgcgatgagcgcgcttgccaaccacaccgggctggggcgagagctgtacacggccggccatgcctgggcggggcgcgcgcggggcgggctcggcctcgccaccattctggccagcgccggtttcgccgggatctgcggctcgtcggtcgcctcgaccgccgccatggcgcgggtggccctgccggaaatgcgggcccggggctatgcgcccggctttgcggccggcacggtggccgccggcggcacgctcggcattctgatcccgccctcattggtactggccctgtacgggctgttgacggaacaggatatcggccggctgttcgtggcgggcctggtgcccggcgtgctggccgtggcgctttatgcgctgacggtgaccctgatcgccgggcgccggccggaagccgcccccggcggtgcgcccgccggccgggccgaacgcttcgccagcctgcgcgggctctgggcggtggccgcgatctttctcggcatcatcggcgggctgtatctgggtgtctttgcacctggcgaagccggtgcgatgggcgcgctggctgtggcggcggtggggctgatccgcggccggctgacgctggcggccgtgggcggtgccctgaccgaggccgcccgcagtgccgcctcggtgatggtcgtgctgatcggcgcgctggtcttcggctatttcctggccctgacccgggcgccccagctgctggttcaggccctgaccgaaaccggcctgtcgccctggggggtgatggcggcgatgctggccgggtatttcctgctcggctgcgttctcgacacgctggcgatgatcgtgctcaccgtaccgatcacctatccggtggcggtggcgctgggcttcgacccgatctggttcggcgtggtggtgaccatgacggtggagatcgggctgatcaccccgccctacggattgaacgtgctggtgctgaacaccatcgcccgcgatgtcggccttgccaccatctatcgcggcgtcgcccccttcgtcgcggccgatctggtgcgcgtgttcctgatctgcctggcgcccggcatcgtgctgtggctgccatcgaccatggggtgaagcgatgcgtccgatcgacccgttcctgcgcggcctgcagctggcccccgatgcggctgcggcgatagaggtcggaagcgatgatccgccgatcgactatcggggcctcaatgcccgggtcgaggcgctggccggctggctggcggggctgccggtcgatggggcggggcagctgcgggtggcggtctattcccccaatgccgccatgggatttgccgccgtgctggcctgcatgcgggctggcgtggtctgggtgccgatcaatgcccgcaacgccctggctgagaatctgttcatcatgaatcaggcgcgggtgggcgtgctggcgatcgccgatgcctttctgcccgatctgcccgagatcctggatgcggcgccggggatcggggcggtgctgctgctggggccggcgatccgccggaaccgcccgcgcggcggttgcagctggcacgggcggcggcgctgatcgcggccccgccgccgccggcgcccgatccggtgcatgatcccgaccgggtgtcggcgatcctgtcgaccggcggcaccaccggccggcccaagggcgtggtctggaccgaccggatgtgggaggcgctgaccctgtcgatctgggcgcatatgcccatgcccgaaggcgaacggccggtgcatctggtggccgcacccatgacccatgccgccggtgtgatcgcgctgccgctgacggccggcggggccaccacagtgatcctgcccaaggccgatcccgtggtgatcatggatgcgatcgaacgctatcgcgtgacgcatctctttctgccgccgacggtcgtctatatgattctggccgaccggtcgacccatggccatgacctgtcgtcgctgcgctatctgatctattccgcagcccccatggcacccgacaagctggccgaggcgatggccctgttcggcccggttctggttcagggctatggccaggccgaaatcccgctgatgggcaccttcatgagcgcggccgaacatgtggcggcgctggatgccggggatcatgcccgcctggtttccgccggccggccggggatcgcgtctcaggtttcgatccgcgaccccgggggacgggaactgccgcgcggcgagaccggcgagatctgcttccgcggcagcctggtcacccccggctatgacggccggccggagctgacggccgaacatcgtttcggcgactggcaccgcaccggcgatctggggttcatggatgcggccggctatgtctcgatcgtcgaccgggcgcgcgacatgatcatcaccggcggcttcaacgtctattcggccgaggtggagcgcgccatcctggccgatcccgccgtgcgcgactgtgcggtgatcggcatccccgatccggtctggggggaggcggtgaccgcgatcgtcgagcctgccgccccggatgcggtcgatgtgcaggcgctgaccctgcggctccgcgctgaactcggcggggtcaagacccccaaacatgtggaaatctggcccgaattgccgcgcagcacggtgggcaaggtgctgaagcgcaagatccgtgaccgcttctggaaggggcgcgaacggcagatctagatgataaatccatgattgtgtgcggcatggcttgacgccggtccgcggctggggaacggtgagggccatctgtgaccgggcgcctgcccggcgtatccggttttcttctccttcgaggatgcgacccctatgttcgcctcgtcctttcccgcgtcggatctgcgtccggtgccggtgcctcgggtgctggccctggccgaggccgatccgcagcgtcccgccgtcgagtccatgctgatggcgctggcgctcgacgatctggcggccctgcacgaccgcacccgcagcgctgcgcgtgcggcacgggccgctgacgacatgccgcgcctgttcgatctggtgcgcggcatgaagaccctgcagcggatcgccggcgcgcgcggccggctgctgatggccccgcccgcccgccagggctgatccgggcattcctccgacctgtcaggactcccccgccgatgtcggatgtcaatcgatcgggcgacacgccgtcgccggtgatcgccgggctgaaactggccctgccgatcatggccgcctatttctccgtggccttctctttcggcctgcttgcgaccgaatccggcctgccggcctgggcggcggtggccatgtcggtgctggtctatgccggcgcctcgcaattcatggccgtggcgctgattgcggccggcaccgccatgccggcgatcgtgctggcggtgggcgtgctgaacctgcgccacatggtgatgaccctggccctgcccgggatccgcccggcggtcggccggctgaagcggccctggcggatggccctctatgcgggcatcaccgacgaggcctttgccgcagcgagtttcgcccgcgaccccgccgcggccaggccggccactctgggcacgctggtgcttgcgatctatctgtcgtggatcgccggcacgctgggcggcattgccgccggtgcgctggtgccggcggatctgcgcgccgccatggctgccgggctctatgccctgttcgtcgccctgctggtgccggggctgaaggcgcggccggcgatggcgctggtggtgagcgctgcggcgatcctgaacgcggccttgagcaccgtgctgccggcgggcattgcgctgctggtcgccatcctgtgcgtggccggcggccatgccttcatctcgggcggcgggtcggcgcccgagcccgccacggatgcgaccgggcgccgactggggaggggcgggtgatgatgtcggacaccctgctgctgatcaccatcctgggcatggcggcggcgaccgccgtgccgcgggtgctgccggcgctgctgcccgcgggatggcggcccggccgtcggcttcaggcctttctggatgcggtgccctttgccgcgctgggcgcgctgatcgtgcccggtgtgttccagatcgagggcggggtgacggccggactggcggttgccggcgccgcggcggcggccgccttcgcccgggcgccgcttgccatcaccgtcgtcatcggtatcgccgtcgcctgggccatggccgggggtatcgtcggcggctgatgccgatgcgtccttgcccccggcgatgcgtccttgctcctggcggcatgggggtgcaggatcgatgcatgaggccggcccggtggccggcatcgcctcgcttctaccgggacgcgcatgaagaccgatacgccgaagaccatcctgctctccgagtacaccccgccggcctatctggtgccgtcgatcgatctggaattccggcttgatccgcatgccacccgggtgaccgccgtctcgcggatggagcggaccgccgatacgccggccgatgcaccgctggtgctgaacggcgccgggctcaagctggtctcggtcgcgatcgacggcgcgcccgtcggccccgaccgctggctgcaggaagaggaacgcctggtgatccgcaaggtcccggccgccttcgagctgacggtggtgaccgagatcgacccggcgggcaacaccgcactcgaagggctctacctctccaacggcatcttctgcacccagtgcgaggcggaaggcttccgcaagatcacctatttccccgaccggcccgatgtgatggcgcgctatcgcaccaccatcatcggcgatccggcggtgctgccggtgatgctgtccaatggcaatccggtggccgacgagatcggcgaagacgggctccggcacatcacctgggaagacccgttcccgaagcccagctatctcttcgccctggtggccggcgatctggcgctctgcgaaagcccgttcaccaccatgagcggccgcgacgtctcgctccggctctatgtcgagccgcgcaacgccgacaaatgcgagcacgccatggcctcgctgaagaaggcgatggtctgggacgagcaggcctatggccgggaatacgatctcgacatctacatgatcgtcgcggtcgacgacttcaacatgggggcgatggagaacaagggtctcaacgtcttcaattcgaagtacattctggcccgccccgacaccgcgaccgattccgattacggtgggatcgaggcggtggtcgcgcatgaatacttccacaactggaccggcaaccgcatcacctgccgcgactggttccagctcagcctgaaggaagggctgaccgttttccgcgagcagcagttcgtggccgaccaccagtcggcggcggtgtcgcgcatccacgacgtgcgggtgctgcgcgccgcccagttccccgaagatgccgggccgaccgcccatcccgtccggcccgacagctatatcgagatcagcaacttctacacctcgaccgtctacaacaagggcgccgaggtgatccgcatgctccacaccctgatcgggcccgaggccttcgcccggggcatggatctgtatttcgagcgccatgacggccaggcggtgacctgcgaggatttcgtccgcgcccatgccgatgccaacgagctggacctcggcgatttcttccgctggtacgttcaggccggcacgcccgaggtttcggtcgaaacccgccacgaccccgaaagccgcagcttcgagctgaccttcacccagaccctgaagccgacccccggccagccggtgaagaagccgatggtgatccccgtgcgcaccgcgctgatcggcgccgacggcgcgccgctcgcgctcaggctggcgaacgaggcggcggatgcacccgaagccgaccagaccgagcgggtgctggtgctggaggatcgcgtcacccgcttcaccttcgccgatgtggccgaacggccggtgccctcgctgctccgcggcttctcggcccccgtcaagctggagacgcgcgcggaagatgccgatctggccttcctgatgggccatgacgacgacgccttcaatcgctgggaggcggcgcagacctatgcgatccgggtgatccaccgcctgatcgccgatgccgccgccggccggcccctggtgctgcccgcggatttccgcgacgctttcgcccgcacgatcggcgatgacagcctggatccggccctgatcgccgaggcgttgaccctgccgggcgaaagctatctggccgagaccatgacccggatcgatgtcgagggcatcaccgccgcccggcagttcgtccgacgcgagatcggccgcagcctggaagggctgctgctggaggtcttcgaccggctggcggccgaggatgcgggcaagccctacagtttcgatcccgcctcggtgggccggcggtcgctggccaatctgtgcctggcttatctgggcgccccaggcggtacggccgggctggagcgtgcccgccggcgcttcgagaccgccgacaacatgaccgatgcgctgggcgggctgctggtcctggccgaccaggaagacgcgctgtcgcagccggctttcgatgctttctatgcccgctggaaggacgagccgctggtggtcgacaaatggttcatggttcaggcgacggcctcgcgcgccaatgcgctggaccatgtgctgaaactgatggagcacccggccttttcgatgcgcaaccccaaccgggtgcgctcgctgatcggcgctttcgccgccagcaatccacgcggcttccacgaggcctcgggccgcggctatgacttcctggccgatcagatcatcacgctggacgccagcaacccgcagatcgcggcccggctggtgggcccgttcaagcgctggcggcgctatgacgaccagcgtcaggccctgatgcgccaggcgctggaacgcatcgccgcccgccagggcctgtcgcgcgatgtctacgagatggtcagcaagtcgctggcctgaggttgcgcgaccgaggttgcgcgactgaccgggaaggggcggcaccgtcacggcgccgccccctgttttgtccccgtcagctgtggcgatagaccgcggtttcgaaggcgagatagccgccgaccgaggcggcatcggcgaagggcaggatctgcgtcgcccagaacccgccgagcccgttctgccggtcgatccagtagaagagattggcgagccccgcccaggcgagcgcgcccgccggccggccggtgggggcgggctcgtcgttgatcatgaaggtcagcccccaggatttgggcatgccggggaaaaactcggcatcgttcgacaacgacgggatcacgccgggcagcatcttgatcttcatctcgcccagcccgttctgttccgccatccgcacggtttcgggccgcagcaccgggccgttgggccccatgccgtcattcagccacatgcggatgaatttcgtgtagtcggtggcggtcgattgcaggccatggccgcccatatggatctcgggatcctggggcagcatgaagtcgggcaggggcgtcaggctgccatcggcaccgcgctgatgcatcaccgccagccgcgcctgcatgtcggcggtcatggtgaaggcggtgtcggtcatgcccagcggatccaggatccggctttgcatcacctcgcccagacggcggccggtgatcgcctccaccacccgcccggcctgatcgatattgctgccgtattcccaggcctcgcccggatcgaacagcagcggcgtgtcgagcgccgccgccgtggcggtgatcacgctcggctgcccgcgtgtggtggccaggcgctcgtagaccgggttgaaaaagtcgtagccgaagccggcggtgtgcagcagcagcatgcgggtggtgatctcgcgccgcggcgcccgcagccgcgggctgccatcggcctcgaaaccctcgatcacctgcacccggcccagcgccggcagatagtcgcgcgccggcgcgtcgaggtcgagcaggccgtcttccaccagctgcagcacggccgtgccggtcagcgccttggtggtggaaaagatcgcgaagacggtgtccgccgtcatcggcgcatccccgcccgcggcgcggaggcctgcggccccctgatagatgtcgcccgcgcgatcggtcgccacggcgaccacgcccggcagaccggggccctcggtcacggcccggttcagcaccgcatcggcggcggttttcaatgtctcggtcattgccatcctccctggacggagcctcaggcctctccgctctcgatccgggcggggttcgaccttggggcccatggcgggcaagggtagcgggcaggggcgacccgtctctatccggcatcggcagcgcctgtcggatttcggcagtttctgcaccgcagacccgcctgaaactcgccagccggcgggtcggggcgctatcgtgatggcaaagcaccacccgtaaaggggggagggggaaggaagacgtctgcgtgcttcgacaggggaggcgggcacatgctgaaagatgcgctgatctatgacgcccggggcaacccgatccgccagcatcacaaggtgaattcccgcgactgggacgagatccgcgactggtcgaaccgggtttacatgccctatcgggtggcgcccacgggcgcggccgcgacgccggcctcgaccatgcattcggcgcgggtggggcggatcatcgtcacccgcttcgcctatggcatcccggtccgcgtgcaggactggtccgaagatgccggcaatgcggtggtgctgaccaccatcgccggcaatgcccgccacgccgcgaccgcgcgacaattcgaggataccggcatcggcgaaagcttcgtggccgattgcagccgtatcgaccatctgatcgatttcgaccccgaccatctgcagctgaacctgaccatcccgcatgcggtgctggaacaggcctgccgcgactggctgggtttcgtgccgggcgatgcgctctggcagcacaaatgccggatcggcggccgggctcggcctggctcgcgctgatggaatatctggtccgggcgattgcagaggccccggaccggctggcggccgaccgggtcggccggcatctggagcagaccgtctgccttcatctgctgaacgactgggccgcccgggccgggttggaccccgccgagccggggcgcagtgtggtgccgcgccatgtgaggctcgccgaagcctacatggccgagcatgcggccagcctcccggccatgaccgaggtcgcccgggcggcgggcgtcagcctgcgcagcctgaccgacgccttcaggcgcttccgcggctatacccccagcgccttcctgcgcgaacgccgcctgcaggaggtgcgccgtctgctgcaggcgggcgggtcggacatgaccgtgtcgcgtgccgcctatacgatgggctatgtcaatctgggggaattcgcccgcagctatcgcgcccggttcggcgaacggccgtcggagaccctgcggtcctgaaacgacgaacgcccgcacggcccccccggtcctgcgggcgttcctcaaccggacgcgggtgcgccttgtccggtcaatgctcaatgctctctcagtcgcggttggcccgcagccggttcatgaagccggtcatctcggtcgacagatgattggcgcgggcctccagcgcccgggcggtttcagccacttcgtcggcggcggtcttggtatcggcattcacccgttcgatacccgacacgccgcgggtcacctcgcgggtgcccgacgagacctgctgaatgttgagcgcaatatcgcgggtggcggcactctgttcctccaccgccgcggcgacaccggttgcgatttcgttcatccgccggatggtctcggcgatcttctcgatcgcctgtgcggtggccgaggcgacattgcgcatgtcgcccacctgggcgctgatatcttcggtcgcacgcgcggtctgggcggcgaggttcttcacctcgcccgccaccacggcgaagcccttgccggcctcgccggcccgcgccgcctcgatggtggcgttgagtgccagaagattggtctgttcggcgatgtcgttgatcagctggacgatctcgcccaccttgccggcggcacccagcatgcctgaaacggtcgtcgtggtctggcgcgcatcctccaccgcctgccgggcgatttccgacgactgcgacacctggccggcgatctcgctgatcgagcgcgacaattcctcggatgcggcagccaccgcatcgacattggcggcggcctgctctgcggcgccggccacgctgctcgcttcggaccgcgccatgtcggccgcactggtcagcccgttcgacgcgccgcccagccggccgaccgtctgggtcagatcctcgaccacgccgcggatcgaggcgtcgagttcgctggccgcttcaagacgtgccgcgcgcacctgcgccatgacgccggtgatgtactgctccatcgccagatccatgtccaggaacaccacccggctcaccgccgacatggcgcgttcccgcttgtcatgcgaccagcgatagcttcgcgaaatggcggccagcaggcgctgcagcaccatctgatagccgcccatataccagcgcggctccagcccgatgcggacatgggcattgccgatccgggtggcgcgcgcgacgtaatcggcgtcgaaccgcccggacatcagcgccgtccaatgcgctttctgggccgttttcagatggtcgaccatccccggcttcgcgatcagcgcctgcatcggcgggtaggtcgcgagcgtgcggtagaaaacgtccagaagatcctcgatctccgcttcgaccaccggccggaccaaagcgagatcggcgatggtggcggcatcgatgccgaggaaacgcagacgctcggcatcgagcgcggaagcggtgacgggcgaagccatgatgttcgggaccaacctgctggttcgtgacgtttttctggggcttgcccacggcctgtggcaggccgtgaggcaaaccgataccaaatcttaaggctgagagggttgataaatgattacggaatgcgtatccggcatcgacggtgccgggacgttccggctccatctcatccgcaagaggaattccggccatgtttttctcggtgtcgaagctcgtggggcacctggttctgccggtgacgctcctgctgttgagtctggctctggtgccgttcctgcgctgggcgggcttgaagcggatttcacgcttcctgggcacggccggtggtgtcgccctggcggtggccctgttcacgccgcttgactactggctgcttgccccgcttgaaaaccgcttcccgagggtggagcgggagacggtggcaaaaggggattttgccggcatcgtcgtgctcggcggccccgaggacggcagactgaccaaggcgcatcatcagccgtcggtcggcgcagcggccgaacgcttcatcgaggcggcgattcttgcccggctgcgccccgatctgccggtgctcttcacgggtggcagcggtgtcttcagcgatccggatgcgaagggcggcccggtcgccgaagcgctgttgcgcgatctgggggtggcgcccgaccggttgatgatcgagagcgagagccgcaacacgtttcagaatgcgatcctggccaaagagatggcgggcgacgtttccacccgtccctggctgctgatcaccagtgctgcacatatgccgcgctcttacggcattttcgtttcccagggctggaacgtgaccgcctatccggtggactacaataccttcgccccggtctggggctggaacgactatcgctttaccgaccggctgaaccagatccatctggccacacgtgaatgggttggcctgctcgcctatcgtattacgggcaggatgaaccgtgtattccccgcacccttggagtccaacgcgccggactgatctgtaaattccgttctaatattgacgatattgtgcgactgccccggccttcatataaatatggcggacgggggtgaccggggcctcgcgcttcaagtcgcatggctactggatctttgggtgaaaaacggcgacccgaagtgaggccatgcgaaacattggtatcagacagctggcactggcgctgacggtcatgaccgtcctgcccctgatggcggtcctgggctggtcggtgatcaccaccggccggttggatcagcagcgcgtcggcgagcagttttcagtgacgacgcataccgccgctcaggaactgcgccagcggatcgatgccgcccggcagctgatcgccgcgatggcggcgggcggcgtgccgggcatgaatgatccggattgtgatgcgcgcttcgcccagctggtgcatctgcggccgatctacaacaacatgttcgtcaccgacatctcaggccggatcgtctgcgcggcacggccgatcccctcggcggacggccagccggccagcctgggggcgcggccctatttcgcggccggcatgcgggccaccgatccgctggtcgcaggctggctgcccggcctcgccaatggccgtccgatcctgccggtggtcatgccggtccgcgacgctcagggccggcccgtcgccatggtcggggcgtcgatcgacctgctggccttcgtgcaggggatccgggcagagctgccggcggataccggggtgacgctctggtcgcccgagggggcgctggtcacccatgccggcccgctgccaccgccggaccccaatggaacggagcctcacccgccgaccggcgcgggcggcgcgcttccggcgttcgatcccggcttcgccattcctattctcagccttcccgccgtgcaggacctgcccgaacgggtgatgatgctggagacggtgtcctttggcgacgaggcgctgaccctcggcatctcgatggacgaggcgcggctgttcggcccggtccgggcgctgatgtcgagcaatttcgtcctggcgctctggctggcggccggtctggtcatcctgtcgatggcggtgatgcggatggcgctggtgcgcccgctcggccgtctgtcgcgttatgccaaggccatggccaggggagaggcgccccgccatattccggatgtctcgaaggtgcgcgaaatcagcgacctggcctccaccctggatgctcttttcgccgatctggccgagcgcgagacccagcgtaaccgggcggaagaagccctgcagcgtgccctggcgggcatggagcggaccgtggcggcgcgcacggcggaactcgcggatgcgcacgaggcggcgcgcctgcgggcgcgtgatctggagcgcggccgcaaccgtgagcggatcgccggccggatgaccgatctgatccagtcctgcgcctcggtcgacgaggcgatggacgtgctggcgcggatgatgccatcactgtcgaacggcgatcgcgggcgggccttcctgcaccggccggggcaggccgcactggaaccggcggcgctgtggggcaagcctctgctgcccgggcacagcatcaccgaggacgactgctggtcgttgcgcctgggccatgcccatgtcagccgggcggaaggcacgatgccgatctgccggcatctggacggggtgccgggccggcatctctgcgtgccgctgatcgcccatggcgagatcctggggatgatcaccctggaacgcgatgccgtcgacgaccgcagcgactgggccgaagacgaaatcgcggccctggaccgcgtggcgttgtcgatcgccaacgtcaagctgcgcgagacgctgcgcggcatgaccatccgcgatccgctgaccggcctctacaaccgtcgtttcgcggatgaaaccctggcccgcgaggctgccgtggcgcgccgcgacggccggccgctggcggcggtgatggccgatatcgaccatttcaagcgcttcaacgatgcccacggccacgaagccggcgatcgggtgctgcggatgaccgcccgggtgatggccgatcatttccgccgcagcgacgtggtctgtcgttatggcggcgaggaatttctgatcctgatgccgggcgccaccgccgccgatgccacggcacgggccgacgccttccgccgtgccctggccgggacggtggaagaaagcggcgatgcagcgctcgggccggtcaccatctcgctcggtgttgcggttttccctgagacggtgaacgaggatgcccgtctgatcgcagcggccgatgccgcactctatgtcgcgaagcatgccggccgtaaccgggtgatgctggatggtcaggtgcggcccgccgacatgctgacgggctgattcgtccgtcacctggccgcgccggccggcaccacccgcccggcgcggatgtcgcggcggcgatcctcgacatgctccaggatcgtctgtttgccgtcgtcatccagccggcgccagacgcggatctcgtcgatggtgcgatagcagccttcgcaccagccggtgatggtgctgatgcggcagacattgacgcagggcgaggcgacggtcatcgggcagcggggctccggctctgtgggtcaggggctctgtgggtcagggttcaaactgttcgcgcagaatgcgctcttccaggctgtggccgcggtcgaacagcagggtcagttcacgcgcgggatcgcgggcgacatccacccggcgcacatcgcggacctcggtatagtcggcaaccgcgctgaccggccgtttcatcggctccagaatctcgaaggtgatggtcgcggtatccgccagcagggcgccgcgccagcgccgcggccggaaggcgctgatcggcgtcagcgccagcacgcccgcgcgcagcggcaggatggggccgtgcgccgacaggttgtaagcggtgctgccggcgggggtggaaaccaatgcgccatcggcgatcagcatcggctggcgctcgatgtcgtcgaccagaatgcgcagcttggcggtctgccgggtttcccgcagcagcgacacctcgttgatggccaatgccctgtgctcggtgccgtcgaccgtataggcgcgcatcagcagcggatagatcgttgccggcaccgcatcggccaggcgctggtccagcccttccacccgaaactcgttcatcaggaagccgaccgtgccgcaattcatgccatagatcggcacatcgcggtccatgaagcggtgcagggtctccagcatcagcccgtcgccgcccagcgccacgatgacctcggcggtttcgggcgggactgtggcataggcggcttcgatcgccgcccggccggcgcaggcctcttcggtatcgcccgcgaccaccgcaaaggtgggaatgcggccggcggcggccggcatcggggtggtgccgaccgttgcgacaccctggggcgggatctgggtcatctgccggtcagccgcccgtcatgctcatatgccgggtgagggcaggggcggcgccccggcgctcgatcacgaaatcatggcccttgggcttggcgtcgatgccgcggcggatggccgcgatcaggggcgtgtcgtcgtcagggctggcgcggagcggctcgcgcaggtcgacctgatcatcctggcccaggcacatatacaaccgtccggtgcaggtgacccgaacccggttgcagctctcgcagaaattgtggctgagcggggtgatgaagcccagccggccgccggtttcggcgatccgcacatagcgggccggcccgccggtgcggtcgggcagatcggtcagggtgaagcgagcctccagcctgcggcggacctcggcgagggagagatactggtcgacccggtcctcgtcgatctcgcccaagggcatggtctcgatcaaagtgaggtcgaaccggttctcgccgcaccagcggaccatgtcctcgatctcgtcttcgttctcgccgcgcagcgcgaccatgttgatcttgaccgccagccccgccgctttggcagcggcgatgccgttcatcacccgatcgagcgtgccccagcgggtgatgcgctggaagcgcaccggatcgcgactgtcgatcgacacgttgatccgccgcacgccggcccggtagagcccttcggcatggcggtcgagctgggtggcgttggtggtaagcgtcagttcgtccagccggccggcggcgacatcccggcccagctcgccgatcagatccatgatcccgcggcgcaccagcggttcgccgccggtcaggcgcagcttgcgcacccccagggccatgaaggcgcgcgacagccgggcaagttcctccagcgtcagcagatcggccttgggcaggaaggtcatgctttcggccatgcagtacacgcagcgcaggtcgcagcggtcggtgaccgacaggcgcatatagtgcacatgccggccgaagggatcgaccagcgaggggcgatcgctcaggggcatgggggaggcattgcggatctggctcactgcggcggctcgctcgtccggaggcccgtcatggaaaggccgtcatcaggggcgtgtcccgttcaccgggctgtcttgagacaacattgtgggggtgcagaggttgccgcgcaagggccgcaacgcaaccgggcagggccgcgtccggcggttcagatcgcgtcgccgtcccacagcgccaggatggcgagcgcccgccggcggtcgaccatgtcgaaaaacgccaccgcttcaagcagatccttgggatccgacaccttggtgccgcggctcatcttacgggtgagcatgaacagcgtcgagaagccctgacgggtgacgtcggccgccttgcaggcgatcgccagggcctggccggtggtctcgaaggcgatccgccgggcggtgatcgggcggatctcggtcatatgggcgagtgccgcctcgaacagcgcgatctcgccctggcgatagctttgcagcaggaaggtctcggtgacgccaccgccgcgtgccagcatggcgacgcgttgccgcgcccggccctgatcctcggccagacggccggtttcggtcaccctgcggtccaccacgcgggcgaccgcccgctcgatcatctcgggtgagacgtcgaaccgctggacgatgtggcggcgcagcgacgcccccacccaccagaacatccgataggcaagccccgccggcaattcctggcgctgcaacagcggcggctggatcacctccatccgctgcgacagcatcacgatacgctccagcagcttcggcgagagcggtgccgtccggttcgccagtcgcgccgtcaccacctcggcctctgcggcatccagcagggcgccggtgacggcgtcgctcagatccggtcgctgggcgatggcggtgcggtgggcggaagaccgttcgcgggcgatcgcgatcagatccggatcggtcaggatcggcgagcgcgacagcaggggatgggcgacctcgatccggtcgttggccagcatcacgaacagattgggcggcagctcccccgcttcgggcatcgccgccagttcttccgccagttcgcggcggagcgtgtgctcgatatccgcaaccaaaggttggatcaaatgggcgacgaccccgcgcacccgttcggtcagcttgcgctcacggtcgatcagcatcgttgcgatggtgccggcaatcgcctgccgctgcgatggtggcttctggagagccgcccgcgcgagtgcttcgacctcgcgttcgatcacgatccccccgccgaccaccagcagcttccccgatatggcccggcttccctctccacgacaacggaatccacgatgcggatcatcgaagcgtcccggggcgggtatggtgatgcgggggcaggtatcatcacgttccgtggcagagcggccgcaggccggcccatagcagagtgaccgcaggcgttggtctttggcggagaaccgcagaccctggccttcggcggagaaagtctcgcgggacgcagcgtccggcgcatcctgtatttacgaagcccggatggcggctgcaaccgcaaaagctgtaccgtggctttccggtgcccctggtcgctcaatcgtcatcatccggcgggttcggtccgcggaccagttccagatcgacgacatcggcatgcacggtgcgctttccgccatgttcgaaattgacggtgacgcgatgggcggccacgctctggacctgacccagcccccaatcgggctgaccgggcaggcggacgaggcttcccggcgggtacagcatgccgtaaggtgccggcgtggtcatctgacgatccttccggattgggtccgttcccgacacagatggggtggcggcatcgcctgcaccaggggccgtttccggggagccgatgccgtccgtggccgggatccggggggacgcgcatatggttacggcaatcgcgctgcgcctaagggaaatttaacgcttgccgccgtaaaagaagaaggcgagccccggtaggttcaccggggatgcgatcggtttcagggagtgacgcgacgtgggcgagggagattgggtacgactctccggactggtgtgtgccaggctctgccacgacctggtcggtcccgtcggtggtgtcgtcaacggcgttgagtttctggccgaagacggcatgggagacgacgcgctgcaactgctggccgacagtgcggcccgcgctgcccgccggttgagcttctatcgtctggccctgggcgccggcggcaatcccgacgaacgggtagcagccggcgatctgtcggcagcactcgccggatacttcaccgacgagcgtgccggtctggacgtcatcgcctggccgagcgacggcaatgtgctgagggcccatggcggcatcgtgttgtgcctggcggcgatctcggcacaggccctgctccgcggcggcacggtcacccttgcctggcggaccacggtcgagggcggcagcgtgagcgtggtggccgaaggcggcgccatgcgcctgcccgagacgctggtcccgtcgatcgagggacggatcgatccggcggcgctggatgcccgcaccgtgctgcccttcatggtttccgaaatggccgccgccgtcggcggccgacttgcggttgccaccgactggtcgggcgccgatctgcgccggctgaccatcacgggcgatctgccggtcttcactgcccgggctggcgtctccagcctggaacggaccggcgagaccggtccctgaacctctctcctcaccgccggcgggcctgcccgcggcggttccgtctgcggacactccgacgacttcacacgcgaggcgccacggcgccagccattcacggcagcagggatgagaacgccatggacgagctgctgagcgagttcctcaccgaaacgacggagagcctgtccacgctcgacgtcgaactggtgcgcctggagcgcaatccagacaatccggaactgctgcagaacatcttccgccttgtacacaccatcaagggaacctgcgggttcctgggcctgccccggctcgagaaggtggcgcatgcggccgagaacgtgctgggcaaggtgcgtgaccgcgaactgacggtcaccccctatatcgtgacgctgatcctggaaagcctggaccagatcaaggagatcctggccgagctggaacggacccaggccgagcccgccggcaatgatgccgacctgatcggccgcctggacgccgcggccgaaggcgtcgaggccccggccaagaccgccgcgccgaccggtgccgacggcgcccccgatttcgaggcggtgcgccggatgatggcggccgagatgtcgggcaacgccctgccggacgacgaagacgaggccgaggccgaggccccggcgggcctgccggtgggcacggcccagccccaggcgctggtggccgcaggtgccggtgcggttgcaacccagcaggcgccggcggcggcagaggccgcaccgcgggccgatgccggcgatcaccatgatgccggcagcaatggcggcccgcgcgaaagccacatcgctggtcagaccatccgcgtcagtgtcgacctgctcgagcatctgatgaccatggtcagcgagttggtgctgacccgcaaccagctgctccagatggtgcgcggccgcagcgacagcgagttcaccgtgccgctgcagcgcctgtcccatgtgacgtcggagctgcaggaaggggtcatgaagacccgcatgcagccgatcggcaatgcctgggccaagctgccgcgcatcgtccgcgacctgggccaggaactgaacaagaagctcgacctgaagatgtacggctccgaaaccgagctggaccgtcaggttctggagctgatcaaggatccgctgacccacatggtccgcaactcggccgatcacggcctggagcggcccgacgagcggcgggcggcgggcaagcccgagaccggcaccatcaccctcaacgcctatcacgaaggcggccacatcatcatcgagatcgcggatgacggccgcggcattgatctcgggaaggtgcgccagaagatcgtgaaggtcgggcttgccaccgagaacgaactcgacggcatgaccgacacccagatcgcccagtacatcttccggccgggcttctccaccgccgagaaggtaaccagcgtctcgggtcgcggcgtcggcatggacgtggtgcggaccaatatcgagaagatcggcggcacgatcgaactgcgcaccgtcagtggcaagggttcgaccttcgtcatcaagatcccgctgacgctggcgatcgtcgcggcgctgatcgtggaagccgcgggcgaccgtttcgcgctgccgcagatcagcgtggtcgaactggtgcgtgcctccaacacttccgagcatcgcatcgagcggatcaacagccggccggttctgcgcctgcgcgaccatctgctgccgctggtgagcctgggccacgccctggccctggtcgacgagcacgacccgcaggtcgaaatcgacgacgacggcctgttcgtgatcgtctgcaaggtgggcaccttctcgttcggcatcatcgtcgaccaggtcttcgacaccgaggaaatcgtggtcaagccggtggcgccgatcctgcgcgacatcaccatgttctcgggcaacaccatcctgggtgacggcagcgtggtcatgatcctggatccgaacggcctggcgacctcggtgggcgagatccagaccgccagcgaccgccgcgccgaggcggcagcggccgaggccgccgccaatgccgacgacaagctgtcgctgctggtgttccgcgccggtggcgaggatccgaaggcggtgccgctgtcgctggtggcacgtctggaagagatcgacctggccacggtcgaacgctccgacggccggccggtggtgcagtatcgcggccagatcatgccgctggtcatggtgaacgagagccaggaactggcgcgcgagggccggcagccggtggtggtcttcaccgagcgcaatcgcaccatgggcctggtggtcgacgagatcgtcgacatcgtggaagacagcttcaatgtggagctgcgcagccgccgcgacggcctgatcggcaccgcggtgatcgcgggccgcaccaccgacatcgtggatgtgggctattacctgctccgcgccaccggcgactggtacgaggccgagccgcgcaggatcggcgccgcgcgtgcccgtcgggtgctgctggtcgatgacagcgccttcttccgcagcctgatcgcgccggttctgcgcgtgtccggttacgaggtctcgggtgtggaaagtgccgaggcggcgctgaaactgcgcgaccagggcgccgagttcgatatcatcgtcagtgacatcgagatgccgggcatggacggcttcgccttcgcccgcaccatccgcgaagagggcgcctggtcccaggtcccgatgattgcgctgtcgtcgcataccgcgcccgaggatttcgatcgcggccgcgacagcgggtatgacgactatgtggcgaagttcgaccgtgagggcctgatcgcggcgatcggtcaggtgatgaacatggcgaaggggagcgtggcatgagtgcggatatcgtccgctacgccggtggcggcaacgccctggcccgcaccggtgacgacgaggtcgtcggcgcccagcggcagttcgtgacggtggtgatcgaacggcagaccttcggcatcccggtgctggtggtccaggacatcctgggcccccagaagatcacccgggtgccgctggccccggccgaggtcgcaggcgcgctgaacctgcgcggccgcatcgtcaccgcgatcaatgtccgccggcggctgggcctggcgccccgcccggcggagatgaagggcatgaacgttgtcgtcgaacacgacggcgagctgtacagcctgatggtcgacggggtgggcgaggtgctctcgctcgacgatgcccggttcgaacgcaacccggccaatctcgcgcagcattggcgagacgtctctctcggggtataccgactgaacgacaagctgctgctggtgcttgatgtcgagcgtctgttcgaattcggctgatgccgcccctcgcgccggcccggcctgtccgaccgaagcctttcctccccacaagtgcccgggcgtcgggcggcgcgttcgaggatccgatctgaaatgaagacctgcctgatcgttgacgactccaaggtcatccgcatggtcgcgcggcgtatccttgagggtctctccttcgccaccagggaagccgcggatggtcaggaggcggtggatcgctgccgcgaggccatgccggacgccgtgctgctggactggaacatgccggtgatgaacgggctggagttcctgaaggcactgcgtcagatgccgggcggcgacgcgccgatcgtcgtgttctgcaccaccgagaacgatctctcccatattcaggaggcgatcatggcgggtgcgaacgaatacatcatgaagccgttcgacagcgagatcatcgaaaccaaattcacgcaggtgggcctcatctagtgagctcttacacagcagggggcggaggtgtcgaaccctatcgcgtgatggtggtcgacgacagcgcggtcattcgcggtctgttcatccgtgtcctagaagccgatcccgagatccgtgtcgtcgcctctgccgcgaatggtcggatcgcactcaaccagctgaagcgccagccggtggaagtggtcgtgctcgacatcgagatgccggaaatggacggtctgaccgccttgccggagctggtgcgggcgcagcccgggctcaaggtcatcatggcctccacgctgacccgcaagaatgcggcggtcagcatggaggccctggccaagggcgcggtcgactacattcccaagcccagcgccaccagcgaggtctactcgaacgagggtttctcgcgcgagctgctggccaaggtgaaggcccatgccgatcgcggtcgtcgcgacggcacggcgccggcactcggtggcggtgccgccgcaccggcggcacctgccgctgccgccagcccgaccacggcctatcgtccgcggaccgagccggcggcacctgccgcacgtccggccgcggtgccggccgcggcggcggatctgccgcagcggctgggtctgcagcgcaagcccgtggtgctgcgcccgttcccgccggccttccgggccaaggcgctggcggtcggcagttccaccggcggcccgcaggcgctgttcaccctgttcggagcgctggggcccgcattgcagcggattccggtgttcatcacccagcacatgcccgccaccttcaccaccatcctggccgagcatctggcccgcgcaagcggcctgccctgcgtcgaggccgaggacggcatgccggtgaaggccggtcgcatccacgtcgcccgcggtgactggcacatggtgccgaccgaagcggccggcggggcggtgatccggatcaaccaggacgcgccggagaatttctgccggccggcggtggatccgatgctgcgggggctggcgaagatttatggccgcaacctgctgaccgtgatcctgaccggtatggggtcggacgggcagcgtggtggcgaacatgtcgtgcaggcaggcggcgtggtcatggcccaggacgaggcgtcgagcgtcgtctggggcatgccgggtgcggctgcccaggccgggctgtgcagcgccgtgctgccgctggatcgtatggccggcgaagtccgccggctggtcgacggaggaccgtgatggcgccggaggatttcgccttcatcagcggcatgctgaagcagcggtccgggctggtgatcggccccgacaagctgtacctgctggaaagcagactgtcgccgcttgcccggcgccgtgggctgccgggactgtctgagctgatcgccgagctgcgcaagccgtcggcggaagaactccggcgtgacgtcacggatgcgatgacgacgaacgagacgtcgttcttccgcgacatcaagcccttcgaagagctgcgcaccttcgtcctgcccgagatgctgggccggcggcaggatcgccgccagctcaggatctggtcggccgccgcgtcgaccgggcaggaagcctataccatcgccatgctgttcaaggagatgggggccaagctcgacggctggcggctggagatcatcggcaccgaccttgccaacgaggtgctggacaaggccaaggctgcgacctattcgcagttcgaggtgcagcgcggcctgccgatcaccatgctggtgaagtatttccagcaggatggtgagcagtggcgcctgaaccagaccatccggtcgatggtgcagttccgtcagcacaacctgctgaatggggcttcgggcttcggcactttcgatgtcatcttctgccgcaacgtgctgatctacttcgatcaggacaccaagcggaaggtgctggaggatctgcgcaaggtgatcgcgcccgacggcttcctgttcctgggcggtgccgaaaccgtgctcggcatcaccgaccgcttccggccgctgccggatcaccggggcgtttacgtcccggcctgatccggcgcccgccgggcggcacaccacaggcaaaaacgacacagaaaaaaccgccggtggaatgtcttccgccggcggttttctttggggagtgccgacgcggcagccaggcggctgctggtcgctcaggcggcgtcggtgcgccgacggcccgatccgtcgtcaccactgcggctgcccagttccgggtccttcagcacatagccgcggccccagacggtgtggatgtagttgtcgccatgggtggcgctggtcagctttttgcgcagcttgcagacgaagacgtcgatgatcttcagctcgggctcgtcgatgccgccatagagatggttcaggaacatctctttggtcagcgtcgtgcccttgcgcagcgacagcagttccaggatggcgtattccttggcggtgagatggaccggccgctcgtcgaccgtgaccgactgcttgtccagatcgaccgtcagccggccggtgcggatcaccgactgggcatggccgcgcgaccggcgcaccaccgcctggatgcgcgcgaccagttccgccatatcgaagggcttggtgacatagtcgtcggcgccgacgcccaggcccttgatcttcttgtcggtatcggtcagccccgacaggatcagcaccggcgtctgaacccgggcggcgcgcagccggcgcaccacctcgtagccgtccatgtctggcagcatcagatccaggatcatgaggtcgtagtcatagagccgcccgatctcgaggccctcttcgccgagatcggtggtgtcgcagacgaacccttccttcttcagggcgagttcgatcgagcgggcagtcgacggatcgtcttcgacgagcagaatacgcatggatcagcaacctcttccgatcggcggcaatccgccagtcccgcacgtggtctggcgaccatggcgcgctggaacgacccttcttatgtcgtcccacggtatcacgtcaggattgtgatgaaaatcggacagacggctttgcgagcacttctcagggtgtaggatcgcttatcgggatatcgtccgcggatccgaaatgaaaagaggcggcggcagatggagaggcggcagatgaaagggccgggtcgatgcaggatctgatccgctctctggcgggcacgatcgaggcgctcgacagctacgtggtgcgcgggcgcatcgtggcggtgcgcgggctgatggccgaggccagcggcgtggctgcgcgcacggcccttggcgaccatgtccgcatccggctgcgtgacggcggcaggcttgcggccgaggtggtcggtttccgcgacggccgtgccctgctgatgcccttcggcccgctcgacggcgtggcgctgggggccgaggtggaggcgagcggcggcgaggcgaccatccgcccctccggaggctggctcggccgggtgatcgacggcttcggccggccgatcgacggcaagggaccgctggtgcccggcgcccgtccgcggccgatgcgggcgccgccgccgcccgcccatgcccgcacccgggtcggtgccaagatcgatctgggtgtgcgggtgctgaacactttcgtcacctgctgccgcggccagcgtctcggcatcttcgcggcctcgggcgtcggcaaatcggtgctgatgggcatgatcgcccgctataccgcggccgatgtctcggtggtggggctgatcggcgagcgtggccgcgaggtgcaggaattcatcgaaggggcgctcggccccgagggtctggcgcgcagcgtggtggtggtcgcaacctccgacgagccggcgctgatgcgccgccaggccgcctataccacgctcgcggtggccgagcatttccgcgaccagggcgccgatgtgctgtgcatgattgacagcatcacccgcttcgcccaggcgcagcgcgaaatcggcctggcggcgggcgagccgccggcgagcaagggcttcacgccatcggtcttcgccgaactgccccgcctgctggaacgggcggggcccggcaccggccagggctcgatcaccggcctgttcaccgtgctggtcgaaggcgacaaccacgacgagccggtggccgacgccacccgcggcattctcgacggccatatcgtgctggagcggtcgatcggcgaacgggggcgctatccggcggtgaatgtgctgcgcagcgtgtcgcgcaccatgcccgactgcaacacgcccgaacagaacgccgtcgtgatccgcgcccgccgcctgctgtcgacctatgaagacatggccgagatgatccgcctcggcgcctatcgcgccggttcggaccccgcggtcgacgaggcgatccgctatcacgaggggctggagcggttcctctcgcagggcaaggccgaacgcgcgacgctggccgaaggctatgaccagctcgcccagctgctcggcatgccgaagcccggaggctgatccccgatggcgaacccggtcaaggccctcgacgggctgatccgcctggcccgcaacggcgtcgatgccgcccggcgcaacgtcaccgcggtcgaagaccagatcaccgcgatcgaggccgacgacgcccggctggtcgccgaggtcgcggccgaaaaggcggcggcaggcaacgacccggcgatgatcgccggctgggtcgcctatgccggccgggtcgaccggaggcgggcagagatcgcccggcatctgacccttctgcgcaaggcccgcgaacgcgcgcttgaagacctggccgaggccttccgcaccgtgaagcgctatgaaatcgcccgcgacaaccgcctggcccgcgccgcccacgaggccgatctgcgcgaaaccgaccgcatggacgaaatcggcatggccggcttccggcgcaaggcggcggaggagggggagtagtcgggatggcccctcggcaagccgcaggtctcgtaagtcccgccactttccacccggaaacacttgaaccccaccccgcatctgcctacgcttgcgggcgtgacggacaacagatccgtcgcatacgacatcgtcgtccagcgtaaggaagatgggcatgaaaatccgtccctcgcacgactgcgtcgtcagccgcatcgcgtccggcaaggccacgcccggcggcaccgtcattcacagcacagcctgaccaccatcctgcgggatcgggtcttgcatggcccgattgcgccagggccggcacgtgatgccgccgggtctgcaccggccgggccacggtgtcggcaggggccgggggtccggtctgcctgatccatgcgggggtgcgccccgttcaggctgcccgatcttcggcagagagagaccggcatatccgcgcggagggaggcggagatgcccggggtggcgccttgcgcccccgttccggcgaagagaatgatgaagacgatgctccttcgcgccgcggtgatcgcggcgctgctgatgcccgccgccatcgcacccatggcggcttcggccgagaccagctcagggcccgacgggttctggatgaccaccccctatcccgatctggcggtgaagccgggcgagaccgcctcgattccgctgaccctgcgtaatcagggcctgccgccgcaacgcgcgacactcgacgtctcgggcctgcccgagggctggacctccacgctgaaaggtggcggccgcgagatcggcgcggtgatggtcggccccgacgaccgggagcggatcacgctggaggtgaccccgccgaagacgggcgccagggcgccggtgccgcttgcggtcaatgcccgccatgacggcgagaccacgaccctgccgctgaccatccggctgtcggatgcggcgggtggcgggctgaaactcgcccctgaactgccggcgctccgcggaaccgcgcgcaccaccttcagcttccggatcaaggtgaccaatcagagcggcgaggggggcctgttcaacctgtcggcccaggcgcccgacggtttccagacccggttcaagcgcggctacggcaccgaagaaatcaccggcctgccgatcgagcccggcgcgtccgagaccctgacgctggaggtggtgccgctgcgcaccgccccggccggccgctatccggtcaaggtcgcggtgaccggcggcgaggtcagcgccgccaccgatctcggcatcgagatcaccggccagcccgacctcgccatttcgggcccgcaggaacggctgtcgggcgatgtggtcgcgggcgagcagacagaattccccttcaccgtcaccaataccggctcggccccggccgaggggctggagatgtcggcgaccccgccctcgggctggaaagtcgaattcgcgccgcagcagatccccagcctggcccccggcgccgacgcccaggtggcggtcaggatcaccccgtcggaaaaggcggtggcgggggattacgtggttggcgtgcgcgccggcagcggcagtctttcgcaatcggtgcagttccgcaccaccgtcaccacctccacgctctgggggatgatcggcctgggcgtgatcgccgtggcggtgctggtgttggccggcgcggtgctgcgctatgggcggaggtgaagcgatgacgcccgaactctcatccagaccgaagggcaccgcgatcgcggccgccccggccgggccgccggtgatcgaggcgcgcggcctggtcaaacgctatggcgcggcggttgcggtcgccggcatcgaccttgaggtcggtgccggcgaggtggtcggcctgctcggccccaacggcgccggcaagaccaccaccatcctgatgctgctggggctgaccgaggccagcgcgggccaggtccgcatcctgggacacgacccgctgcgcgagccgctggcggtgaagcggcgggtcggctatctgcccgaccaggtcggtttctacgaggcgatgaccgcgcgcgagaacctggcctataccgcccgcctggccgggatcgacgggtcagaggccgcccgtcggatcctggcggcgctggagcgggtgcggctggtggaggttgccggccggcgggtttccaccttctcgcgcggcatgcgccagcgcctggggatcgccgaactgctgatgcgcgactgccgggtggtgatcctggacgagccgacctcggggctggatccgcaatcgacccgcgagctgctggcgctgatccgcagcctcgccgccgacggtatgaccgtgctgctctcgtctcacatgctggatgtggtcgagacggtgtgcacgcgggtggccctgttcaatcgcggccggatcggcttcatcggcacggtggaggcgctggccgcgcggatcggcggcggggtctatgtcatcgaggtggaggccgatgccggcgacctgccggccctgctgtcggggctcgacggcatcgaagccgtgatccccacggcccatggcggctggcagatcgaggcccgtgccgatctgcgggcggcgatcgcccggcggctggtcgaggccggcattgcactccacacgctggatctgaggcgcgtgcggctggacgaggcctatggccggttcttcgaggaggcggacagagatgcgtgagggatctcccttcaccggggtcggcacgatcgcgctcaaggaagcggccgaccatatgaccggggcgcggctgcatctgatcatgctgctcgtgctgctcaccgccgccggcgcgctttatggcgcgatcggcaccatccgtgccggggccaccgacgacacgtttctgttcctgaaactcttcaccaccgcccgccagccggtgccgtcctttgccgggctgctcggcttcctgctgccgctggtggcgatcgccctcggtttcgatgcgatcaatgccgaacacggccggcggacgatgagccgcctgctcgcccagccgatctatcgcgatgcgatcctgttcggcaaattcctgggcgggctgctggtgatcgcggtggcgatggtgacgctctggctcggcaccacggggctcggcatcctgttcctggggctgccgcccacgggggctgaggtgctgcgcggcctggcctatctggtggcgaccatcgcctatgccggggtctggctggcgctggcgatgacgctgtcgacggtgatccgctccaccgccacctcggcgctggcggcactctccatctggctggtgctgtcggtgttctggggcatgatcgcaccggtggtcgcctcggcgatttcgccggtcgatccgctgaacccgatgtcgctgatcgatgccttccagacccagcaggcggtggcgcggctctcgcctcagacgctttatggcgagatcaccgccatcctgctggacccggcggcccggtcggtggggccgttgttcatcgaccagctgcggggcgcgctgctcggcgccccgctgccgacgatcgaaagcctcgccatcgtctggccgcagatgtcggggttgatcgccgcgatgatcctgctgttcaccgcggcttacgtgctgttccagcgccaggagatcagggcctaggattgccgcccagggcgatcacgaggctgcgagatcacgaggttgcgggcgcccggccggccgtcgtgccggccgggccgtcccggtcggcctcgtcgccggcggtcatctgcagcacggcggcgatggtgccgaccacgatcaggctgacccagccggtggaatagctgccgctccattcaaagctgagcccgcccagccaggcacccaggaacgcgccgacctgatggctcaggaacatcaccccgaacagcgcgccgaaattggccgggccgaacaggccgttgatcagcccgctgaccggcggcaccacgctcagccacagaacccccatcgcggccgcaaagatcagcgtggtctcgacgctcaccggcaccacgaagaacacggcgatggcggcggtgcgcagcagatagatcagcgccagcacgttgcgattgccccagcgctggcagagatagccggcgcccagcgtgccgaaggcgttgcagatgccgatcagcgcgatcgcctgggcaccgacgatcggcggcaggccgcagatgccgatgaaattcggcagatgggtggcgatgaagatcagctgaaagccgcaggcgaagaaggcgatggtggtgatgatgaaggtgcggttgcccagcgcctggccgatcgccgcccgggcattgaccggcggcacggcccccgcggtggcgggtgcgggggcggggccgcgccggaacagcagcgtcgccaccgccatcagcgccgcgagcagggcaaggccgatcatggcgtcctgccaggtccagcgatcgatcatgccctgagcggccggtgcgatcacgaaggtgccgagcgatccggtcgcggccaggatcgacaccgccgtcgcccgcaccgccggggtcgccaggcgcgagacgatgccgaccagcacgccatgcgatgtgccggcgaccgcaagcccgatcagcagcccgccgcccagatagagcccgacatggctgccgctcgcggccagatagaggccgagaccatagagtgccgcggcgatcagcaccaccagccggccgccgaagcggtcgcagagcgcgcccatgaagggctggccgatgccccaggccaggttttgcaccgccatggcgaagccgaaggtggcgacggtgatgccggtgccgcgcaccattggctcgacgaacaggccgaggctttgcctcaaccccatggacagcgacaggatgataccggcggcgaccagcgacaggatcagcgccggggtccaggatcgtgcagcggcgtgtggcacgggggcgtcctcctcgtaagacatcccctcaacgatagagccgcacccggccctggaaactcactagtcggtatacatcagctcccgtgcggcggccggcgccaccgccgggctgccgcaggcgaccagcagcgccgccgcgcggccgccggccagggcataggcggtgtcgcggtggatcagcgtgtgcacgatcgcgccttccagcaggatcatgacctgccggccgaccagatcggggtcggcaacaccgcccgccgtcagctcctccaccagccaggcttcgaacctcttcttgtgatcggcggccatcaccacggcaggatggccgggttggccggccatctccagcgccgcccgggtaaagccgcacccccgccatccgggccgcttcgcagaattggccagcgccgtgaacatggccaggatccgatccggcaagggccggtcatcgggccccagccagctgcggtaccgctccaccgtcggcgcatcgcgcgcggccagataggcggcgatcagcgcatccttgctgtcgaaatgatagtacagcgtccgcttggtgacaccggcccgcgcggcgatcgcatccacgctgacactgcgcagaccctgttcataaaacagggcttcggcggcttcgatgatggtggtgcgggtggtgttttccatcgtttcgaaagccttccgttgatgaccgcgagacgggggatctgccgggctgctaaagcaacgccaaccgcgccatcagggccgggttcgaccagttcgggcggcgttcctcgaaggtgacgcgcaggccgcccgaggtggcgtcgagcagcaggaccagctggaggaagcggggcatgacttcgctgccgatgtcggcgatgacggcggcggctgctgcttcggggagcggccagggggtggcggcgaggtgggtcatgtaggtgtcgagcgcgtggcgcggcaggaccaggcggtcgggcacatagcgcaggcgccagagcaccgtggcggggggaccgtcttccgagaagcgcagcttcagccggccgcgatgttcgaccagatagtcatgggcgatcgccgggttgtcggcggtaaccagatgcgcgcgccgttcccccaccgcctgccagcggcggtcgagcgagctgatcgggtgctccgggtcggggcccggcggggtgtcgtcgtcggacatctcggcggatctcgtgaggaccggcctcggatgagaccggatcagccatcatagcgcgatcggaccggtcatgcgaccacgccgctgccatccgggcgcggcgccgggcgtgcatgggcgggcaggcgaatcggcggttcggttcgtatggcaagaccgccttgcaggcccgagaccgcgagcacgtcgtccatcacccgtgccagcgccgcggcggtgccgggcggcagggcgcgggcggtgcgcatcaccatgtcgacccggccgggagccgccaggccgtcgagctggatgtcgcccagacggctgagccgggtttcgaccacgaaacggcagatgccgtcgccgcgcccgccgccgtccccggtgccgtcatcatcccggcggggctggtggatgtggatctgcaccgggatgacggtggcattggcccagctcgggatctggacgctgcgccactcaccgcccaaggcctgaccggcggacgtctgggcgccgcggccggcgccgtcgaactcggacagtacggcacgggccgtgtcggcggcgtccagctcgttcagctcgtcggcgagtttgtccgcggccgcggggcggttgcccgagagcacctgtttcagcagcaccatcagattggcggcgaaatcccggccgggtgtcggcagcacgggggccagcaggcgttcggctgcggccggatgcagggtggcgatcagtcgcgcggcatcggccagggactgccagtcgcccgatgccgaggttccgggaagcggaacggcaggcgcgccgccgggggtggcaccgctgcggccggcgggcggggcttcgggcgccaccaccaccgccagtcgcgtgcccggcggcggcaacggcccgggccggtcgatcgacaaaaggccgagggcggtggagaccagcatccggccattgccgtcccggcccagcaccacgccggtcacacggctcgcctcgggcccgtgttcgggggccgggcggaccggcggcgcatcgtcggcagggatgcgggcgctgcggccggcctcggccaggatcagcgcgcgggtgcgctgcgccagttcgcgggcgccggccagatcctctccggccgcgaccggatcggcggccatcgtcgatgcgggatcggccggcatgggggcggtgggctccgcttgcacggctgtggtcggggcggcgggctgcgccggggaggtcggcaggggggccgctgccggagggggcgccgccgccggtgcgggcgccggtgcccagagcggccgggccaccggtgccgccccatcctctgccggccacccgcccgtcggaacgttgagcggctggaacccggccgccgacgcctgcggcagcgccgggcgcggcaaatcggcctcgggctggcggggctgggacgccggtgcctgggcgggcgtctgatatgccgtcggctccgcatgggggaccgtcgcgccggtggttggggccgtgccgggccaggcttgcatgggtggggtctgcacggacggagcctgtatggacggggccggcgtgggaggggcctggcgtggaggggagctgggccggcgggctggcggcaggccgggtcggatcgccgccatgggccgcggcatcaggcgtcgccaggaccgaagatccagccgggccgggcacgcgcggggcggctgcgtcggccggcagggctgcgggggcggggtgctgggccggcgaccgctgaacggcagggtctgccggcatggccgcttcaggctgcggcaccgtcggttgggtcacggccgaggtggccgtcgcggcaggcgcggcgccggcaggtggagcaccggcgctggcagccgcggcaggtggcgcctggacatgcggggctccggcggcgggtgcctccggtgcggaggctgtcgtgaacgggctctgcacgggcggtggtgcctgcggcgggcgggcggcggatggcgggggctgtgcagcctctggcgacggtgctgcggacatggccggcgccgggggttcccaggccgggggctgcggcgaggaggatgccgggcgccaggcggtttcagccgttgccacagccggccggcccggtgccgcgggttgcggctccggtgcggcttccggcgtgacatgtggcctctgggcgaggcctggcgatggcggcgcagccgctggtgtgccggtgggcgcggatgtcggagacggcaatgtcgggccggcggcgcggggcgcgtcggggagctgcgccagccaggcggttgcactgcccgcgggggccggcggctgcggcggttgtgtcgatgtccatggctgcggcccggccgcgggcgccggtgcccggccatcggatggcaggggggcgggcatgcggtgcggcagcgggccgcctgccggatcggcctgccagcccgtcgcgggcgcgggcggttgccaggcgccggcctgcatcgggctgggatcgggtgctgccatatgcggtggcggcgcggctgcgggtgccgctgcaccgggcaggggcggcgccggtgcggggacggcaggtgcggccagacccggtggaggggccggcatcgatgtggcgccggtcggggcgccggtcgggccggccggcggccaggatgcaggcggcggcgtgccgccggttgcaggccatggcgagcctgccggcgcagggggaaccggtgtagtgctgcctggtgatgctgcggtcggcaggggttgggggggagcgggctgacctgacggtcccggcgccggtgcggcctggccggggaggggcgccggtgccgcggctgtcggtccgggcgcgagggccggcagttccactgacagcagggtgagaccggtgccggccggtgcgcgggcggcccattccaccagccgggcgaccgggtcgacgccggtcggctggggccggggcgccgtgccagtggttccgcccagggttgtcgcggccgaggacgtggcggcccgggatgtcgcggcgggatggggcagcggcggcgacaggcggagcgccagcagggcgcggtcgcgctgcggtgtcgcggccgtctcgggatcgggggcttccggatcgggggtgggcaggcccatcgcctcgaccaatgcgcggccggcggcatcgagcagggtgaccggcacccggccgcgatgatccggcaggcggccgaccgaggcatggtccacccgtgccagaaccccgtcatcggcgagcaggccggcggcgaaagagggtgccggggcggcaggcggcgcggcccgtgccgaggcgggcgccgagggggctggcgtggccgccgtggcagaggcgggggcagaggcgagcgccgtgccgtcgcgcggcgccgcggtcagggccagctggccgagcggggtgcggaccagcggcctgccggcctcgtcgcggccgcgcagaaccaccggcagggcgatccggccggcggtgtcttcgggcggtgtgggctggcggacctcggacccgctggtcgtggccgtcgtgcgggccgtgccgtcggggccggtcaggcggggatcgccggggcggccggtctcggatccctggaggccggtggtgccctgctggcggacgggccggccatcggcggtggtggcggcccggccgtcggggctgcgcggatcggggggcggtgcgtccccggggcggcggggaagctggccgggcggctggtcgccggtgccggggttgcggccgccggttgcatcgcgctgcacggcgccgtcctgccggctgcccgtccggccgggatcgcccgccggggtctgggaagcctggccctgatccggcgcacgtcgctggcccgcgccgtcacgtcctgtcgccccctctcgtccaccggccgggcggccgtcgacggaggtgcggatcagggcggctgggatggcaggcgggatgatgtcgaccatggcgtcccgggcggatgcgcggatgacccggcagattttgccgggtcagggcaattattgccgggtgccacgcaagtttcgtgcagaaaacgccccgtcggccctgtattccgtcagagggtcagttcgccggcgatcttgtcgacgtccatggccgccggggcgttggggtggcggatggtcagcggcgtctggcggcggatggcctcgcgcaccagcttgtcgcggcgcacgatgccggcaagcctgggcgcgacgcccaggaagttctgggcggcattgcgcagggtttcataggtgcggaagccgccggcctggctgtcggccatgttgaccacgatgcgctggtcggcctcggggttgtcgcgcagcatcgccttcacgaaggcataggcatcggtgatcgaggtcggctcgtcggtggtcaccaccagggcggtgccggcggtggcggccagcgcccgcaccgactgatcgagcccggcggccagatcgatcagcacggtatcatactggcgcgcggcctgaacgatgccgaggcgcagcatggcgacccgttccgccggcagccggcccagcgagccggaccccgagcggccgggcagaatgtcgaagccgccggcctcgtagctgctgatcgcctcggcaaagccgatccggccggtgacgacacccgccagatcggtgggcggcgtcagccccagctgaacgtcgacattggcgaggcccagatcgccgtcgaacagcagcacccgccgcccgcggcgggcgagcgcgccggcgagcgtgatcgagaaccacgtcttgccgacgccccccttgccggaggcgatggcgacgacgttgcgggcgcgcagcttcgcggcgggatgtatgtgaaccgaacggtcgacgttcatgggcggatctcggcgtctcggtcgagcttggcggggcggaggttcagcggatctctaagcaagagttgcgccaacccggtcgcgctcaacgggttcagtccttcggaaacatgagcggtcacgctggcctccgacagccggacgcgtgccgcggcggcggcgcagatcactgcgcccaatcgcctggcaccgtcgagccgggtgcagatcgcccgtctgggatgcagcaccgagaaggcggccccctggtcggcggcctcgaacgggtcgatcccggccggcagcaccagcacgggttccagttcggccgcatcgagcagggtggcgagttcctcggtctcttcggtgaagaaggggttcacgccggcggtatccaccagcagggtcatcggctctcccgctgcgtcggcccgggcacgggcggcgacgcgggccagttcccgcgacgagccggcgaccagcaggtcgatgccgagcaggccggtataggcggcgagctgttccaccccaccggcgcggatggtatcggccgtcaccaccgtcagccgccggccctgggtgagggcgcgggcggcgagtttggcgacggtcacggtcttgccggcgccggcaaggccgatcagcgccagcgcctggggccggccggccgtgcggccaagcgggtcgaaacccaccacccggtccagcgcctgggccagcgcccgatccggcgcctcgcccgcccgcagccgttcgcggaccatggccagcagccgccggccggtctggccgccgacaccatggaaggcgagcgcccgttcgatctgggcgagttctggcgagaccgccttggagacggtctccggatcctcctctgccgcagcggcttcccggcgggcggtcgcagcggcggccggcgtgatcgatgcggtttcctcgcgctcgaactccagctcgatctcgtcgtcgacatcatcggcgcggctgcgaagcccgggccgcgccgggggcgaggcgggcggcagatcggggggcggtgccgccggcggcacggcgcgcgggccgctgcgcaagggcatctcggccgcgcccgggcgcctgcgaccggcagcggcccggcgttcggccagcaccgcttccgcggccggcacggcggcgggcaggctggcgggcgtggcgacggagggtcgcgcggccccatccaccgcggcggtcaccaccacgccgcggccgtcttcggccggcacggtggcgacgatgatcgcgtcctcgcccagcaccttgcgcacctcggcaagcgcctgggccatgttgcgggcctggaaggtcttcagccgcatgggcagacctcccggggccggttgatggctgtccggcggtcaccggcccgaaggcgtcggagctgagacgtcgacagcaaactcatcagatctgggccaccgttcggatgcgggcgcgggaatcgatctcgttctgggacatgaccacggtcatgggccggaagcgctcgatgatcgaacggacatagggtctgatcatggggctggtcaacagcaccggtgtctcacccagcatcgcctgacgctcgaagctctgccggacacgcgaaatgaactcctgaagcttggtcggcgccatggccagctgtttctcgtcgccctggccgaccaggctctcggcgaaggcatgctcccaatcgggcgacagcgtcacgatcggcacataaccctgttccgaaatcaccgaggcgcagatctggcgggcgagccttgcgcggacatgttcggtgatcagcatggcggactgggtatagctgcaggcctccgacacgccttccaggatggtcggcatatcgcggatcgagatccgctcgcgcagcaggttctgcagcacccgctgcagcccgccgaccgtgatctggctgggcacgatctcggccacggtcttctggtggtcggggcccagctcgtcgagcagtttctgcgtctccaggcgcgagagcagctcgggcatgtactctttcaccatctcggtcagatgggtggtgagcacggttgccgggtcgaccacggtcaggccgcggaaatgtgcctcttcgcgccgggtctcgtccacccatttggccggcaggccgaaagtgggctcggtggtctcttcgccgggcagcgagatcggctcaccgcgcggatccatcaccagcagcatggcggggcgcagctcgccgcgcccggcctcgatctctttcacgcgcaggacataggtgttggcgggcagctgcatattgtcctggatgcgcaccgccggcatcacgaagcccagatcgccggcgatctggcggcgcagcgccttgatctgctcggtcagccggtggccgcgctcttccgaaatcagcggcagcaggccatagcccagctcgatgcggaccagatcgatgtgcagcgccgaggaaatcggctcgtccatcggcacggccggcggcgggatgtcggcctcggcggcttccaccgccagacgctggctgcgcttcatcagccgccaggtcatgaagcccagcacgaccgcgaaaccccagaagggcacggtcgggatgccgggtagaagccccatgaacagcagcaggccggccgcgacgcccagcgccttgggatagcggccaagctggccgatgatcgcctggtcggcggtgccgatgatgccggatttggtgaccagcaggccggcgccggtggagatcagcagggccgggatctgcgagaccagaccgtcgccgacggtcagcagcgtatagctgcgcagcgcctcgttgaaggtgatgccctgctgcaccgtgccgatgatgatgccgcccaccacgttgatcacggtgatcagcaggccggcgatggcatcgccgcgcacgaatttcgccgcaccgtccatggcaccgaagaaggtgctttcgtcctccagctctttgcgccgggtgcgggcggcggcctcgtcgatcagcccggcggacaggtcggcgtcgatggccatctgcttgccgggcatggcgtccaggctgaagcgcgccgacacttcggcgatgcggcccgaacccttggtgatgaccacgaaattgatcagcaccaggatgatgaagaccaccacgccgatcaggaagttgccacccatcacgaactggccgaaggcctcgatcacctggccggcggccgatgtgccctcgtggccatggctcaggatcaggcgcgtcgaggcgatgttcagcgccaggcggaacatcgtcgagaccagaaggatggtcgggaaagagctgaaatccagcggtttctggatgaacagcgtgatcagcaggatgacgaccgacaggctgatcgacatcgacagcagcaggtcgagcgtccaggtcggcaccggaaagatcatgacgatcaggatgccgagcatgcccagcgccacgaccagatcggcactgccgagcatggcgccaagccggccgagcaggccgccgccgccaccgcccggcccgccgccctgcggcatgccgccggggccgcgtccggtcacgggtgtcggaagaccgcctcgttcagccatcggtagcagccttggtcatgcatccatcccccgccacggtgtgatcgccccggatcagcggtcgtaggcgccggagcgttcgaaatccccgcccgccggcggcggcaccgccacgccttcttcggcatacagcttcagcttgttgcgcagcgtgcggatcgaaatgccgaggatcgtggcggcatgggtgcggttgcccaggcagtgctggatggtgttgatgatcaggtcgcgctccacctccgccaccgtccggccgaccagggcgcgggtggcgtcctcgtcgtcggcggcgaccggtgcggccggggccgccggggcgaagccggccggctggccataggccgcgggcggcacgccataggccgcgggtggcccgccataggggttggcataggggttgtgcgcgggcacgcccgccggtgccgcaggcgcgcgcgggggctggaaatcctgccgccgggccgcggcggtcgccaggctggtgccgtcggccagcatgatcgcctcggcaccgatctcggtgccgcgggccagcagcaccgcccggtgcatggtgttttcaagctcgcggacattgcccggccagtcataggtcagcagcaggttgcgcgcgtcgggcgacagcggccggtcgggcagggcattggcggcggcatagcgctgcacgaaatgatcggccagcgccgccacgtccgacggccgctcgcgcagcgacggcaggcgcagattgaccacgttcaggcggaaatagaggtcttcgcggaaattgccgcggcggacctcgtcttccagattgcggttggaggtcgcgatcaggcggatgtcgaccttgaccggccgggtgccgccgacccggtcgacctcgcgttcctggatcacgcgcagcagcttggcctgcaggcgcgggtccatctcgctgatctcgtccagcagcagcgtgccgccatcggcctcttcgaacttgccgacccggcgggcgacggcgccggtgaaggcgcccttctcgtggccgaacagctcgctttccagcaggttttcagggatggcggcgcagttgaccgacacgaagcgctggtcggcccggcggctcttgcggtgcaggaagcgcgccatgacctccttacccgtgccgctttcgccggtgatcagcaccgtggcatcggcgggcgcgatctgttcggccagcgacaccacccgttccatggccgggtcgcggaagatcagcgcatggtcttcggacgcgaccgcctccagcaccgccgcgatcagctccgggtccggcggcagggggatgtattcgcgtgcgcccgccttgatggcgcgcacggcggcctgggcatccgcccccaccccgcaggcgacgaccgagacatggatgcgttcctgttccaggcttcggaccagacggccgatgtcgagaccgacatcgaccatcaccagctccgccccatggccggcacgcagatggtccagcgccgcttccacgtcgggaacctgcgacaccttggcgccgcgcgacacggcgatgcgcgtcgccgcgccgatctggccgcccagggaaccgatgatcagaagtcgcatctcggggttactcctgccgccgttacgccccggggggcgtcaccggcattcttgaaccggaactcgtcgtcttgtggggtcgttccgcacgggcggcggcccctggtgtcttggtcagtcgtagaactggatccgctttgccgggggcagcatcgcgttcagggtcagctccagccggcgggggttctcctgccggccgatcgaggtcgcccccgccagaaagatctgcttgaacatctgctcctccatggagttgcgttccagcttgcccgccagcgggttgaacaccatgttcgccagcaccgcgccgtagaaggtggtgagcagcgccaccgccatcgccgggccgatggtgctggggtcttccagattgcccagcatctgcaccagacccaccagcgtgccgatcagccccatcgcgggcgccacttcggccgaacgcttcaggatctgggccgactgcatatggcgataggccatctgcgaaatgtcgcgcttcaggatccgctccacgtcttccaccggtatgccgtcgaccaccatgctcaatgccttgtgcaggaagggttctccctgcagctgggccagcgtctgctgcaggcccagcacgcccttgcgccgggcctgatccgccagttccaccacctgcatcgccgccttcgacggatcgaccggcttcgacaccatggtcttcaccagcagcttctgggcccggatcacctcggccagagagaagttgaccatggtgatgaagaaggtgccgccgatgacgatcaggatcgacgggatgtcgatgaaggcgccgaccgagccgccgaggatgatggccgccgccaccagaaggaagccgacgataaggccgatgacggttgcgagatccatgaggtcctgggttccggtccggtccgacgtggaaggcggtggggggcgagggcaggcgctggaggttgacgtcagaaaagaacggtgtgcggaccggaaggtcagccgcgatcggtcttgatgatttcggtcatggtcacacccagccggtcttccacgacgacgacttcgccgcgggccaccagccggtcgttcacatagatgtccaccgcctcgccgaccttgcggtccagctccaccaccgcgccgcggcccagcttcagcagctggttcacctgcatggtggccttgcccagcaccgccgagacctgcaccggcacctgatagacggcttcgaggtcggcggcactgcgcggcacgtcggggacctgctggtccatctcgtcgcgcgagggctcccggcggcgctcgccgtcgaattcctcgaggctcagattgtccttgtcgtcggccatcgatgatctccgcgccgcggcgccggttggagggacaagaggggtgaaacggaagaaggcgtcaggtcatcattcggacggagcatgccccggcgtcaagtgctccatgccggaaccgtgccccgacgcggtcgcctccgccagggtttcgtcgatccgctgcaggatatcctcgcgtgagagcacggccatgccgcccggccagaccagccgggcatcgcccggcgcgatgcccggatcggcgatcacccggcactggcccagaacgccttcctcggccagcaccggcgccacgcgcgcgctcatcaccgcctcggcggcggggttcacgtgcagcaccgcctcgccggtctcggcgatgccggcgatgcagtcgcgcagcatggtctcgatccggtccagacgctgttcctcggtgcagcccagcttgaccgcaatcatgcgggccagccggaccagatcggcggtggtcgcatccagccggtcgtgccagccatggatggcctcggccgactggcgttccagccgctgaatggcctgcagggtttgctgctcgatcgcggccagcgcctgggcggcacctgcccgccggccttcctcgaaggcggcggcctgggcctcggcgagttgggcttccgagaaggtcggcggcggcgggggcggtggcggcacgggggcggcttcgaccaccggctcgggcttcttcttgcgcggccgcccgaaatcgatgtcgtcgtcgaagctgacgtcgaaggtgaacttcttgtagcccgccatgtctctgccgttcctccggggccggatgccgtgactgcggatcctcagtagaccaggacgtcgtcgcccttgccgtcggcgatgacgatttcgcccttgtcggccaggtccttggcgaccatcaccatgtaggcctgggcctcgtcgacgtcgcgcagccggaccggacccatcgccgccatgtcttcgcgcagcatcttgccggcgcgttccgacatgttctggacgaacagctcgcggatcttttccgacgcgcccttcagcgccagcgccagcttgtccttgtcgaccacgcgcagcaccgtctgcacgccggtgggggccagattgcccagatcctcgaacgtgaacatgagcgagcggatcttctcggccgaatccttgttgcggccttccagcgcgtccaggaagcgcgattccgcctgccggtcgaggttgttgaagatctcggccatcatctcgtgggcgtcgcggcggctggtgcgggccaggttgctcatgaactcggccctgagcgtgcgctcgaccccgtcgagcacctctttctggaccggctccatgcgcagcatgcgcatcaccacttccatggcgaaatcatcgggcagggcggccaggatccgggcgctgtgttccggccggaccttggagagcaccaccgcaacggtctgcgggtattcgttcttcagataattggccaggatctgctcgttcacattgccgagcttgtcccacatggtgcgacccgcgggaccgcggatctcttccatgatcgcctcgatccgttccttctccaggcccgatgccagcagcaggcgctcggtggtctcgaaggtgccgaccagggtggaggtggacgagatctgttcggcgaaatcgaccagcagcccctcgaccatttcggacgagaccttgccgagcgaggccatgacctgcgaaatctcgcggatctcgtcgtcctccatcatgcggaagagcttggcggcgtattcatcgcccagcgccagcagcaggatggcggctttttcggggccgcccagcccccggagttcactcttgccacgtgccatggaggctcaatcctcttcccggatccacgaacggatcacggccagtgcttcttcgggatggcggtcgacgatttcggcgatcttgcggatcgaggactgccgcacccggccctcgacctggctgatgtcgatcatcgcctcgctgctttcgatggcggcggccagcgcccgttcggcggtggggccggccagggccggaaccgggttgccgtcggggccgggcagggcggccatgggggtgccgtcgggaccggggatcatggtcacgccaccgacgccgcccatgccgccggcaccggctgccgcacccgcgggctgcgggcccagccggccgaccagcggccgcagcaccagcaggatgaccagcagggccacgatcgccagcaccaccatttcggcgatgcgcatatagtcgctggtctccagccccagcaggccggcattcaccaccgtctcctggctgcgggcgaagggcaggttcaccacttcgatccggtcgccgcgctcgtcatcggcgcccacggcggagcggaccagctgggtcagacgctccatctcgtcggcggcgcggggctgataggtctgggtgccgtcatcggcggtgacataggtgccgtcgaccagcacggccacagacagccgcttgaccgcaccgccctcgcggacctcgttgcgcacggtgcgcgagatttcgtaattgaccgtctggccgtcgcggttggactgggtgcggttgccgcccgccccctggccctgctgggcatcggggatgttattggacgcagtcaccgcctcgtcgccggcctcggtcgacagctcgttctcgcggttcacctggcgggaccggatcacctggccatcggggtcgaaggtttcctgcgagatggtcacgcggttgtggtcgatctcggcatggacttcgacctgcacccggccggggccgaccgattcttcgatcaggcgggtgacctgggcgcgcagctggctttcgacgttctggcggacctcttcggcggcggtgagggcggcacccggggcgccttccgtgccgccgtcgccgcgggcgagcagggtgccgcgatcatcggcgatcgccacccgttccgggcgcagccccggcacggcggccgcgaccagctgctggatggcccgcacctggccctgggtcaggctgcggccgcccttggggctgaccacgatcgaggcggtgggctcggcctgattgcgcgagaacagttcccgccgcggcagcacgatatggacccgggcggccgaaaccgcatcaatggtcatgatcgtgcgctgcagctcgccttccagcgcgcggaccagattgacgttctgggcgaaatcggtggtgccaaggccttcggagcgatcaaagatctcgtaaccgatcgatccgcccttgggcaggccgccttcggcgagcgtcaggcgcagccgggcgatctgatcctgcggcaccatgatccggcggccgtcggggctgagcgtgtagggcacgcccgcctgttccagttccgccacgaccgaggccgcatcggcagtgtcgaggtcgccatagagcaggcccatggtcgggctgcccagccgggtggccaggaagaccgcgaagatcagcagaccgcccgccacggcacccagtgccgcaagccgcgccggccccaatcccttcagtgcctgcatccaggccttcagcgtatccgccatgagacccgttccactccgtctcgcaatgccccgatcggggcgcccgacgatcctctttccgcgatgcctgaccccgggtctggggatcggcacgcacgaagaagccgggcgatgcagtgcaccgcccacccctgtttacgcgatctttggtgaacagaaggttaatgcccggcagattttgccgggtgggcggcaaaaatttccgcccggatcatactgtggttcaacgcaatggcaatgtcttgtttttgcgaaaaatacagagaaatccgcggcgatgatgtccgcggaccggggccgcgccggcaggggggaggtggcgggcggaggatcggtgtcttaacgaaaggtaagcatttgccgggattgtgcggtcagatcaacccttgcgtccgcggcgggaacggctggcgatcagccggctggcctcggcgccatgggtctggcgccagctttcgaactcttcgaggctgagggcatagcgccggcagatctcgtcgagggctgcggcaccggccatcaccgccgccacgacctcgatcttccgtcgggcgacccacctgaccccgttgccgggcggcaggtcgaaacgcagcgtggtggaccgcttctgccggggaggcttctccggcaggacgagaacattgccgtcggtggcctcggcaatgtcgggcgctggggataccagcttcaacctgggtgtggtcatcggaagggcggtctcgcaacggttgcggggcatagggcgacctcgcccgaacacccgacacggatccgatgctagtccgatgtgtttaacaaaatctgaaggccggcagaacgacgccgggcaccacggcccgcgcccccttttttcgggggcggggcgcggtgcccggcgtcgttggcgtgggtgccgccaggatcagcgcttggtgctgatgatttcctgcagcatctcgtcgacggtggtgatgatcttcgagctggccgaataggcgcgctgggtgatgatcatgtcggtgaattccgacgccaggtcgacattcgaggtctcgagcgaagagggcgagatcaggccggcgccgctctggcccgaggcgcgcaggttgaaattgcccgacttgtcggtctgggcaaagacgttgccggtgcgctcctgcaggttctgcgggctggcgaaggtcgcgatcggcagcttgtagagctgcttctgctcgccattgctgaacgaggcgaccacgaagccgtcggcgtcgatcttcacctcggtcaactcgcccgaggaggcgccgttctggctgaggtcgcggacctcgtagtcgccggcatactgccgcagaccatcggcctgaccggtgccgagcgggccggcggtgccccagtcgatggtgatgtccgacgagcccgcaccggccgcccagtcgatatgcagcgcgtcggtcagagaagtggacaccgtgttgagcgtgccgtcggaattgaaggtgacgacgccggcggcgatctgcgcctcgggggtcggcgcggtggtgacgacgtcgttcttgtcgacggcgttgatttcaaccgcccattcgttgttgccgaccttcaggaagttgaccatcagatcgtggccgcggccctgaccgtcatagacgcgcaccgagcggctgaaatcggacgagacggcacccgagctcatgttgagcgcgctgtcggaggcatcataggtggcggcgaccggggtgccggcagtgtcgagggcgagggagccgctggctgcggttccggacacgtccagcgtccggcgcggatcataggccgagatcgagatcgtgccggcggtggcggtgccacccagctcggcgacgaagctgccggtgccttccaccagatcggccagttcggccagggtcgagaactcacccgtacccgtgcccgcggtgaaggtcaccgtgttcaccccgtccgacagggtgatcgtctggccggcggtgacgacgccggccgcgatcagatcgtcggaggtggagacgccgggggtcgaggtgctggtcgaggtggcgccggtataggtctcctgattggtgttcaggttgaccgcgaccgtcatttcggtcgtcgccactgccgtaccgctgatctggccgacattcaccgtctcaaggctcgaaatatcggccgaggaggtggtgttggtcacgttgccagcctcgcccggcagacggccggccgaatcgagcggccagccctgcaggtagaagccggcggcgttgcgcagatagccctgctcgtcgggcacgaaagagccggcgcgggtatagagcacctcgttggtgcccgtggccttgccttcgacgacgaagaagccgtcacccgaaatcgccacgtccagacccgaggtcgtgccctgcaccaggccctgctggtcgatcagctgctgcacgctggcgcgcacaccgcccggggcgtagaaggactcggaaccgctgtcggtgaccagggtctggaagttggtggtcttcgccttgtagcccacggtgttgacgttggcgatgttgtccgagatgacgcccatcgccgtgctctgggcacccaggcccgacacaccggaatagagcgagccatagagaccgaagctcatcaggggcactcctcaatcatgggggcggggcacgtccgcccgcctgattctgactttcgggccggggtgtctggtccaccggccgatggttctgacgggctgccgtcctggcgacccgcccaagctctgaaggtcggcgcggtctgcgccgtcgcttcccgagatccttaagccgcggccgcttcctgagccgcgagaagtgtcgactggtcgatgagaccggagttgtagagctgctggagggccttcagcgtggcgtcggcctcgctggttgcggccgaggcatcgcggatgccggtcacttcggagagcgggatttccaccccgttcacgttcagcacgacattgccgttggtgatgccgacgctgtcgacggtgccggtgatggaggtggtgaccgcgatcgtcttgcccgtggcatcgagcgcggtgacgctcatccggtactggccgtcttccagcagcttgccctcgctgtccttgccatcccattcatagttgtgcacgcccgccgtggtctcgcccgcttcggagcggaccaccttgccgctttcgtcgatgatgttgacggtcaccttttcggcgttctcgggcaggcggtagtgatagctggcgctgccgtcggtcatctggatcgtgtcgccattggcgtcgacgaccttgccgatatacgaggcggcgtttgcaacctgctggccttccgacagcgagatcaggctctccagattgctgttggactggacgagctgctcggtctgcgtgaacagaaccagctggttggtgaattcgttggtgtcgagcggattggtcgggtcctggttcttgagctgcgtggtcagcagcgtcaggaactgatcgaaatcatcggcgagcttgttgttggcgatcgtcgccttcgacgtcgtcgcggtggtcgtcgtggtgttcgtgacggagctggtcgccatgatgtcctctgctcctctcgcctcagatccgcatgtcgacgcggcggccgtcgattgtggccacctggtccgccgccaggccgttcagactgccgatcccggccagcgggtcgcgatcgatattcgtgtcgcggtcgcggcgcggggcgccattgccgcggcggttgccgtcaccggccattccgttaaaaccctggcctgcgaagttctggcccgcaaagccctggccctgctgaccggagccctgctgccccgccatctgctgtccccccgcctggttggcgagcgaacggtcgatgtcgtagcgcagcgcgcccggctcgatcttgaacccggcctgggtgaggctgcgttccagatcgcccgcatcggcggagagggcatcgacggcttccggcttttcggccgagaagcgggcactgatccggccctgggcgtcgatcttcatttcgacccggacccggccaagatcggccggcatcagggtcatcacgaagtggctctcaccacctgccagcggcataccacctgccggagacatgctgcctgccaaggccgtatgcatgtgctgtgccacctgcatcgccggccggcccggtgcggcatcctgcatcggcagggcctgggtctggccggtccagccggtgcggagctggccggtttcgggcaggcccatcgccgctgccagatcgccgccggccgccaaggggcggctcgcctcgtcgaaactggtcatggccgaaagggctgctgcaccggcgggaagggcctggatcggggcctgaaccctgggatttgcggcctcccgggccggttcggcggcggaacgcggggcagcggtcggctcggcatcggtctgccgggcgccggcggctgcgtccggtcgggcaaccatcggctggacggcctcgtccgtccgggccgtcgcgacgggggcgacatcggctgcggcgggtgccgccggggccgccgccatctccgtgcggccggccggcggatcctgccggggcgcgaggttctgaccggctgcgcgggcatttcctgccggggcggcagtttctgccgtcggcgcggcggtcggcacggcagtccttgccgtctgcggcgccggggctgccgggggttcgacggccggcgcccggtcggtctggatccggtcggcctggacctcagtagccggtgcctgaacggtcggtgcccgcacggctgtggcctgcgtggccggggcctgcatggtgggggcctcggcggtccccggggcgctccggccagcggccgccggcacggtcgctgcctgggtggtcgtcacccgaacaggcgccgcctgaacggtgccgtcggtgatggtcgccgtctcgggcacgtcgcgcccggccggggtggtttccgccatcgatgccgcctgcggggccggtttcgtctcggcggagggggccgtcggggcggtgcgggcatcgccggcgaccgggccggcgtcgttcgccatcaccgtcggggcaatgatggtcggctgtgccggcatctccacctgcggccgcgcggccgggcgggtatccgccacgtcacgcggcgcgacggtcggcgtcgtgtcggccgtcgcaagaaccgtgaccgggcggtcgacggccggaccatcgatcaccggtgccgtttccgaaccggtcatgggggcagccgggcggccggccggggcaggggccccggctgccgccggctctgccgaaaccagcgccgcatcgggggtggcgttgcgaccggtcgggaccgaggtcgtatcggtgtgggcggtgaaggcgacggtgcggccggccgggcgcgccagaccgatgggcaggtccatccgcgccaccagctcgccgcccatcatgtccacggcctggtcggcggcgaccggctggcgggtgcgggtggtgaccacgccgtcattgccggcccggaccgtcaccgccagaacggcgtcgtcgcccgccggcgggttgtcgagcgcggtcgaaaccgcgtcttcgaagctgatcgcccccggtacggtgacggtctgcccgaccacggctgcatcgggcagagcgggtgcgtcgggcagggcgggcgctgccgcgggcggctgcgccacgccggccaccacgacctcgtcgggggtaagcgtcaggggtgccgcagccgtcgtcgcgggcgcaaggattgccggtgcaggggccgcggcgctcgcgaccgccgccagcgtcgccggatcgatctcgtcgtcttcatcggcgatggcgcggggggcgcgcggcgcctggccggcgggggcctctgtgccggccggtcgcccgggctggaggtcgacgcggccctcgggcatggccggcgcgctgtccatgcggatgcgggcggtatcgatcaccaccgcggccgcggtcaccgcgcgggcggccagatcctggccaagcggcaaggacgtggcggtatcggtaccgctcggggtatcggtcacccgcgcttctgcgctcgcctgcgtcttcgtgtcgacaaggaactcgggcgccgggcgatcgacggcagcaattgccggtcccggcaaatcctgccggggggaaactgccggatcggtggcgtggcgcggaggctccgccgtggggcgcggaggctccgccgtggtctcagcgcctgccgctgcgtgcgccatgggcggtgtgttcgcagccaccggggtctgcggcgcctctgccgccatcggggtggcgggggcggcggccggggatgcgggcgtatcggcgccctggtccgccgtcacaccgaccgtgcggccggccggggcaggaatggcgggaccggaagccgagggggtggcctgccgctcgggggcggtgggctgggccggggcagagggctgggccggggcacgcacctcgcccgccacatcggcggccgccgtcacatgtgcggcaagcagcgcctggaaggcggctgcactgtcgtccgacaccgtcacggcctgaggggcagccgtgccgccggcagatccggtggaacggccgatcaggcccgacaaaagttcggtcagcgatgcgggggcaacagcggacatcggcaacggctttcgaccggggggccgcaccccgacggtcgggaatgcgtgcgcccccggaaacagcaagtactgtgccagtcacgggtcggatatgcgggtgtgcgcgagaggtcagtccgcccgtcgggcgtcgggtgcggccagcggcaggtcgaagcacgaggtggtgccccggccctcggcgctttcaagcgtcagcgtgccaccctgcaattccaccagcatgcggctgatggtcaggccgagcccggtgcccttgacctgggtttcggcaccgccgttgcgcgcctgctcgtaggggcgcatcagccgtgccagatcttccggcgcgatgccgggaccttcatcgctgatcgccacgatgaagcgatcgttctgcacccggttgtcgacggtgatcgacccgccgggcgggctgtatttgatggcgttcgacagcaggttcagcatcacctgcttgagcgcgcggtcgtcggcgacgatctcgggcgaggggcgcagcggtgtccaggcgatccgcacccgcttttcgatcgcaagcccgccgaccacgcgaatggtctgcgacagcaccggattggcggccatggcggttggtgtgacgtcgtatttgccggcctcgatcttggccatgtcgagcaggtcgttgatgatcgagagcaggtgcttgccgctgccgtggatcgagttcagatagcccagataagtctcgttgccgatcggtcccagaacctgctgttccatcagctcggcaaaaccgatgatcgcggtcagcggcgtgcgcagttcgtgggtcagcgtggccaggaacagcgatttctgctgaaaggcgccttcggcggacagccgctgggcgtagttttcctcggccagccggaccagttcttccgcctgctgttccagaaggctgctctgatgggtcagttcggcctcgtgtgcggccaggcggtcggcctgatcgagggcggtcgccactgtcacgcccagatccatcaccgcgcacagggcgtcgagctgtcgctgcagaatggcggtggcgtgggcatccatgcgcgggcagccgtccagcgccagaacggcgatcgtggtgccgtctttcgcccggatcgcggccagcagcagatcctcatcgccttcgctgctcagctgacgtgtcacccggtcgaacaggtcctgggaagcggagctgccacgcccatcggcctgtgtgcccgcaaggacacgcgggccgcgttcatccagcccgaccaacagaccggcggttgcgtcgagcgccgaggccgccgccgttacgagctggctcaacgccggcgcagactccgatccgagaacccgatagcggcgcagcgtctcgattttccgccggtcggtggtcaggtcgaacgtcatctctcctgcgcggcccggtcgccgcccgcggtggcgcgcccgttccacagtgcagggcgcatgatgtgtcctggttaacccgtggtgacggtcctgtccacagcattccgcgtgacgaatatgggactcagcgaccaccgatgtcttcgggcatatccgtgtacgcctgctggtggtattccacccgtgatagcagagcgaccatgcgccggtcgtggatgccggcggcgtcgagcgcccccacgcaggcccgcagatagtcggccgacgagccgagttcgcctgcggcatgggcgatgatccgggcggtctgatcttccgtcagccggccggcatagcgttcatgggcggggttgatcacgaaagtcagggccggcacgggcccgtcgggtgtctgggccgatacccagcgcggcaagtaagaggcggtcagcatctcgcgccgccagatcagggcaagttcggcgcgccagtcggccggatcgggcatcagggtcatggcggtgcacgagccgccccggtcgagcgccagcatcagcccgggctgatcgggcgtgccgcggccgaagggcatccacaggcagaagctgcggtgcagccccaccacccgcgcacgccgccgctcggtgatcgccacgcaagggttccacatcagcgagccatagccgaacagccgcggtgcgccgcccgcgaaagcgccgggcggggcggtgtcgagcatctcttccagcgactgcgccagctcggcatcgtccagaatgtggatgtgcggataaagccgggcgaagcggcggcggatctcgtcggcctgcagcatttcgcgggtgacgccatgcggcccgccgccggcgagcggcccatccgccgttccggagccggtggtggctcccgaagcggcggtggtctcggaaagggcggccgcacgcccgttgtcgggtgaggtcatgccgtggcgtcaccgatgatggccggcggcctgcggaagtgtggcgcaggccccgtggagaatgacagtatagcgacgcagcgaccttttgtctcggcgcgccgcagcggcgaacgcaattgatcggcatgcgaaataatacaacagtcttgcgtatcttgcctctcagaggctaacacttggacgacacgaacggccccgggcagggaaacggccggtgaagaccggcacagccgagggccgcgccccaggaggaagcacatgcccatgcgtatcgaagagggcgccgaactctggcgcccctcggccgagaccgtcgaggccgcgcgcatcacagatttcatgcgctggctcgcggccgagcgcggcgtcgaaaccggcgattacgaggcgcttcgccgctggtcggtgaccgagcccgcggccttctggcaggcgctgatcgaccgcttcggcatccgcttctccagcccggccgaaaccccgatcgcctcggaagagatgccgggggcggtgtggtttccgggggccatgatcaactatgcccgcgtcgccttcgatcaggcccggccgggcgaggtcgcgatcttccatcagtcggaagtccgcccgctccgggcgctgacctgggacgatttcgaggtgaaggtgcgggcgttgatgggccggctgcgcgccatgggcgtgaagcccggcgaccgggtcgcggcctatctgcccaacacgcccgaggcggcgatcgcctgcctggcggcgaccggcgtcggcgccatctggtccagttgctcgcccgatttcggcacccgatcggtgctcgaccgtttcggccagatccggccgaaagtggtgttcgcggtggacggctatgcctatggcggccggcagttcgaccggcgggcggtggtgaagcagatcttcgaccatctgcccgatgccgagcatctggtcttcctgccctatctgaacccggccgatcgcagcctgcctgtcgagagcgccgtgctctgggatgatctggtcgaggggcccgaggcgatggcccttgccgcgacccaggaattcgaagaggtgccgttcgaacacccgctctggattcagtattccagcggcaccaccggcctgcccaagggcatcgtccacagccatggcggcatcgtgctggagcatgtgaagagccacggccttgcgggcgatctcaatccgggcgaccgcttcatgtggttcaccaccaccggctggacgatgtggaacagccagctgtcggggctgctggtcggcgcgacgctggtgatctatgacggcaacccggcctggcccgacccctatccgctctggcggttgatcgagaagacgaagctcaacgtcttcggcacgtcggccgcctggctgaccgcccaggccgccgccggtgccgagcccggtgccatgttcgacctgtcggccctgcgctcgatcggctccaccggctcgccgctaccgcccgagggctatgccttcgtctacgaaaaggtgaagcgggatctgtggctgaacgcgatcagcggcggcaccgacacctgcgccgccttcgtcggcggatcggtcatcctgccggtcaatgccggcgagatgcaggcgcgggcgctcggcgtcgacgtcgccgcgctggatgacgagggccgcgagctgatcggcgaggtgggcgagctggtgatccgtcggccgatgccctcgatgccggtgatgttctggaacgacgagggtggcagccgctatcgcgaaagctatttcgagatgtatcccggctggtggcgccacggcgacttcctgaagatcaccgagcgcggcaccgcggtgatctatggccggtcggacagcacgctcaatcgtcacggcatccgcatcggcaccgcagaggtctatcgcgtggtcgacaatctgcccggcgtgcgcgacagcctgatcgtgaacctggatctgccccatggtcggttcttcatgccgcttttcgtgtcgctggaagagggggcgagcctggacgaggcgctgcagaaccggatccgccgcgagatccgcgaggcctgctccccccgccatgtgcccgatgtgatcgtcgagatccccgacgtgccttatacgctgaccggcaagaagatcgaggtgccggtgcgccgcatcctgatgggggcgccgatcgagaaggcggccaatccgggggccatgcgcaacccggaaagcctcgacgtcttcgtcgcctatgccgacgaggttcgccgccgcatccgcgaggcggaagagacggcagcctgaggcagaggccccgccattcccgtggcggggccgtcccctcgtcgatattcatggtttcttatctgatacgacgacatatttcttccgaggttgccggttgcatgagaacgagaacgacatgcgaagctggctgatcgggaggaatggatggtcatgtcgaacatcttcgccggcaagacggcaatttctctaccgtccttgttcgcagctcttccggtggcggtcgttctggtggatcgtcatggaaatatcctcgccgccaatcccgcgacatcagttctgcagggccactcacccgaggcggtggtggggcgcaaggtgtcggagttccaccaggatgcgacgcgcaatctggcccgcgacggctggctggccgaggccggactgacgcttccggatcacgagatggtttttgacggtcggcattatcaggtatcggtccgtccggtcagagacgacaacggtaatgtcacggccttcgtgatcgccttcacggacatcagccggctgaaacgtgtcgaacagcgcctgtcggaagccaaccggcgcctgaaggcgcgggtatgggaagatcacctgaccggcatcccgtcccgccgctatctggatgcggcgctggcgcgtgagatccgccgtgcccgtcgcagcgggcagaccctctcggtggtgatggccgatatcgaccggttcaaatcctataacgaccgctatggccatccggccggcgatgactgcctgcgactggtggcgcaggctgcggcggcggcgctggggcggggagaagatgaactctgtcgctatgggggcgaagaattcgtcgccatcctgcctggcagcgatctggacggtgctgcccgcgtggcggagcggatgcgccaggcggtggccgatctggccatcccccatgatgacgtgccgtcgggtcatgtgacgatcagcctgggtgtggccggcctgcctccccgggacatcggcagccaacgcgaccgtgacgccctgatcgccgcagctgaccgcgccctttatgcggccaaggctgccggccgcgaccgggtggcgcgggcagggcaagacagcgccgattgaagccgcttgcatggcagcggcggcgccctagactgccgccatggtcgatttccgcagcctggagagcttcgtctggatcgcccgcctcggcagttttcgggcggcggcggacaagctgaatgcggcacaaccctcggtttcggcgcgtatcgccaagctggagcaggagctgggtgtccagctcttcgatcgcagcgcccgcaatgtgacgctcacctcgaaagggcgggtgctgctggactatgccgaacggctgctggggctcagggcctcgatgctgtcggctgtggccgatatttcggggctgggcggcacgatccgcatgggggcggccgaaaccatcgtccacacctggctgccgcggctgatcgagcggatccacaagcattacccgggtgtgacgctggaactggaggtcgatacctcgctcaacctgcgtgacggcctggtcaatcgcgggctggacatcgccttcctgctgggaccggtcagccagccgacggtgcagaaccggccgctctgccactatcccctggcctgggtggcgagcccccggctggggctgccgcgcgacggtgcggtcacgctcgacaccctcgccaactggccgatcatcacctatccgcggctcagccggccctatatcgccattcaggacatgatgcacggcctgcccgggcgccggccgcggatctacggctccagctcgctcgccaccatcgtgcggatgaccctggacggcatcgggatcagcgccatcccgccccggatcgtgcgcgaggaactggcctccggcgccctgcatctggtggaaaccgatgccgccgccacgctgccggggatggatttcaccgtatcctggcaggcccaggccgacacgccgctggcccgtgccattgccgaagccgcgatcgagaccgcggcaggggatgccgaggcgtgagatccggccccgacggccaggatgtcgcatgcagcgtttgatccagatcaaagtcggcggcaaccggctgtcgtctccttccttgtaacggttccaaagaaaccggttccggatccaagtgaggagaagacgatgcgtcggttgatgtcagccgccgtgatggcggcgttcgccctgccgggcgtgccggccatggcagacgagttgcgggaaacggctctcggtctgttcgcaacggtgccggccagggtggagcaggtgcgtggcgcgccggtgaccgccgaacgggtggagctggggcggaaactgttcttcgagccccggctgtcgcgcagccatgtgatcagctgcaacacctgccacaatctcggcaccggcggggccgacaatgtccccacgtcgatcggccatggctggcagaaggggccgcgcaactcgcccacggtctataatgccgccttcaacgtcgcccagttctgggatggccgtgccgcggatctgcgcgagcaggccaaaggtccggttcaggcgggcgtagagatgaacagcacccctgagcgggtggtggctaccctgaaaagcattcccgactatgtcgccgaattcgccggtgcttttccggggatggccgatccggtgactttcgacaatatggcattggcgatcgaggccttcgagaccacgctgatcacgcccggcgcgcggttcgaccgttttctgggcggcgatgatgcggcattggacgcgaccgagcgccgcggattgcaggtcttcatcgatagcggctgtgcggcttgccataacggccccaatgtcggtggccaggactatttcccgtttggtgtggtcgagcgtccgggcgccgaggtcctgccccagggagacaagggccggtttgcggtgaccaacactgccgacgacgaatatgtcttccgagcggcgccgctgcgtaacgtcgcgctgaccgcgccctatttccacagcggccaggcgtgggagttggaacaggcggtggcgatcatgagcaccgctcagctcggcaccgaaatgaccgatgaggacgtgcgcgctgtcaccgccttcctgcacacgctgaccggcacgccgccggtggtgacctatccgatcctgccggccagtacggcaacgacgccgcggccggaatagggcggcgggggcgcttcagcccgcctcgcggatcaggtcgtggacgaagcgcagcttgtcgatcacggccggggccagcacgaagggatagagatcctgctggcccatgctgcggttcaggctgttgacggcataggtcagcggtagccaggcctcgatcagcggtgcgaaatcgcgctggcggtaggcgtcgaaatcataggcgacgtcagtaggggcggcggggtccaggatgttctgcggcttcaggcggatgccgaaggcatgcgccgtttccagcgtgtcgacgatgtgcaggtaatgcgcccaggtctcggcgaaatcctcccaggggtgagaggcggcataggtcgacacgaagcgttcctgccagtcggccggcgggccttcggcatagttgcgggccagcgcttcggcatagtcgcagctctcgtcgccgaacatcgcccgaaaccggtccagccggctgagggacgggtcggcgtcgcggatcagccggttccagtaataatggccgatctcgtggcggaaatggccgagcagggtgcggtagggttcgcccatgtcgcggcggatccgctcgcgctcggcatcatcggcctcggcgacgttgatggtgaccagcccttcggcatgaccggtcatcacccgcggcgcctcgggatcgacatcggccaggaagttgaaggcaagcccgccgatcggatcttcccatttggccgcgaccggcaggcccaggcggagcagggcgtagatcagccggtgcttggcgacctccagcctctgccaggcggcgagattggccggcacggcaaggtccggcacggtgcggttcagccggcaggccttgcaccaggcatgcgggctgctggtcgggatcagccagttgcaggcgtcgtgggtggcatttgcgcagaagcggaacatctgatcgggcatcgccagcggccgccagcgcccgccggtttcaggctccagcgcactcagcgtggtggcatcgggcagataacccagccggtgcccgcagcgcaggcaggttgtgttctcgaagaacagggtctggctgcagttctggcaggaaaaaagtttcattcgggcggggcatccgatcttgtcgcgcaaccggtccgctgcacacggattgcgtgcggcagaccggtcatccgcaacgatatgagagacgcgcgaagtgtgtccaagccttttctgatcgggatgccgtgtggcttcatccaagtccgcggcagagattggcgatcatgcgcgggcccgcctcgtcctgaaggctgagcaggctttcggggtggaactgcacggcgcggatcggccgctcgcggtggcgcagtgccatcacgatgccggcctcgtcgacggcggtcgcctccaggcagtcgggcagttcggcggcgaacagggaatggtagcggccgatggtgatctgctccggcaagccctcgaacagcagatcggggacaaggacgcggatgcgcgacggcttgccgtgcatcggtaccggcagacggcccagccggccgccgaaatactccacgatgccctgcaggcccaggcagacgccgaaaatcgggatgcgggcggcggtcagcaggtcgagcgtggcgttcatgccgaaatccgccggcgatcggggcccaggggagagcacggccagatcgggggcaaggcgggcgggcaggtcggccgcgagcggcgcgcgccaggtgacggtttccgcgccggtcgccttcagataggccgagagcgtgtggacgaaactgtcctcgtggtcgaccagcaggatccggcggcccttgcccggacggggcggcagggtctcgcggcgctcctgatccggacgctcaagcacgtcgatcatcgccgaggccttgagcacggtttcggcctcctccgcggccggttcgctgtcgaagagcagggtggcgccggcgcggacctcggccacgcccgccttcacccggatggtgcggagtgtgaggccggtgttcatgtcgccgtcgaagccgatgcggccgatggcgccgccataccaggcgcgcgggctcttctccatccgctcgatccagctcatcgccgcacgcttgggcgcgccggttaccgtcaccgcccagcaatggctgaggaaggcgtcgagcgcgtcatagccgtcggccagcatgccctcgacatgatcgaccgtgtggatcaggcgggaatacatctcgatctggcgccggccgacgatgcgcacgctgcccgggaccgagacccgcgacttgtcgttgcggtcgacatcggtgcacatggtcagttcggcctcttccttggccgaggcgagcagggtgcggatgcgttcggcatcttcgatcgcgtcgcggccgcgggcgatggtgccggaaatcgggcaggtctcgatccgccgcccggtcacccggacatacatctcggggctggcgccgattagatgctcagaccggccgagattgatcagaaagccatagggggcggggttgcggcggcagaggcgccggaacagttccgatggcggtgtcgtcgccgggcggcggaagacgcggccgggcaccacttcgaacagattgccggcggcgaattcgggcagggcggcctcgaccatcgcggcgtattcgcccgggcccatgtcgtcggccgcggcattggcggcaggcggcgccgcgacgtcggcatgcacctcgcgcggcagatcgtcggtggaggtgccgtcgacggtgaagtcgtaggcgatcgaccaggcccggcgggcggcatggtcgaccgagatcacccggtcgggcaggtagagcacgatatcgcgatgatccgacatccgcttgcgagccagggggatacgctcgaaggccaatgcgatgtcgtagccgaaggcgccatagaggcccagatgcggatcctcggggctcgcgaacagatcgatgatcgcgcggatcgccgagaaggccgagggctggcggctgcggtcctcttccggaaattcggccgggccgtcgagaatgcgggcggtgacctggtcttcgtcgatcatcagcccggtgacatgggggtgatcgcccagcgcccgggtgatcgccggcagcagcacccggccgcgggcattcagcgcccggatttcgacctcggcaccggcaagcccggtcatgcgcgcggtaaagaccagcggcggatcggtgaagcccagatcgaaacggacatagcggcccggatagtcgtaagaggacgcaagcagcacgccgggccgggtgtcgagcgcatcgatcagcggctgggtggcaccgtcatggggcagggcctcgacatggcggcgcacgatcacgccgccggcggtgcgccagctggacggggcggggatggtctcggcggtcatgcggcgggctctcctttgccgtggaacaaccggatggtccggccggatgggcgggagagcgggcaggggttgcggcccgcccgcgtgcgggcatgggcggcagtctcggccggacccccgtcttccggggcggccgtgcggtcggtcagacgcgcgtgatcggcgaccccggtcgaacggggccccgccactggcggccatggatggccggatatgcgcgcatcgtgatcatgacctgaagcattgccgcaatcggggcgccccgtcaacgcctggcatgcggcaacccgtcgcgggcaggggcgggaggatctttccgattcgggcttgtggaatctgcgtatctgcatatattcaaagatatgaagattgaagccatgacagagaccgccgagcgggtcgccgagttgatgaagacgctgtcgcatccgaagcgtctgctgatcctgtgcaacctggtggaaggcgaacgatcggtcggcgacctcgcccggctgaccgatatgcgcgagaccgcagtgtcgcagcagctggccctgctgcgccgggagggcatcgtcgccccccggcgggaagcccagagcatcctctatcgcctggcgcggccggatgttgcggaactgctcggctttctctacgcaacctattgcacgccttcggaaaccaccgaaggtgcggcacccatcacggagagcgtggcatgacgcccgagatgatccagagctggagcattgccctgatcggcggcgtgctgatcggggcggccgcggtctggctgatggcggcccaggggcggatcatgggggtgagcggcatcctggccggcctgctgccgccgaagcctgcggcgggtggcgatcgcggctggcgcatcacattcgcgctggggttgatcggtggtccgctgatcgtccaggcggtgaccggcgccccggcgatcggcgccccggtggtgtcgctgccgctcctggtggtggcgggactgctggtcggcttcggcacggtgatcggctcgggctgcaccagcggccatggcgtctgcggcctgtcacggctgtcgccgcgttcgctggtcgcgaccggcaccttcatggccaccggtgcgttgaccgttctggttatgcgccacctgatctgaatctgatcaggccaaaatattgagacaacacgctatccgcacaccctgcggatcaaggagacgcttatgctcaggctcgcctcagggttgatcaccggtctgatcttcggtgccggtctggcgcttgccgggatgaccgatccggcggtggtgctgggcttcctggatgtcgccggtgcctggaatccggcactcgccttcgtgatgggcggggcggtgatcgtgaccttcatcggcttccgcatcctgcgcggccgccgccatccactgctcggcaccggcttttcctggccgaccgcaaccgcgatcgaccggcgtctggtcggtggtgcggcgatcttcggcatcggctgggggctcgccggctattgcccgggcccggcgatcgcctccctcgccggcggccggatcgaggtggtgatcttcgtggcggccatgctcgccggcatgattgccgcccgcttcatctccgccgcgccggcttcggcgtctccggcctccgcgtcccccgctgccctgaagaggtgatccgatgtccgcgaccgcgttccagcccgatttcgccatccctgccgccgtggcgcccgaggtcgagagcttcttcgacccggccaccttcacggtcacccatgtggtcgccgatccggcgacgaagcgggcggccatcgtcgatccggtgctcgactacgacccggcctcgggccggacctcgacgcagtcggccgatgcggtgatcgcccatgtccgtgcccggggcctgaccatcgactggatcctggagactcatgtccatgccgatcacctgtcttcggcgccccatatccgggacgccctgggcggacgggtcgggatcggcgccaatatccgcaccgtgcagaagaccttcggcgacgccttcaatgccgagcccggctttgcccgcgacggcagccagttcgatcatctgttcgcggatggggagcggttcgccatcggctcgatcgaggcggtggccctgcacacgcccggccatacgccggcctgcatgacctatgtcatcggcgatgccggcttcgtgggcgacacgctgttcatgcccgattacggcaccgcgcgctgcgatttccccggcggcgatgcccgggtgctctaccgctcgatccggcgcctgttcgcgctgcccggcgaaacccggctgttcatgtgccacgactatctgcccgaggggcggagcgactatcgctgggtcacgaccgtggcggaagagaaggcgcgcaacatccatgtccacgaaggcatctccgaagacgatttcgtggccatgcgccagggccgcgacgccaccctgtccatgccccggctgattctgccctcggtgcaggtgaacatgcgggccggcgagatgccaccggccgaagccaatggcgtcgcctatctcaagatcccggtgaacctcttctgaggaaagcctggattatcgccggaaaccaatgggtcccgaccgggcccgcagatgacggaagatgaaaacatgaaggcgaatgtcggcggtctcgaccgcgtgctgcgcatcgtcgtgggcctggccctgctgtcgatgctgctctggggcgacgagggctggaagtggtacgggctgatcggcctgctgccgctcgccaccggcctggtgcgctggtgcccggcctatacgctgttcggcatccgcacctgcccgctggcgcggcgctgaccgcataaacccgccccccgcctgaaggtcgacctcgccatggcccgtttccgtccggccgcgctcgactggctgcggcgctatgacggccggacggccggcgccgacggtcttgccgcagtcatcgtgaccatcatgctggtaccgcagagcctggcctatgccatgctggcgggcctgccgccggcagcggggctttatgcctcgatcctgcccctgatcgcctatgccgccttcggcagcagccggacgctggcggtggggccggtggcggtcatctcgctgatgaccgcggccgccaccgccgaagccgccgcggcgaccggcatcgcgcctgccgcagcggccctgctgctggcagggctgtcggggctgatgctgctcgccatggcggcgctgcgcctgggcttcgtcgccaatttcctcagccatcccgtggtcggcggtttcatcaccgcctcgggcctgctgatcgcgctgggccagaccggccatctgctgggtgtttccgcccgcggcgacaccctgccggccattctgacggcactttacgacgggctgctcacccgcggcatcaacctgccgaccctggtggtgggcgggctgtcgctcatcttcctgttctggtgccgcaagcggctgaagccgctgctggtcaaggccggcttcgggccgcgtgcggccgatgccgtcgccaaggccgcccctgccgtggcggtgctcgcctcgatcctggcggtggggcagctggatctggccgccgcgggggtgaaagtcgtgggcgtgctgcccgcgggcctgccgccgctgaccctgccgccgctggatgccgatgccgtgctggccctgctgggccctgcggcgctgatctcgctgatcggcttcgtggaaagcatttcggtcgcccagaccctggccgccaagcgccgccagcggatttccgccgatgccgagctggtcgggctgggggcggccaacatcgccgcctcggtcaccggcggctatccggtcaccggcggtttcgcccggtcggtggtgaatttcgacgcgggggcggaaaccccgatggcgggcgtgttcaccgcggccggcatcgcgctcgccgccctgttcctgaccccggccttccgcgacctgccgcaggcggtgctggcggcgaccatcatcgtcgccgtgctgtcgctggtcgacctcaaggcgccgctcagggcctgggcctattccagggccgacggcatcgccatggcggtgaccattctgggcgtgctgctggcgggggtggaggccggcatcctggcgggtgtaatcgcctcgctcgccctgttcctgcgccacagtgcccggccgcatatggcggtggtgggacaggtgccgggcagtgaacatttccgaaatgtcgatcgccatcgcgtcgccgtttcggacaccgtgctgacggtgcggatcgacgaaagcctctatttcgccaatgcgcgggcgctggaagaccggatctcgtcgctggtcgcctgccggcccagcctccgccatgtggtgttgatgtgcccggcggtgaatctcatcgacctctccgccctggaaagcctggaggcgatcaaccgccgcctcgccgagggcggcatcagcttccacctgtcggaagtgaaggggccggtgatggaccggctggcccgcagccatttcctggacgagctgaccggtcgggtgtttctcagccagcatgcggcgatgcaggcgctggatccggagatgacccgggccgctgacggacttgtgcgggatgccgcttcctgatcctgttgccgcaagttgcaacagaccacacgtggcgatgcctggagaacatcaataatgtcgcccttggagcagtgatcgtcactgcaagagggcgaggaaactgcacctcgtcttcgtttccaccggagaagaaggtgtcgattatgacgaataccattgcggacctgaaggcccttgcggtcacgtcttccaacatggaagtcgaggtgctgggctaccacgccgttgccgatggcggcggcggtctgttcgcctggcaggcgggtgccaccgccaccgatgacggtggactctggatcgaaagcacggtcgcgaccggcggtctctggcagcggatcgtggacagcgccgccccggtcagcgtgcgctggtggggtgcccgcggcgatggcagcaccgacgacaccgcagccatccaggcggcgctggatgcgggtttttccgccgtgcacctgccggccggcacctatcccgtctcggcgacgctgaccgtgccggccggtacgatcgtcaccggtgacggttcgggtgccttccgtccggccaatgcccgcaccaccatcgtcaagaccaatggcgacaccgccggcgatgcggtgatggagacggggcagtcctgcaccatccgcgatctgaagctgcagccgcataacgaggcggcggtgacctacgaacgtgcggtctatccctccggcacgggcaacacctcgatcggtctgcggaccggctcggccaacacggtcgaggacgtggtctcccaggggttcgccgattcggcgctggttctgggcaccaccaccaaggtgatgcgctgccacatcttccgctcgcgccggggcatcaccaccagcggctcggacggcatgatcaccaacagcgtgaccatgttctgccacgaggcgggcatcctgctgacgaccaattactggatcatcaccagctgccgcatcgaatggaatgccacctacggcatccagtcgaacagcggcgagcacaccttcaccgccaatctgttcgatcgcaacggctgggccggcctgtacctgaacggcggctggggcaatgtggtcaccggcaactacttctcgcgcaacggcgccggcggcgacggcagcatgggccgctggaactgggcgatcccgggccacaacgcctatctggcaccgccgaccgtcgccgacagctgccatatcaagatctactatcagcgcgattgcaccattaccggcaaccgctatcgcgctggcgtcgatgacggcggcagcggcgcgatggcaccggcctatgtctacaacatggatggtaccgcgggcgtcacctcgaacatcaccatcttcgccaatgccggcgaaaccgcctcgggcggcggcttcggcggctatgccgccagctatccgggtgggtcgggtgtgttcgggggcaccgacacctcggcacagcagctggtctatggccggccggtgcgcctgggctcggtgaccatccccggcatgtcgacgccgcgtcagccctatggcctgccgcaggcggcctcggtcgacgtgccgatcggcactgcgatcggcgggcggatcaaggtctggaccaatgcctggaacagcaccccgtcctacgcggaagtcaccttcgcccgcgcctcgggcagtgcgacgacggccacggtggcgatcgacaacgtcatcggcaccaatgtcagcaccgcggtcatttcgaccgatcccgcggtcatgacggtgaccttcgcaggcacccgcttctacaatctctcctacgacctgcacacgatgtgaggtcagacccgccggcctggtgccggcgggtttttttctgcctcacatgccggtgatgccaagcttcaccagcgtgtcgccatccagtcgtccggtaaccggcaggcggctgtcgccctggaaggttctgatcgcagatctggtcctctctcccagaatgccgtccgccggcccggcatcatagccgcgggcattgagggcgatctgcgcccgcagaaccatgtcgcgcagctcctgacgggtggccgcgacggcattgccggccgccgggccggacgtggtggccgaagacctgttgccggaagaggtctggcccggtgcggtgtagagcggtgccgtgtagctgggggccgggtaggtcggcaccgtatagccgggcgtgctgcgatagctgctggatgaatagtgcgagcggtggctcgaatggctgcgatggcttgaatggctgcggtggccggcaaagcggttcaggccggcacctgccgcatcgaacgggttgtcgaatacgggaacaggcaggcctccgtccgggccgaattcgggtgcggggccgcgcgcggcaagtgccggttgtggcagaaggcctgacagcatggccggcagggacagccccgccagagccgtgacggtctttttgatcagacgggacatgacggtcctgttccctgatgggcagttggtggccagtgatcgaacggcctgacatcgcgcccgatccatcgggcgtcggccgaggtgaaaaagccggcgcagtcctgccgggcggggcagggggcgcagagcggcgcaaaatcgttcttccagtccgaaatggacgcccgggcgacggcgaaaagatcggcaggaagcgcgcagagcggcaggttgtagatcgagaccgtcatgcccagagccgtcagccgatgaacggcgcgggagagggcatcggcatagtcggccggatcgatccagatcttcgcgcgattgcgccgggcgaagcccatcggctccagccccatgaaagcgatgtgggctgcaaagggcagtgcgcgatagatgaagcgggcaagcgcttccagacgcgccacggtctgtcgggtcaggaccacacggatctccaccgtcgcgccaatcgctgcaagattgtacaggcccgccatggtctcggcgaaggcgccttcggcctgcaccacatggtcatgcaggctggcgatgtcgccataaagggggatgccccaggtcactgcctcgggggcggcaccggccatggcgcgtgccaggccgggatcggcgaaacgccggccattgctcagcacatgcagggaggtcgccggcagatgccggcgggcggtccagatcacctcgatcaggccgtcatcgagcagggtcggctcgccgccggatatgccgagttgggtctcttcggggtcgatcagcgtgatgatccgcgtcagatgttcgacgcggtgcgtgtcgtcgacctcacgcgggggctgggagcacatgaggcagaggctgttgcagcgttccgtggcgagcagtgtgttcgcatgcgagccgcgccgccagagtatggtgacgagtccgccttcaggcgtgagcccgacgacgtcgcccggtgccaccagatcccgtcggcttccgccgccccaccagggtccttcatagccggtcggtggcgcggcatggccggccccgaagacgccggcggcgagagcctcgacgccggcgggaagacgcccgccggacagatcatcctgccagagcagacagtgatcgattggtacccggcctgcggcgaggacatcgaggtccgcgattttggcgacgtcgatggcgaccggaggaccggtgcggatcaggcgctgatgcaggggcagggacatggcgtgcagcctctccgatcagtcgaggcggatgttgccgctgagatcggcgggctgtcgtcgaccgacccaggctgcgaagatccggttgacctcggggtcgttcgctgcgatccgggcgaagagcaggcgaaacagcgccttgtggcgcgcgcagtgatcgctgaaagcgcgatggcccaccgggtcgccttgcgtggccagatggtgaaccgggtcattgccgcaatagggcagaaaggcgcagctccagcatccgggcaggctttccgccagaccggcggcgaggagggcgcggagggtgccgctgccggcaagctcccggaacggcgtgtgaacgtccccgatcctcagccgatgatccccgtttgccgccagcatccgcgcctcgtccgagacatagacgccgccatcatggttatagaccagcacgccgtgcccggcacccgcgggggagcggagatcgacatagccgccgccgaagggggtgaggatgtgggtcaacaggatggcggcataagcttcttcgatgtgccggccggcacggcaatgttcgatgcagcgatcgagcgcccggcgatagaattcgatgaagccggcgacggacggggcgaggccgggttggcgtcgggcgaagccgtagggggcgaccggccgcagaaacaccgaccggaagccgagatcgacataggcgtcgacgacgtcgtcgggccggtccagtgcatcgccggtgatggtggcaatcgcggcaacggcctccgcccccagaatctcgcgggcgcggtccagtgcgcgtcgggtggcatcgaacgcgccaccgtcgggccgtcggcgatggcggtcatgcagcgcagccgggccgtcgatcgaggtcgagagcgcgatttcatgctccaggcagaagcgaagcatgtcgtgatcgaggcgctgcagggtggagaccatcgagaaagtgagcggtcgtccgtccgttcccgcgcgctcccgggcaagtgtcacgatctgccggacccgatcgaacgccagcgccggttcgccaccctggaattcgatggtgagcgagggggcggggctttcaaagatccggtcgaccgcagctcgggccgtctcttccgacatgtcgaagccggcggcggaggggccacggcgcgagacctggcaatagtcgcaggcatggtcgcagcgcagcgtcaccacgcagatatgcagcgacggcccctcggcgacgaaacgcttccgggtcgcaagctgagcggcagtgatccgcatggtggtgggggcgagcgggtcgtgcaggaagccacgggcgagcaggtcgtcccggatatcgggcgcgagttcggcaggatcctcgatcaggcggcggaaatccgtctggctcagaaacgcgaaatcaccaccatcatgggtgacgagaacctgagccggtgggaaggtcagccgctcgaaacgcaggggcatgaggtcgaggctgttcatcctggtatcagcgcagccatggccgtcctgaaaacggcgtcgcgcatcccggcagtgcgatcacgcaacatgacccgcagggattgatctgtcagtcgttccagaaagcgggcgatgagtgctgcatccaccggcaccccatcggggagcctgcgggcgaaggccaccagccgggtgtcctcaggtgcgtcgggcaccagccagatcagcgcgtccgccgccatttcataggcggtgtgaagaacggcttcggctggataggcgatgtcgagccggagaagttgctccggctcgacggtcgttgcgatcttgctggcgggtgaaggcatggcaaggaggcccttggcagcagagcatcttgtgacgctaatcctgcatggtcactctttgcaattgaaaatacgaattcacggcatagttacagcctaaagtagttagacgttcaccgcgccagtaccgtcgcggcctgtttggtggtctgaaccgcgccggcgacgcggctgaccgcgtcggtgatgccgtccaggctgcgggtgacggtgtcgactgcggcggcggtggtgtgcatattggccgacaggtcgcgggtgacgacgctctgttcctcgaccgcggccgcggtggtggtgacatggtcgcggacggtgaggatcgagccgcggatggtgcgcagcgcttccgccacctcgcccgacagcccctgcatgccttcgatttcggtcgagatgcgggtggtggcgtcggccgactggttggcgagggtcttgacctcggttgcgaccaccgcgaagccgcggccggcctcgcccgcgcgggcggcttcgatcgtggcgttgagcgcgagcaggttgatctggccggcaatgccgcggatcacctcgaccacgccctccatcgagcgggcgacaccgtccaggcgctgggcggcctcgtcggcgcgcgtggcccggtcgaccgcgccatcggtcgcttcccgcgacttcaccatgctctgcgaaatctcggcgatcgaggctgccagttcttccgtccccgccaccatcatctgaaccgcgccgctggtctggccggcggccgtggcggccgcgccggcctcgttggtggagcggtcgaccgcgtggtcgatctcggcgaaattgttgtcgatcagagtcttgagatcggtcagcatgccgatctgccgggtgatgtcggtggcgtatttcaccaccttcatcggccggccatcggcatccaggatcgggttgtacgaggcctcgatccagaccgtacggccgcccttgccgatgcgcttgaactgccgggcctggtactcgccgcgccgcagcgccgtccagaatgccttgtagtccgccgagtcccgttcggcgggctctacgaacatggcatgctggcggccctggatttcgtccaggcgatagccgatgacgttcaggaaattgtcgttcgcccacaggaccttgccgtccaggtcgaactcgatcacggccagcgccttgcggatcgcccgcatctgcccgtcgaggtcggcggccgcggtcttctcggcggtgatgtcggtggcgtatttgaccaccttcaccggccggcccgcgccatcgagcaccgggttgtacgaggcctcgatccagacgaccttgccgcccttgccgatccggcgaaactgacgtgcctgatactcgccccggcgcagcgcgtcccagaaggcggtataggccgggctctcgcgctccgccacatccaccagcatgcggtggttctggcccttgatctcgtcgagcgtatagccgacgagggtcaggaaattggcgttggcatcgagtatccggccatccatatcaaacgtgatcatggcctgggagcggttgatggcggcaatcactgcctcggcatcgctccgtcgacgcggcgacaggaaatcgaacatgtggtcgtccctcacgatctgggctttgatggtctgtacgacatctttgacggtgccccgggtctgggtcgcgaaggttgaagggaagtctcatcttcgcagcgcatctatgaaacaggtgcggagcaggcgtgaggacatgatgacgctgatcatcttaaattttcattagcaacagccgccgactgttctgaattttcagcggtaacgcaaaatgcaccagttcatcaaccgaaagaagaaaaagggggctggtccctttttgtcttgtcccgctggcgtgcgtggacggccactcaagccgcgccttgcccggacactatgcaactgtcatgactgatcgaaaattccgatcagtcaccatccaaacgaatcattggacccgctcagtcgggacggcgtagcctgacggacacggagatgccatgggagggcgtctccggcccccagttgacgacaggacggacgggacgagatggcggcaggcaccaggcatgcggcgacgggagagctgtgcgtcgaccgcgcggatccggcgatctgccgggcggcgatccgcagcggcgccttcaccgggcagacggcggggctcgcccccggtttcgtgcagggcaatgtgatcatcctgcccgcttcttatgccggggatttcctgcgcttcgcccaggccaaccccaagccctgcccgctgctggcggtgggggagccgggcgatccgatgctgcccgggctgggcgccgatatcgacatccgcagcgacgtgccgcgctatcgcgtgttccgcgacggcgtcgccgcggccggggaacccaccgatatcggtgatctctggcaggatgatttcgtcaccttcgtgatcggctgctccttctcgttcgaagaggcgctgatccaggacgggctggaggtgcgccatgtcgcccgcggtcgcaatgtgccgatgtatcgcagttccattccgctgacgtccgccggccgtttcggcggcggtatggtggtgtcgatgcggccgttcagggcggccgacgccatccgcgcgatccaggtgacgagccgcttcccggcggtgcacggcgcgccggtccatctgggcgacccggtggaaatcggcatcaccgatctggcccatgccgatttcggggacgatccgatcatggaggcgggggagattccggtcttctgggcctgcggcgtcacgccccaggtggcggtggaagcggcgaagccgccgatcgccattgcccatgcccccggacatatgctgatcaccgatctgcgcaatgcgcggctggcggtgatctgagcagacgacagaaccacgaggcaccgcgatgagatcgtgcggcaacgcaaccgcccgacgactgacacaggagttcaggatcagatgaccagcatcagcaaggcccttctcgccggtgtggcgcttccggtaaccgctctcgccatcctggcggcgccggcttccgccgccgatatcccgtccgcgaagctcagcttcgtgggcagctggagcgggctcagcctgcacaagaatttcgagaagccgttctggtccgagaccctgcccgccgacagcaagggcgccgtcgaggttcaggtcacgaccttcgaccagatgggcctggcgggtgccgaggtctaccgcctgctgtcgcgcggcgtgttcaccatcggcgccaccgtcgccgactactcgatcgaggatgcgcccgagatcgagggcctggacatgccgatgatcgcgccgggtgtggccgatgcgaagaaggtggtggaggcctatcgcccgaccctgaacgaggccttcggcaagcgtttcaatgccgagatcctggcgatcgtgccctatcccagccagatcgtgttctgcaatgcgccgatcgagagcctggcggacctcaagggcaagaaggtccgcgccagcggccgcaccaccgccgaattcctgaacgccatcggcgccgagggcatcacgctcgccttctcggaagtgccggccgcccttcagcgcaaggtcgtcgactgcgccgtcaccggctcgctgtcgggctacagctcgggctggcacgaggtctcgacccatcttctgcccatgccgctcggcggctgggactatgtcgtgaccgcggtcaacaaggacaaatgggccgaggtcgacccggcgacgcagaagttcatccagcacgagatcgcgaccaagttcgagaccccggtctggaacgccgctgtgggcgagacggtcgaaggcatcgcgtgcctcaccggcaagggcagctgcacccgcggcgagcccggcaagatgaccctggttcaggtcaccgacggcgaccgggagcttgcccgcaaggtgctgaccgagaccatcctgcccggctgggcggggcgcgtggatccggcggtggtcaccgcctggaacgacggcgtcggtgcggtcaccggcctcacggcggcgaagaagtgatcgcagccgtcgcgtaagatcagtctccagccatcagccgccgcaggaacccgaccccatggccagaaccgcctctaccgctccgctcgtccgaaccctcgattgccttctgggcatctcgaccaggatcagccgggcaggggtctgggcctgcggcgcgctgctgtttgccgccgtggcgatgatcgtgatcgagatcgtgcttcgcgccttcggctcgtcgctgcacggcgcgcatgaactctcgggctatgtgctggccatcgtcacctcctgggggctggcctgggcgctgatcgaaaaggcgcatatccggatcgacgtgatctatatgcgggtcggcccccggctgcggaccgtgctcgacctgatcgcgatcctgatgatggcgctgttcgtggtggtgctgctctcccaggtctgggaactggtcgccggcacgctgaagcgcggctccaccgccaacacgccgctgcaaaccccgctctggatcccgcagatgctgtggatggctggcctggtctggttcgccttcacggtcttcgtgctcgccgcccgcaccctgctcggcgcgctgaccggcgatcgcgatgccgtggcccgcgtctggggcaatcgcagcattgaggacgagatcgcggagaacgaccactcgacgcgcggctgaccggccgccgctcatccgtcgcccttagcttcgttccgcccgtccgcattctcaggggaacctcgtcccgtgctcggcatcgcccttgtcgtcctgctcgtcctgcttctgctcagcgtgccgatcgcggccacgctggtggggctcggcctgttcctcgaccagaccttctcgttcttcccgctctacaaggcgatgggcgaggtgttctggagcgcgagcaacagtttcctgctgatcgcggtgccgcttttcgtgctgctgggcgagatcctggtccgggccggcatcgccgggcgcacctatgcggccctcgacaaatggctgtcctggatgccgggtgggctgctccacgccaatatcggcacggcgacgctgttctccgccacctcgggctcgtcggttgcgaccgcggcgacggtgggctcggtcgccatgccccaggccaaggcgctgggctatgacgaccggctgttcgcgggctcgatcgcggccggcggcacgctcggcattatgatcccgccctcgatcaacctgatcgtctacggcttcctgaccgaaacctcgattccgcgcctcttcctcgccgggctgatcccgggcctgctgctcgcggccctgttcatggcgaccgcggccgccgcctgcacgctccgccccgagcttggcggcccccgccgcccggcgcgctggtcggaacggttccgggcgctgcccgatctgctgccggtgctgggcctgttcgcggtgatcgtgggctcgatctatgccggctgggcgacgccgaccgaggcggcggcgctgggcgtggttgcggcactggcgctgtcggtcgccaaccgcagcttcaacctccgcatgctgaaagaggcggtggaaagcgcggtcaagaccacggcgatgatcatgctgatcatcatctcggcctatttcctcaacttcgtgctcgccggcgccggcgtcacccgccagctcgcggccctgattgacgggttgggcttcggcgcctatggcatgctcgcctgcatcatcctgctctatgtgatcctgggcttcttcatcgagaccctgtcgctgatggtcatcaccatcccgatcgtagccccggtggtgatcgcgctcggcttcgatccgatctggttcggcgtgctgctgatcctgatgatcgaaatggcgctgatcacgccgccggtcgggctcaacctctatgtcgttcagggcgtgggcgggggcatctcgctcaaccgggtgatgaccggcgcgctgcccttcgtcgccgccatgctggtgatggcgctgctgctggtgctcttccccgggatcgccctctatctgccgggggccatggcgggctgatcccgcctgccgcttttccccggccttccaatcgcagacatccgccaacctccgggcccgatcgcccgttcagaggagacgcccccctcatgtccgtcatcagcctcgacaccaccgaaggcacctgccgcatcgacgtcaccgagctggtcattgccggctgggccggccgcgaccgccatcacgtggaggaacatatccgcgaactggaagcgatcggcgtgccccgcccgtcgcgggtgccgctgttctaccggctgtcggcccagatgctgacccaggacgagagcatcgaggttctgggccccgacagttcgggcgaggccgaggcggtgctggtcggcgataccgacggcacgatctgggtgacggtcggctccgaccataccgatcgccgtgtcgaggcctattcggtcgccgtctccaagcagatgtgccccaagccggtcgcccgcgacgcctggcgtttcgacgaggtcgccccccactgggaccggctgattctgcgctcccgcgcctttttcggcggtgaggccgtgctctatcaggaaggcccggtgaacggattgcttgacccgcgggagctggttcgggactacaatgccggccgggacggtctggcccccggccaggcgatgctctgcggcacgctcgcggtcatcggcggcatccgcccggccgacgctttcgaggtccagctggaggaccccgtgcttggccggcggatcacgcaccgctataccccgaagatcctgcccgtggtcgcctgatcccgcggcgccggggcttcgtaacaggttcgccttcataacagtccgacgaggaagcgcgcgagatgacctatccgacccctctgtcccggatcgcggccgggttcaacgacggcagcgtctcggccctgaagctggccgagaccgcgctcgcccgcattcatgacgaggggttcgcgccgggcgcgcagatcttcacccgcgtctatgacgcctctgcgcgcgccgaggccctggccgccgaccaccgccgcgcggccgggctgtcccaggggccgctggccggcctgccgatctcgatcaaggatctgttcgatgtggcgggcgagaccaccatggcgggctcggtggtgatgaaggatgccgccccggccatggccgatgccccgatcgtggcccggctgcgtgcggccggtgccgtgatcaccggcaagaccaacatgaccgaattcgccttttcgggcgtcgggctcaacccgcattacggcacgcccggcaatgtcttcgatgccgaccgcatccccggcggctcgtcggccggcgccggcatctcggtggtgaagggcatggcggccgccgccatcggcaccgataccggcggctcgatccgcatcccggccaatttcgccggcatcgtcggcttcaagccctcgcaggcgcgggtgccgctggaaggcgcgctgccgctgtcgtccacccaggattcgatcggcccgctggcccccaccgtcgcctgctgcgcgctggtcgatgccgtgctggcgggcgaggcgccgcgcatcctgcgcccccgcgcgcccgagacgctgaccttcgccgttgcccgcggcctgccgatggacggtgtcgacgaccaggtcgccaatgcctatgacgcggccctgaagcggctccgcgatgccggcgtccggctgatcgagctggaactgcccgagatcgccgaggtgccgcagctgaacgcggccggcggcttctcggctgccgaaagctgggcctggcaccgcgcgatcatccagaccggcgccgagcgctatgatccgcgggtgctgtcgcgcatccgccgcggcgaggcgatgggggcggccgattacatcgacctgatcaagcgccgccgccggatggtcgccgccgccgatctggcgctccgccccttcgacgcgctgctgatgccgacggtgccgatcgtgccgccgcggatcgcggatctggccgatgatgccgattacacccggctgaacctgctggtgctgcgcaacccgaccttcggcaatgtgctcgacctctgcggcgtcaccctgccgatcgcagagccgggcgcactcccggccgggctgatgctgctgggccgcaacggcgccgatcacgacctgctcgacgtggcggccggtgtggaggcgctggtcgtccgcacccgcgctgcctgagcggccctggctccccccgcgccatggaaacgctgctcgccgacctctcggtccagctgttgccgatcgcggcccgcgtggttgcgaccgcgatcgtcgtcatgggcgtctcgctgctggttcagcatgcggggcccgccctcggcggtatcgccgccgggctgcccatcgtcatgggccccggcttcttcttcctgatcggccaccacccgccggatttcctgcatgatgcggcggtggcgacgctgatggcgctggtggcgaccctgatcttcgtcgcctgcttcatcgtggtcgcgaaacgggcagggcccttcgcctcggtcggcgcggccatcctcgcctggtgcgtggtggccgcggtgaccgcggccctgccggtggaactggtggtggcgctgccgctctatgtcgtggtcgccatcatcgcgctccgcttctgccgccacgccgccggcgacggcccggccccgcggggcgcgcggcgcatcgccgaccttgtcctgcgtggcatcctggccggcacgctggttgccagcgtctcggtggtggcggccctggcggggccggtctgggccgggctgctgatgggcttcccgatcggcatgatcaccatctcgctgaccgtccaccagcgctatggcggcgaaaccgcccgccagaccatgcttgcggcgctcggcggcatgagcagccttgccgtcttcactaccgtcatggcgcttgccgtcacctccaccccaccgatgaccgcctgggtgctgtcgctggcggcctcgctgctgccgcccatggggctggcggcccggcagatccggcggggccgatcgaacggggtttgaatccgaatggggtttgaagtcgaacagggtttgaatacatcgtgatgtggacgccgggcttggcaccgccgcccggtcgttccatcctctccgcgatcccgttcgatgcctcgcggagagaccgatgtccgacaagcctgccgcttctgcccccgcttctgcgcctgcatccacgcctgtgccgagtgccattccggcgccggggcgggatccgcagctgttcaagccgatcagcttccgcagcgtcaccgcgcgcaaccggatcatgattgcgccgatgtgccagtacagcgtgccggacgggctggtgggtgactggcatctggcgcatctgggcggcttcgccaagggcggggcgggcatcgtcttcgccgaggcgaccggtgtgctgcccgaagggcggatcacgccctggtgcccggggctgtggtcggatgcgcaggagacggcctttgcccgcgtggtcgattttgtggccgggcagggcgcggtgccggcgatccagctggcccatgccgggcgcaaggcctcgaccgatgcgccctggcggggcggcgggctgcttgcccccgatcagggcggctggcagccggtggggccgaccgatgccgccttctcacccgcccatgcggtgccgacggcgttgaccgaagacggtatccatcgcatcgccgatgccttcgcggcctctgccgcccgcgcccgtcgggccggcttccggatcatcgaggtccatggcgcccatggctatctgctgcattccttcctgagccccctgtccaacacccgcgacgatgctttcggcggcgatgccgaccggcggatggcggcgctgatgctggtgctggatgccgtgcggtccgaatggccggcggagctgccgctgttcctgcggctctcgtgttccgactgggtcgagggcgggctcgatatcgcggcctcggtcgagatcgcgaagcgggtgaaggcgcgcggcgatgtcgacctcatcgactgctcgtcgggcggcggtgatccgcgccagaagctgcgcgcctatcccggctatcaggtgcccttcgccgaggcgatccggcgcgaggcgggcatcgccaccgccgcggtggggctgatcacccagcccgaacatgccgaggagatcatcgccaatggccgtgccgatctggtggcgctggcccgcgtgaccctgggtgacccgcattggccgctccgcgccgccaaggcgctgggggcggagctgccctggccggaccagtacagccgcggcatcctgcagctctgacggcagcttccggcccgaccgctccggcggtcgggatcgggctgtgtaggagttatgttatactgttgcattaacgtaggcgcgggcgtaagcagaaggggttccgcctccttccggaccttgagcccatggacctgcatcgccccgtcgccacgccgcccgttccccatccgccgccggggcaggcgctgatgcgcagtgcgctcggggtcggcgtgttgcgccggctgctgattgcggccattccggtcgccctgctctggctggcggtgatgggggcgatccggtgatgatgtcccctgccgccggtgggcggctttctcccatatcggtgccgggaccgcaggtggtgtgcaccgacctgaccctcggctacggatccggccggccggcggtagagggggtgagcctgacgcttgcctccggcagcctgaccgccattgccgggccgaacggggccggcaagtccaccctgctcaaggccctgaccggacagctcaccccggaagccgggcggatcgatctcggggggctggaccggcgtgccctcggctatctgccgcaacagaccgagatcgaccgcagctttccgatctgtgtggccgagatggcggcgatggggctctggcagcggcttgggccgttccgggcgatcggccgcaggcagggggcggcagtgctccaggcgctcgcaaccgtgggtattgccgatctggccgaccggccgatcgcggcgctctcgggcgggcagatgcagcgcctgctcttcgcccggctgcttttgcaggacgcccggctgatcctgctcgacgagcccttcgccgcgatcgacgaggcgacggcggccgagctgatcggggtgatccgcggctggcatgaagagggccgcaccgtgctggccgttctccacgatctggacgcgatccgcgcgcatttccccgactgcctgctgatcgcagggcggatgatcgccgccggccccacacaccgcgtgctgacggccgagacccttggcagggcccggcttgcccaggcgcggcattcctgaagcgaaggcgcattcaccgtgatccacgatctgctgatcggtcccttcgccgactatgccttcatgcggcgcgccctggtcggctgtctggcgctggcgctgggcgccacgccgatcggcgtgttcctgacccagcgccggatgagcctgaccggcgacgccatgtcccatgccatcctgcccggggccgcgatcggctatctggccgccgggctgtcgctcgcctggatgacgctgggtggcctgatcgccgggctggtggtggcggtgctctcaggcctcgtggcccggcgtaccggcgggcgcgaggatgaaagcctcgctgccttctacctgctgtcgctggcggccggtgtgctgatcgtgtcgctgcgcggcagcaatgtcgatctgctgcatgtgctgttcggctcggtgctggcgctggacgatgccgcactgttcctgctctcagggatcgcctcggtgtcgatgctgaccctggcggtgatctggcggccgctggtgctggaatgcgtcgatccgggcttcctgcgggcggtcggccgttccagccccatggcccattacgggctgctggtgctgtcggtgctgaacctggtcggcggcttccatgccctgggcacgctgatgtcggtgggcatcatgatcctgccggctgcggccgcgcgtttcatcgccccccacagcctgctgtggcggatcctggtggccggaaccatcgccttcgtgtcggggatggtcgggctgctgctttcctatcatctgggtctgccttccggccccgcgatcatcctggccgccggcgcctgctatctggcggcgctgctgaccgctcctgccggcgcgcgccggcggttcctcccggaaccttcctcccggacagaaaggaccgtctcatgatcaaccgtcgccatctgctggccgcgggcacgctggctgtgctcgccctccggctgccggttccggcccttgcggccgatgaaccgatcaaggtcgtcgccagcttcagcatcctgggcgacatggtgcaggaagtgggtggcgaccgggtccgcgtcaccaccctggtcggccccgacggcgatgcccatgtctggcagccggcaccggccgatgcccgcacggtcgccgatgccgatctggtggtgatgaacgggctgggcttcgagggctggatggaccggctggttcaggcctcgggctatgacggcccggttgccgtcgcaaccaccggcatcgtaccccgcaagatggcggaggaagaggatcacgatcacgatcacgatcacgccgggggcgatgatcacgaccacgatcacgaccaccaccatggcggcaccgatccccatgcctggcagagcctgaccaatgcccggatctatgtccataacgtgctggaagcgctgattgccgccgacagcgacgacaagccggtgttcgaagccaatgcggccgcctatctgaaaaagatcgacgcgctcgacgcccggatccgggctgagatcgcgagcgtgccggctgagcgccgcaaggtcgtcacctcccatgatgccttcggctacttcgaggccgcgtatggcgtggaattcctggcaccggtgggggtgagcaccgaggccgaagcctcggcgggggatgtcgcaaagctgatcgaccagatccgggcggaaaagatcccggcggtgttcatggagaacatttccgatccgcggctgctggagcggatcgcgtcggaaaccgatgcgaccatcggcggcacgctctattccgatgcgctctcccccgccgacgggccggcggccacctatctggacatgatggactataacgtcaggacgctggtggccgcgcttcgcatctgaccagcgccatgtaatcctcgatccgcttgccgggctcggggcggaaatgctcgccggtgcgggtaagctggcggatccggtcgatgcggaaggcccggaaatcgccgcgcagctcgcaccagccggtcagcgtccagaccgcgccccaatgctgcaattccagcggccggaccacccgttcggaggtggcgccggccgcatcggcatagtcgagcgccagcttctcgcgggtcgcaatcgcctcgcgcgccgccttgagccgctggcggtcggcggcggtcaggcggaaaccgtaggcggcggccgtggtggggatggttatgccacgggtgggggtggcggcgcggagcttgatctccagctcttccgccgcccgcgccaggctttcatcggcatgggcacggaccatggcgacaccccaggtcagggcttcaagctcgatcgccgacaatgcgagcggcggcaggaagaagccgtcgcggagcagatagcccataccgcgttcgccatccaccggcacgccctgggcctgaagatcggccagatcgcgatagaccgtgcggaccgagacttccagctcgtcggccagctgttgtgccgtgcgcagccgaccgccccgaagcgactgaagaatggcgaagaggcggtcggcgcggcgcatcggcgtcagctcgcgtgggcgatgtcgagatgggtcatcaccacgctacccccgtcgatggcagtaaggaaggggcgggcggtgggttcctgcatcagcgcatcggccgcggcgcgggctgtggccagatcctgccattcgatgcagtcgatccagacccccatatcggcgaggcccaggcgccggcggacgaagccggggcgggtggccagccagccgtccatgcgggcggcatcggcggtgaaggcctcaggatctatgccgggcctgaggcggaagcggacgatttcgagaaccggggaaggctgactgatctggtccatggggctgaggccttgtctgggttgtcccatctgcgccccatccatagcgcacgtctcctgacagcatcttgtcaggagacgtgaacgcatcgtgatcagccgagctttgtgaagtcgggccgccggcgctcggcaaaggcggtgaaggcctcgcgggcttcggggctctgcagacgctcgaagaacagcttgctttcggtgtccatcaccgaggcgatggcggccgcatcccgcatcagccccttggtcgccttaagcgcgccgatcggctgctgcgcaagccggccggcggcggcacgtgcggcgccgagcacatcgtcggcgggcagggccgcattgaccaagccgatcttggctgcgtcgaaaccgctcagcacctcgcccagggcaaacatcgcgaaggcgcggcgatggccgatcgcggccggcagcagcaggctcgatgccgcttccggcaccagggccaggccgacgaagggggtggagagtttggcatcccgggcgacatagaccaggtcgcaatgcagcagcatggtggtgccgatgcccaccgcctggcccagcacgcccgccaccaccggcttctgcatccgggcgagctgtttcagcacccgctggacatggcgcaccgccgggccctggccggcggcgatcttcgcaaaatcgccgaggtcgttgccggcagtgaaatcgccgccctcgccgcggatcagcaccacgcggatcgcgtcatcggcctcggccgcttccagcgcgtcggcgacggcgccgtacatctcgttggtgatcgcgttcttcttcgccgggcgggcaaagacgatctccatgatcccgtcggcggtggtcgtgcggatatcgtcggtcacgatcggtgacgtcatgatgggggtgctttcctgatcctcgggcgggagaccggcatcggtgttcgtgccgaccgtcttcagccaatgcgcgatcaccgcgcgctcctcgggcgtaagcccgtgggccatgcggcgggtgaggtcgttggcgcggcgcgcggcgacccggcggatcgcctcgccacgctcggtgagccggagagtgaccgcccgccggtcggccggatcatcggtacgggcgaccagcccggccgtttccagcttctggacgagggtggaggtggcggactggccaagatccagcgccgcccccagcgccgtcaccgacgacggcccgcgctcccccagcacgaacagcgccgccgattgcgaggtggtgatgcccagatcctcgatccccgcctcggcgatcgccatcacccgccggttggcggcggccagaaggtggatcaggcggggtggtctggacatgcgctcctgtctccgaactgcatcgacgtcgaagtatatgcatcgatgtcgatgtatttcaatatccatcgacgtcgatgtatctcagccgaagacgacccggtgcggcaccgggaagcggcccaggatctgctccacccgatcgaccagcgccggcctgtcgtcctcgggcaccggcgtgccgtcgtccagggtcagcgtcaccaccgcgcaggtgcccagccggtcgtcgggaccggtcttaacggtcgcggccaggccctccagcgccgccagttcggccgcatagacccggtcggtggcgagctggcggagcgtcggtttgaagatcttgccgatcgcggtcaccggcatctcggccaggatgatcacctcatgcggggctgcgggccgttccggcacccggtcgcgcgcccaggcgaccagctcgtcggaactggcggcggcgcccggcttcagcgtcacgaaggcgaccgggatctcgcccgcataggcatcgggccggccgaccgcgcccgccagcgccacggcggggtgggcgtgcagcacctcttcgatcgattgcggatcgatattgtggccgccacggatgatcagatccttggcgcggccgaccaggaagatccggccctgatcgtcgatgcgtgccaggtcgccggtcgaaatccagccgtcgccgacgaacagtccggcgtcgaaccggctctgtttgtagcccgagatggcattggggcccttgaggcacagcacgccgatttcgtcgaccgcggcatcacgcgccagcttgccgtccgcatccaggatcacggttttcatcggctggtacggaaagcggatgccgaccgagcctgcaagtgcctcgccataaggcgggttgaccgcagaggcgcaggtgccttcggtcaggccatagccttcgagcagcttgataccggtcagcccctcgaagccgcggatcacctccagcggcaggggggcggcgccgaccacggcgaaacgcaggctggagagatcggcacccgccaccggcacctgcatcagcgcggtcagtacggtgggcacggatgagaaggtcgtgacccggtagcgctcgacgatcttccagaaattgcggatcagatcggggttgcgatagccggccggggtggcgagcagcacccgggcgccggccatgaacggcgccaggccggtgacatggacggcattgacatggaacagcggcagccccgacagcgtgcagtcggccggcgacatgccgatcacccgcgacaggatccagcccatatacagctcgttgcggtgcagatggcgggcgagcttgggcgtgccggtggtgccgccggtgtggaaataggcgcagacatcgtccgggccgggttccgaccagccgaccggccggtcggcgggggcggcggtgagcagggccccccagtccttcaccttcggatgcaccgccatgtccacgggcccgccgccgaccttgatgaccgccgtgatgcccggcaggcgctcggccgcggccacggccttttcccagaggtcgagcccggggaggggacccggggccaggatcagtttcgcatccgccgcctcggcgatttcgacgatctggtcgatgccgagcagcgggttgatcggcgccgcgatgccggccgcctccgcaccccagagcgcgatatgggtttcaggcaggttgggcatcagcatggccacggcatcgctgcgcccgagaccgagcccggcaaaggcattggccgcacgggtcaccgcctcgaaaaaggcagcgtagccaagctcacgcggggtttcctcggcggtacctgccgacagatgggtgatggccggtgcatcgccataggccatcgccgcccagcgcagcacgtcataggtgctggtgaagccgaggcgctggtcgagcggcatctcggtctcgatccgctcgacatcggcgatcgaggcgatgcggaagcgcggccccatcgggtggcgggtggcggcggggttggtggtcgtgggcatccggggcggtctcccttgcgcggggccggcttcttcggcaggccggcctccttcgtcctggtgttgccggatgatgcccgttccggggcgcgcggtcgagacggcagcggcgattgtatcgggagatttttcggcggaggaacgagggctgtgaccaatgtcgcgccataaatgaccattggtcatttattatgggggccgtcgatctatcactcagccagggatttccagcatgtccgcttctcccgcccccatcttcgcaggccgccgcgtgctcatcaccggtgccagcagcggcatcggcgccgccatcggccgccgccttgccgccgacggcgcggccgtgatgctcgccgcccgccgcaccgaccgccttgaggcgcttgccgcagagatcaccgccgccggcggcacggccgcaattgccacggtcgacattgctgaccgcgccgcggtgcagcgtctggccgacgaaaccgaagcccgcttcggcgccatcgacgtgctggtcaacaatgccggcctgatgccgctctcgccgctcgccgccggcaaggtggaggagtgggagcggatggtcgacgtcaacctgaagggcgtgctctacggcattgccgcggtgctgcccaagatgcaggcccaggggcgcggccatgtgatcaacgtggcctcggtcgcagctcacaaggtcttccccggcgccgccgtctattgcgccaccaaattcgccgtccgggccctgtcggaagggctgcggatggaggcggggccgaagatccgcaccacggtgatttcacccggcacggttgcgaccgaacttgccgacaccatcaccgtgcccgaggtggcggccatgatccgccgctatcaggagatcgccatcggccccgaggcgatcgccgatgccgtggcctatgccatggcccagcccgcaaccgtcgacgtgaacgagatcgtcatccgcccgacggcgcaggacctctgagcctcgtgacggccggagggccgccgcggcggcgcccctccgcttcgcgtgtgcgcgcaggtcgacatgccgtcccggccttgccccgctgcgacttcccggccattctggcacccagatgggacgatccgtgcggacgtcccgccactggccaggatggagcccccttgaccattgcccccggacggcgcgcacgcagtaccgaagccaaggctgcccggcgcgaggcgatcctcgatgccgcccggcggctttacgaggcggcgccgacgatcgaggcggtgggtatagaagaggtcgcccgcgcggccggtgtcgccaagggcacggtctatctttatgcgccgtccaaggaagcgctgttcctggcgctttatgagcgcaccaccctggcctggctcaaccggctggaggcgcggcttgccgccaagtcggcagccgatccggcgcgggcgggctatgccgccgatgcggcccgggctgcggcggccgccgtggtgggggcctgtacggacgtgccgttgatggcccggctgaacgccgcgctgcacggctcgctggaaccgcggctggatgcggatgcgctttatgcggtcaagatcggcatgatcgaacggttgaacggcatcgcccgcgatctcggccgggtgctcggcctgccggcgcgggaggcggcggaggtcgtgcccggcctgttcgtgtgcatgatcggttgccatcacgtcgcgatgccgccgcccaatctggccgggctgtacgagcggcccgagatggcgccctatcggcttgatttcagccggttgatggggaattccctgcgggacatgttcctggggcggctggccgcccgtccggaagaacccgcctgacataaatccgaatcctccctcttttattccctgatccgaccggttgcgatggccggtgcctgcgcgcgagaggcgagcggtaccggcttttttgcgtgttccggtccccttgactcggcctgtcacggcgccgtaacgtcgaggcgtgaaagaaattctgatctatgaaaaaactttcacagccatcatcgggccgcgggatgcggccgcagtgaagcaccgacgcaggccgggagggccgggcggagggtatgggccagaacgggcgccgagggatccgaagccaagcgatcccggtccgagacgttggggaaacgccgagatgaagactttcaccgccgccctgctcgcgggggcgatcgccgtggccgggatgggcatgaccaccgccgcggccaaggccgaagagacctctcccttccgctgcaaggaaggcgagacctatgccatgaacgtcatggtgtcgggcgtggaatactggttcccggtctatgagatgttcaagcaggccgcccatcagatgggctgcaagaccgtctataccggcacgccggattacgacgtgaccaagcagctggcgaccttcgaacaggtgctggccaaacagccggccggcgtgctgctgcacccgatgaaccccgatccgttcatcgagccgatcgatcgcgccgcagagatgggcattccggtcgtgacctttgcggccgattcgcccaacagcaagcgcgtcgcctatgtcacttccgacaatttccgcgagggcgccacggccgccgatactctcgccaaggccatgggcggcaagggcgactacgccatcctggagaatcccggccaggacaatcacgaccgccgggtgtcgtccttcatcaggcagatggaggaaaagtatccggagatgaagctggtggcccgcaccgccaccaaccaggatccgacccgcgcctataacgcggtgctgaccatggcccaggcccatcccgggctcggcgccgtgttcatgcccgaggcgagttcggcgctgggcgctgcccaggcggcgaacgagctgggcggcaagatcaaggtcatgagcgtcgacgtgaacgccaaggtgctcgatatgatcaaggccggccagatgttcggcgcgatcaacccgaaccagggcgtccagggctatatgggcttcatgatgctgttcctggcggcccatcccgatctgatcgacccgatgaacgactataagcgcagcggcttcaacccgttcacgctgccggtcatcgacaacggcttctcgatcgtgacgcccgagaacgcccaggatttctattgggacgcttacctgaagcgccgcggcaccaagggcatcgacgagtgaactgaggggtgcggcccctgcggccgggcgggtgaccgcccggcatgctcccgccctctttctcctgccccctctctttcctgcctcagcatcacccgagaacggtccggctgatccatgacccatcctgaaccggtggccggcgcacagggcgagaccgtcctgaagcttagcggcatcaccaaatccttcggcccggtcagggtgctgaccggggtggatttcgacctgaaggcgggcgaggtccatgcgctggccggcgagaacggtgccggcaagtcgaccctgatgaacatcatcgacggcatccatcgccccgatggcgggcaggtggagctgttcggtgaagcggtgcatctgtcggggccggccgaggcccaggcgcggggcatcggtttcgtgcaccaggaaatcgccctctgccccgacatctcgatcgccgagaacatcttcatggcggcaccccatgcccgcggccgctggttcctgaaccggcgcgagttgcggcgcaaggccgaggcggtgctggggctgctgcacccgatgccggtggatacgccggtcgggcagatcggcatttcggcccagcaactggtcgagatcgccaaggcgctgacgctcgactgccggatcctgatcctggacgagcccaccgccgccctgaccgaggccgaaacccggcggctgttcgacgtgatccgcacgctgaaggcacggggcatcgcgatcatctatatcagccatcgcatggccgagatcttcgagatctgcgaccggatcacggtgctgcgcgacggccgcaaggtggtgaccaaggcgatcgccgacaccacgcccgaagaggtggccgaacgcatggtcggccgcgaacttggcgacctctacccggaaaagccgggcgtgcccgcgggcgcgccggtgctgctgcaggtggagggtctggccgatgccgacgaccatatcgcggaaatcggcttcgacctgaaggccggcgagatcctgggtctggccgggctgatgggcgccgggcgaagcgagatcgcccagaccgtctgcgggctgcgccaccgcgcggccggccgggtggtggtcgaggggcacgaggcgcggatccccgactatcgtggcgccacgaaacagggcctcgcctatctttccgaagaccgcaagggggcgggcgtgttcctcgacatgtcgatcgcggccaatgtctcggcccaggatccgggccgcgtagccggccggctgggcatgatcgacggccgcgccgaggcggcccaggcggccgaattcggccggcggatgtcgctgcgcatggcgggccccggccagaaggtgtcggagctgtcgggcggcaaccagcagaaggtggcgatcgccaagctgctgctgaccggcccgcgtatcgtcttcctggacgagccgacccgcggcgtcgatgtcggcgccaaatccgagatctatcagatcctccgcggcctggcggccgagggtaggggggtcgtggtcatctcgtcggaactgcccgagctgatcggcctggccgatcgcatcctggtgatccgcgaaggccggatcgccggtgaggtggcggggccggagatgaccgaggaacacatcatccgacttgcatccggcgtgggcgcccccggcgccgccggcgaagggagcctgcggccatgagcacggcagaaaccaaccgcgcagagactgacgggcggaagaccggagacatgaaggccggggcgcatccggccgaaccccgcctgtcgctgctcgcccgcttcaacaagatgcgcgaggccgggctgatcgtgatcatcgcggcgctgttcgtgatcatgagcttcgcttcgccctatttcctgaccgtcgccaacatgaaggcgctgatgctctcgttctcgatcgagggcatcgtggtggtcggcatgaccatcctgctgatcgtgggcggcatcgacctgtcggtgggggcggtggtctgtttcgccatggtggtggcgggcaagctgttcctgctgggcgtcgacccctggaccgcgtcgctcggcggcatcgccgcggcggcgatgtgcggcgtgatcatgggcgcctgtgtcacgcggatcggtctcaaccatttcatcgcctcgctcgcgatgatggtgatcgtccgcggcgcctgcctggtgatcaccgagggcacgccgctgtcgctgttctcgttgccgaaagagttcaaattcgtcggtcagggctcgctcggtcaggtgccggtggtgatcctgatcttcctggcgatcgtggtggtcttcgacctgctgatgcgccgggccgtggccttccggcgggtgttctataccggcagcaaccccaaggcggccgactattccggcatccgcacctcgcgcgtcatcttctgggtgacggtgttgagttcggccctggccgggctggcaggcgtgatcttcatggcccgcttcggcgccgccacccccaccttcggcgtcggcatggagctgaacgtgatcgcggccgcggtcatcggcggcgccagcctgaagggcgggtccggttcggtgctgggcgcggtgctgggtgtcgccctgctgtcgctggtgaccaattcgctcatcctgctcgacgtctcggtctactggcaggatatggtgaaaggtctgatcctgcttgtcgcggtctcggtcgaccatatgctgaaccgcagacgcgcctgacctgccacccgacccatgaccgaaccgctcaaacgtcgggtgcccatgcggagagtgaccatgcggcatgacgaccggacgcccaccggggatgtcagacaatacgacctgacccgccggatctaccgggcgctggtgatgcattatgtcgaaggcctgaaacaggccgagatcgcaaggctgaccggccagtcgatcgcgaccgtcagccggctgatcaagcagggtcacgatctgggcatggtggagatcaccgtccgcgcgcccttccagccctcgctggagctggagcggcggctggcccgggcggccgggctgatggaggcgctggtggtgcccaacctgtcggccaatgacgaggtggcgctggcgagcgtgggcgaggcggcggccgggctgctgctctcgcgcctcaaggacggcgacacgatctgcatctcgggcggcaagggtgtcagcgccctggtcgccgggctgaacccggcgcgacgctacgacgtctcggtcgtgccggcgaccggtctcgtcgaaggtccgctttataccgacgtcaactatgtagcggcgcagatggccgagaagctgggcgggcgcgcccatcgcatccatgcgccgatgttcgccgacacggtggaccagcgcgccatgctgatcgacatgcggtccacccgcgacatcctggaccgcgcacgccatgccgatatcgcggtggtgggtgtgggctcggtcacgccggccggcagctcttactacgaccttcatccggaactcgccgacgaccggacggagatcgagcggtcgggcgccgaggcagaactgctcgcccatcttctggatggggcagggcgggtctgtcgctatcagatgaacgaccggctggtggcggtcaccccggaggaactctcccgcgtgccattctcgatgggcgtcgcggtcgggccggccaagatcggcccgatccgcgccgtgctgcgcggccggcatctgaaagggctggtgaccgacgagaccacggccgatgccgtgctgcccggccttgaggcggaggcacctgccgcccggagctgagcccgccccccgcccccagatccttccgccgacgacgcccgccgcatcgcagccttgcgatgcgcgaggggaggctttgtctccgcgccgccggcccgcacccctcgctttcccgtcccgtctttcgcgtcaccgcagttttccggaggcctgcccgtcatgaccacccgcacacgcggacatcggctggatgtcctggccaaggcgcccgatcctgacgtcgtcgtgatcggcggcggcatcaacgggatcagcgtctatcgtgaactggccctgcaggggttgcgagtggtgctggcagaggcgcaggattactgcgccggcgccagcggtgccctgtcgcgcatgatccatggcggcctgcgctacatggagaacggcgagttcgatctggtgcgtgaggcattgcgcgagcgggacctgctgctgcgcaacgcgccgcatttcgtggcgccgctggccaccaccgtgccggtgttcgaatacctctcagggatcggcaatgcgccgctgcgcttcgtggggttgagccgcaagcccagccggcgcggggcggcggtgctgaagctggggctcaccttctacgacatcttcacccgcaagagccggatggtgccgacccatcgctttgccggcaaggcgcgcaccgcacgcgactggcccgacctcaatccgaaggtcaagtgcagcgccacctattacgatgcctggatcacccatcccgaacggctggggctggagatgatccgtgatctggaagcgacctgccccgatgcggtggcggtgaactatctggccgccgagggcaccgatggcgacgccctgctgctgcgcgaccgcatcggcggccgggaattccgcctgcggccgaagcttgtggtgaacgccaccggcgcctggatcgacctgaccaaccggcgggtggccaacctggtggacgcccccggtgccggcgcgctgccgcggatgatcggcggcaccaagggatcgcatctgatcgtgcgcaacccgcggttgctgaaggcgctgggcgaccagatgatctattacgagaaccaggaaggccgggtctgcatcctgttcccctatttcggcaatgtcctgatcgggtccaccgacatcaaggtcgacacgccggagggtgtgcattgcgagaccgacgagcgggcctacatgctgcaatcgctgcgcttcgtcttcccggatatcgagatcacgcccgaccagatcctctacaccttctcgggcgtgcggccgctgaccaatgccgcagcggcgaccaccgggcagatcccgcgcgatcaccattgccgtttcgtgccggaagaggccgggctgcccttcccggtgatgtgcatgatcggcggcaaatggaccaccttccgcggcttcggcgagatcgccgccgaccaggcgctggaacggctgggcgggcggcggcgggtgtcgaccgacaggctcgcgatcggcggcggccgcgatttcccgccggccgggccggcgcgggagcgctggatcgccgatctggcggccgcgacgggcatcggtgcccatcgggcacgggcgctggccgaacgttacggctctgccgcgcgccggctggcggatgatttcgtggccgcgggcgaccggccgctcgccgccgatccgggctatggcaccgccgagatccgccatctgatccgggccgagcatgtcgaggcgctggaagacctgatctgccggcgcacctcgctcgccatctcgggcgagctgtcggccgatctgctcgacgagctgctggcgctgctgagtgaagagcgcggctggacggcggaacgggccgccgatgaacgggcccggacgctggagcggctggccgcgctgcacgatgtcaccgaagacatgctccgcgcgcgcaacgagacgacccgggccgcaggctgagcccggcgcgaacctgcctctgaacacctggcttgaagaaagggccgaccatcgatgtccgacaagttccgcctcaaccgcctgttccgcaatggccgctgcctcgacgtcgccatcgaccacggcatcttcaacgagccgaccatgctgtcggggctggaggatgccaaggccgtgttcgacaggctgatcgcggccgcacccgatgcgatccagaccaatttcggtcaggccgacctgttgcaatcggtgccgacctcggcgaagccggccctggtgatgcgggtcgatgcagcgaatgtctacaaccgccacaagcacacccacatgtggtcgaccctgcagcaggccgatgatccggtgctgccggcggtgcagctggatgcggcctgcgtggtgatcaacctgctgatgctgccgggcgaacacgacctgttccgccagtgcgtggagaacatcgcgaaggtccgcgccgcctgcgatcgctatcgcatgccgctgatgatcgagccgctggtgatggcgccccattccgaggccggcggctatatggtggatggcgatgccgagaagatcgtcgccctggtccgcttcgcccgcgagttgggcgctgatgtgatcaaggccgatccgactaccaacccggaagacttccatcgtgtggtcgaaaccgcccggtgcccggtgctggtccgcggcggcggcaaggaggatctgctgacggtgctgaagaagtcggaagcgctgctgaagcagggggcgaaggggctggtctatggccgcaacgtctatcagcacgacaacccgacgggggtgacccgggcgctgatgacgctgatccatgacgacgccaccgcggaagaggccttcgcggcgtataaggccgttgccgcctgaggcgggggcgggcgctgccccccgaggcagcgccacccgtaagaagacgtcagggaggaaaagacatggcctatcttctgggcctcgatgccggaaacaccatggtgaaggcggtgctgttctcgatcgacggtgtcgagcttgccgtcgccgagaagggcgggtcgacccgccatccgcgcccgggccatgtcgaacgcgacctggacgaactctgggcctgtgcggccgcggcgatccgcggctgcatcgcccgggccgggatcgatccggccgagattgcggcgatcggctgcgccggccatggcaacgggctgtatgcgctcgaccgcgaccggcagccgctgatgggcattcagtcgatcgatgtccgcgcgggcgggctggtcgagcgctggaaccgcgacggcaccaccgaccggatctgtcgtctggcactgcaacggccctgggcggcgcagctgccgaccctgctgtcgcatatccgcgaaaccgacccggaaaccttcgcccggatcggcaccgcgtttacctgcaaggattacatcgccttccggctgacgggagaggtggcgagcgacgagaccgatatgagcggtgccgcctgcctgaaactgcccgaggggcgctatgacgacgagctgctcgccgcctatgggctggagggctgcggcggcatcctgccgccggtgcaccggtcgagcgcggtgaccggccgggtgacggcgcgggcggcggccgatgccgggcttgccgccggcacgccggtggtcggcgggctgttcgacgtgatcgcgagcgcgctcggatcaggcgtcgtccgcaccggtgctgcctctctggtcgccggcacctggagcatcaatcaggtgatcgtggacgagccgatccgcgacaacccgcccttcatcacctcggtctatgaaggcacccgcttcatggaggtggaggcctcggcgacctctgccgccaatctggaatggttcatgcgcgaatgggtggcgcccgaggccgatgccgccgagcggccctatgacatggtcaaccggctggccggcacggtcaaaccctcggccgatctgccgatcttccatcccttcctgttcggggccggcgacgatgccgcggcgcgggcgggattcttcggtctggccggctggcatcagcgggcggatctgatgttctccctgttcgaaggtgtcgccttcggccatcgcgcccatgtcgacaatctgcgccatcgtggcatctcggtcgaagacgccgtgctttcgggcgggggcgcgcgcagccgggtctggtcgcagatcttcgccgatgtgctgaacctgccggtcaccgtcacccgctgccaggagaccggcgcgctgggggccgccatggtggcaggtgtcggcgccggcatcttcccggatttcgccgccgccgcggcacgcatggtggtggtggaccgcgcccatgaaccggatgcggcggccgcggagatccacgaccgccgctatggcgtctataccaccctggtcgaggcgttgcgcccccactggaagcggtgggggagctgacggcttacgccgggcgggcgtccttgatccggcgacgcagcttgaccatgccgccgatccagcggtcgtagtcgttggtcttgttgcgcatgtaggtgagcaccacctcgtgcggcaggatcaggaagcgctcgtcgtcgagcgccttgaccacgatgccggccacgtcttccggcgtcagcacgccgtcgagcgaagcgggattgccgtccatggagcgcagcatggcggtatccacgccctgcgggcagagcacagacaccttgatgccgtcgtccttatgggcgatggcgagcgattcggcgaagccgatcgcggcatgtttggtggtggaataggtggtgctgccgatctgcgacaacagcccggcggccgagacggtgttcaggaaatagccggcgccgcgcgccttcatccgtggcagcagcgcctttgccgcatgaatatgggccatgacgttcacgccccagctgcgctgccagtcggcttcggtggcggaggcgacgtcgtcgaaatccggatcgccgatcgcgatgccggcattggagcagaagaggtcgatcgggccgaacttcgcttcgacatcgtcgaccaccgccagaatgtcctcgaatttcgagacatcggccctgtaagacgcagtggcggcgccctgggcgacggtttcggccgcgccggcctcgttcaggtcgacggcaatcaccgccttggcgccctcgtcggtgaagcggcggcagagcgcgcggccgatgcccgcgccaccaccggtgacgacgacgaccttgtccttcagctgcatggggggagttcctccggcatgtttgtgatttttttgcgggatgactatacgggctccgacccggctgccggaagcacgacatggccggcccggggatctgcgctgccgtcatgaagcgcgcggatgatccgggcggcggcccccagcccgcgggcttcctcgatccggatccagggatcgccgccggtggtggcggcagtcatgaaccgggtctggtccaggttgaagcggcgggtgaattcggccccgccccagtcggcattgcgtttgcggatctgcaccggcgcgaagaacatcaccggcgccgggccgggcagggcggcaccggccgcgagcgtccggtcgagcggcgcggtgttggccgccgagccgaccagacagtcatggaccaggcccgggccgaaatggccatggacgcgcgcacgtagcccgtcgtcgcccgagaaatcgacataggtggtcgggcggtcggcggcgatgccgtccagctcgtcataggtcaccacccggtcgtagaggccgagcgcttcggtgaaaccgcgattggcccggctggtgaggccgatcagctcggggcgatcggcaaggcccgccaggcagaaggcggccccataggcggttttggccgaggcggacgagatcaccagccgcgccgcgccgaaccagccattgtcggccagataatccgccagcacgaaagaggtgatgaacagcggccggatcagcatctgggcgttttccagggccggcgaccagaccggatcggccgtgcagcgggtatactggttataggccgaaaccaggggcaggcgatgctccgcctggtcatagaagccgcgctccgtcacccggccgggctgcatgacgatccgggtggcgatcgggaaatagccgtagaagcgctcgcccggcgcgatgccgtcgacatcggacgcttcgacctcggcaaagccccagaccggcatatggccgtgatcaggccggccggtcggaaagaaatcccaatagcgcatcgcctcgccgaaggcggcgtaggtgatgttgttggtggtgagcgcgaagcggtcgagccggagccgtatgctgcccggcgcggcggccggggcgggtatggtctcgatcagggccgcgccgagatcggccttcggtgtcagcagccgggtgatggcagggctgtcggtcatgggtgtatcctccctttgtctgccatcagcctagccctttgccgggctccgggggttcggatttgccatgcctgccacgccgctgacaccgccggtcgcaaggccgctgaaacggccggttcaggcccgtgcgcgcttcaccgttcaggcgatctatgacggtctggttcggatctggctgcgcgacgggccggatgcggtgacgatgaaagcgattgccgccgagaccggttttgcggtcggcacgctctacgactatttcccgaaccgggcggcgctgctttccggctatgtccgccactgcatcgacgatctgatccggcggctggaggccgatgccgccgcggaaccggatctgccctgggggccgcggatcgtgcggctggtgcggatgacctgcggccgggacggtgccgcgccctgtttcgaccacgacatgctgatggtcgagcacgcgatcgccgaagagaaacatcatcgccgcgcctatgaggaattgtccgccgcctggctgcggatcctggaggcgacccccggccggccccagggcatcgacgccgcggccatccgcgccgccttcctcaccgtgctcggcacccgccgctatgtgctgctggtggagccgaccgagacggaggtgggggactgggccgggcggctggagcggatctgtcttggggcgctggcgggcggctgaacccggatctcgtcatcccgggatggcgagggtccggccttcggcggcgacacgccagcttgccacatcgcccagcatgatgtcggcggcctgccgcgcccgttcctgtgcggcggcaaggccgtcggtgccggccgcatcgtcggcctccatggcggcgatcagggcggtgatgtcggcggccatgcgtttcgaacggcgggcgctgccttcgaaatccccgatgacgcgaatgccataggcggccgtggccagcaccggcaggccggcagtcagggctgtgacgaggaattgccacgagtcgcggatcggtccgaccgacaattcgaccgccatgtagacggttgcgacaatcagcgtcaggacgaaaagcagctcaccgaaggtctcgaggcggtgttccagctggtgcatgcgcttgtgggtggagccgtggtaccggcactgaccgtcgagcatactgtgcagggcggtccgggcccggatgccgtggtcgtcggcaggccgcaggacgggcaggccggcagcccgcagcagggcccgttcataccaggcggtccagatgccaatccggccctgctgcacggtcgggcgggccgccaggccgtgcatgggcagcgccacgcgcagccgctccgccacctcgcgggcctcgagccaacggcgatgccaggcccgccgccggccctggatggtgttgagcaccacccagagcagcagcaggatttcgatgccgacgaagaccggcttgccgatcgattttaccccgaagctcttgccgaccaggatcgacagggcaacgacgaacaccgccagggccgcgcagaggaagttcaccaccaccgcgctgcggaagatctgggcgtaataattggcgagtgcatcggcccagccataggccgcggtaaggtcgggcggtgcgccggcatgggccgccgcttcgtcgtccgctgccgtttcggggctcgtggcgtagaaatcccgccagcgcggccggcgcatgaaggccatggcctggagccacagccaggcctgccggaactggatatgcctgcgcccctctctcagatagtcggccagatgtgcgacctcgtcaccatggacgggcggagcggtcagctgctcgatcaccctgcccagctgcccgatcggctgcggcggcaggtcgtgaaaggaaagatccgtgcgcggatgccggtccagatcgcgccagcggatcgtcggcggtgtggtgtcgtcggccgctgcgatcaccaccaccgggatgccgcggcgggcggcggcttccagcatgtcgggggtgccgccgcggccggctgcggggccgccatcccagatggcgatcagcagggccgcatggtcgagcatggccagtccggcgcgctcataggcctggtccgccgcagcccgctgtccgggcagctccaccacgcgggcggcacgggtgaggagggcgctgaacgcctggcgggatgctgcgtcggcgaaatcctctgcataggtctccgccgcgaagggcaggggtgcctccagctcgaaacccgccgccaacccggcttcggccacgatgcggtcggcgccttcggccaggctggagacgaccgacagccgcggatcatccgtgctccagacagccgcatgccttttctgcacatcggcgatggcgacctgtatctggcggagcacgtctgcgacctctgcgctgatccggtggacgccggatgccggcagccggttcggcctgtggccggtgacgccgacggacagggcgaggcgcggtttcgggggatggctcagtcgcggcggatgggtgggcaaactgtcgggcttggtcatccgccggttgtccttcctgtgatgccggtcgccaacggaaggataggggcgggggcgtgcaaccacaaggttgcggatcatgccgatgcagcggctgtctcggttgcggcgtttcagtgatattgataatgagttgcaaaatcgatagcctgccgtcccttttcgctgatccgcagacggctgccggccatggccccgacgaaatccgcagacctgcccgggctggtcgagagcttccagatgcactacggcgatctgctgcgctttctgcaacggcgctgcggcgaccccgaacgtgcggccgatctgatccaggatctgtacttccgggtccgcgccgccgaggaagaggggcgggtggtcgaggatccgccggcctggatgcgccggatcgccatcaacctggcgatcgacggtcagcgccgtgaccttcgcttgcggcgcgagcagggcgacgagatcgaaggcatggtggtggcctgcgagcggcccctgccggaccgcgcggttgcggcgcgcgaacggctgcgggtgcttgacgccgccctgcaggcgctgcctgataatccgcgccgggcgctgctgctgcatcgtgtcgaggggttgacccaggccgagatcgcgcggcggctgggggtgtcggaaagcatggtgatcaaatacgtggcccaggccctgaaacattgccgcgactggcagcgccggatcgacgagggggctctgccgctcgtcgggcatggccggcagggcggcgcctgatggtcgcgtccttgccatcctctcccccatccccgcccgagggtggcgatgtctcggatatcgccatcgactggctggtgcgtgtgcgcctgggggcggccgatccggaggacttcgctctctggcgcgcggcatcacccgcgcatgaggcggccgcggtcgaggccgaagccctgctcgacgagatcgggcagacgccgaccgcacagatcttcggggcggagcgggccttcggggccgagcgggtcgtgccgctccgcccgccaccggccccgaccctgcggcacccccgggccctgtcgcgccgccgcctgctgaccggcgccgctgcggccggcgtggttgcagccgcaggcgcaggcgccctggtcgccgccgggcccggggtcggcggccgggtgatcgccgcgctcgatggcggcgagacgacatcccgcggcgagcgccgggcgatcaccctcgccgacggcagccgcgtgacgctcgccggctgctcggcaatccgcgtcgatgtttcggcggccggccgccgcatcgagctgctggccggcgaggcgctgttccaggtggccgccgacaccacacgccccttcatcgtgacggccggcaccggccgtgcagaggccatgggcacgctgttctcggttgcctgtgcgggcagggcggcccgggtggtggtggtcgaggggcgcgtcgaggcgggccccgccgacggccacgtgccgatgcccctcaccgccggccaggccgccaccaccggccccgacatgaccgcagagccggtcgacgccgcaagcctcaccgcctgggcccgcggccggctgatcgtgaccggccagcccctgtccgaggtggccgcccgcctggaccgcgacggtgcgctgcgcctgctggtcctgggcgacaccgcccgcacccttcccgtcaccggcgtcttcgacctggatgatccggaagggacgctgcgggcaatcgcaaccgtgctgccggtgcgcgtgcggcgggtggggggtgtggtcgtggtgacggcggctgcctgacccgtgccggcccggcgggcgccggtcgttccctgaatgccccgtcccgaaaaaaatcacgcatcccattgtcggttcccctccgtcccgtcgtcctggtcatagaagagctgcgaatgatccgcaatcgcttgatggatcggcagcgaccaacaagacggcacgtccacggagtatcggtatgacggaacggatggcggggcagggtgcccggatcggcgggcgcaaggcggggatcgggctggcggcggccggtgcggtagtgattgcgctggcgccggcagggctggcaacgccggccagagcgcaggcggcggcaaccgcagaggccgggctggtcaccttcgacattccgccgcagatgctggatggcgcgctgacggcactggccgatcaggccgggctggtgctgctgttctcggcacccgaggcggcgagcattccgtcggacgggcttcgcgggccgcatcaggtggacgaggcgctgcgccggttgctggcgggcacgggctacggccaccgtttcgtcgacggccgcaccgtcaccatcgatccggtgcgcacacgggcggggtcggtggtgctgccagacatgctggtgaccaccacggcggccggctatgaacagaagctggtcgatgcgccggccagcgtcaccgtgatcccgcgcgaggagctggagaagcggcccttccgatcgctgtcggatgccgtgcgccatgtcgaaggcgtcaatgttgtgggcggcgacaagggttcgatctcgatccgcggcatggaggccggccatgtgctgatcctggtcgacggcaagcgccaggagaccagcgccgccaatcccaagggcgccaatgccgaggggctggcgcagaactggatcccgccgctggaggcgatcgagcgcatcgaggtggtgcgcgggccgatgtcgacgctttacggctcggaagcgatgggcggcgtgatcaacgtcatcacccgcaaggtcggccgcgactggtcgggggccgtcggcgccgactacaccgcccagggccatagcaagtacggcgatgagtggcagggcgatgtttacctgtcgggaccgctggtcgaagaccggctggggctgcaggtctgggggtatgagaagcggcgcgacgaggacgacatcgccagcggccatggccgctcgctgcgccgcaacggcacggcccggctgaccctgacccccgacgacatccatgaaatccagctggaaggcggtcgcaccacccaggaattccgcaaccgtctggacaagagcggccaggaccgcgagaccgaatacacccgcgaccatatgtcgatctctcatggcggcaactggtcgttcgggcgcagcgaggtggcggtgtatcgcgaggtcgcccgtcgcgagggcccgaccgagacctggcggcccgaagccaccaatatcgtggccgatgcgaagctggtggtgacggaattcgaggagcatgtgccgaccatcggcctgcaatggaaggagtccgaactttcctccggcggctatcgcggacgcaccgatggtgaccgcaccaccacctccgtctgggagcgttcggccttcgtcgagaatgaatggcgggtgaccgacagcctgagcctgaccggcggcctgcgcgtcgacgacaacgagtatttcggcgaccactggaccccgcgtgcctatgcggtctggcggatggcgcccgactggacgctgaagggcggcatcgccaagggcttcaaatcgcccgctctggtgcagatcaacccggatatcggcaacccgcagcgcggcggcaccgtcacctggggtaacccggatcttcagcccgaagagagcgtgaacaccgaaatcggcctctattacgaaggcagcgacttctcggtcaacgcgacgctgttcaacaccgactacaagaacaagatcgccaataccggctcggccatcctgcgcgacgagaacggcgagatcatctacagccccgacggatcgggcacgccctatagcggctatttcaacatcggcgaggcgaccatgcgcggcctggaactggccggccgctggcagatcaccgaagccttcgggctgcgcggcaattacaccttcatcgattccgagatgaacaccaagggtgccaccttttacaactacagccttgaaagcctggacggcgagaaactggtcggcgtgcccgaccacacgctgagcctgacgctggactggctggtgaccgaggatgtctcgaccttcgtaacgggatcctatcgcagccgcgagagccggatttccttcggccagggcaacaccgccagcgacggcatcggatcgaccaccaccttcgatctgggcggcacctggaagatccatcccaacctgtcgatgaacgccgcggtctacaacgtcaccgaccaggtgcacgagcccgaggagggcaagtactggtatgtcgaggacggccgccgtttctggctggggctgcgggcgagtttctgaacccgcccgccggccgggcaagaacactgaagactggagacgggcatgacggatcggcacgggcggcagggcggccgccggggcggggaggggctgcgatgacgacgcaggtcgaggcacggtccggggagcgtctgccccatgggctgggtgtgatcctgcgggtcctggcggcggggccgctcggctatgcgctgggggcgatgacggcgctggtggccgcgcgccatctgccgggccccgcgcgcgacgccgcccaggcggcgatgatgctgggctttctggttcatggcggggtggtgatctgggtgttcgcggcggcgagcgccgcccgggcctgggcctggctctgccccttgggcgtggcactgcttctggcctggaggctgccatgaaggccgggttccgacagtccatggcgtggctgcatgaatgggccgggctgctgatgggctggctgcttttcgccatcttcctgaccggcacgatcgctttctttcgcgacgaggtcacccactggatgcagcccgaactgcacggggtccgggccgaggccgggggagcgacggcggcggatgtggggctggactggctgcggagcaatgccgccggtgccgggatgtggatgctgaccctgcccgacgaacgttcgcccgtgttgggcgctgcctggcggccggatggcgcgccggcggggcgggcggggttccgccgcgccgaactcgaccccgcgaccggtgccgaactgcacccgcgggaaacggcgggcggcaacttcctctaccgcttccatttcgagctgtatgccgtgccgcgcgacaccgcgcgctggatcgtgggcatcgccaccatgttcatgttcgtggcgatcatcagcggcatcatcacccatcgccggatcttcaaggacatcttcaccttccgccccgacaaggccgggcagcggtcgtggctggatgcccataacgcgaccgcggtactggccctgccttttcatgtgatgatcacctatagcggcctggtgctgctggccggcacgctgatgcccttcctgttcgacggcccgcgcagtggtggtgagcggggcggggagcggccgctggcgcacgccgtggcgccggcctctgccgcagcacccgtcgtgccgctggcgccgctgatccaggctgccgaagcgcgctggggcgggaaggtcggcagtgtcaccatcacccgacccggccggccgggggcggagatcgagttgcggccgctgcatgccgccagcctgccgaccgccggccgcaccggcgaccggctgatcctggatgccgccgacggccggctgatccgggcggtggacggttcggcggggatgagcacggtggcggagatcaacaccgtcatcaatgtgctgcaccgggcccgctttgccgagccctggctgcgctggctgttcttcgtggcaggtgtcgccggcacgatcatggtcgcgtcagggctggtgctctgggtggtgaaacgcgctgcacagcatgcccgcaatggcggcccctccatcggcttccggatcgtcgagcgcctgaatgtggccggcatcgccgggctctgtcttgccaccgccggctatttctgggccaaccgcctgctgccggccgatctggcgggtcgggcggaatgggagatcaggatcttcttcctggtctgggcggcaaccgcgctgcacgccctggcgcgcccggtccgccgcggctgggtggaacagctgggggtttcggcgctgctgctggcggttctgccgctggccgggatgccggggcttctggccggagatgcgcgggtgatcggctttgcgctggtgtcgctggcaacagcggcggggctggcccatgccgcgcggcggctgtcgcggccggcggcggctggcaggcccgccgcccgccgcagaaccgccatggcggcgggagagcgggcatgagcgcggctgcattcacctggcccgcctgcgtgctggcctgggcggggtttctggggctggcactggccatggaccgccaccacgatcaggttctgggcggcaggccctcggtcctgcggcggcggatcgcgacccttgccggctggggcctgctcgggctcgccaccgctgcctcgatcgccggctggggctggtcgatcgggcttgccgcgctctggggcgtgcttggcctctccggcggcgggctggtgctggggctgagctacgcgccgcgccggctgccggcgcttacggcagttctggccctgacgatgtggctgccggcggtgctggtctgaacggccgccgccgggcgggcagggtgacgatggcgaggcaggcgatcaccagtgccacccccgcccagccggccggcggcagtctttcgcccaccaccaggatcgccagaatggcggcgaccaccggttcgatcagcgagatggtggtggccaggctggcggggatgcgcgccagacccaggccgaagcagacatagcccagaaacatcggcaccagcgccatatagatcccgaccgcggcattgccccaggacgtgaggaagggcgcgcccgtcagggccagcaccggcatcagcagcagcccgccgatgccgaaggtggcccccatggcgacggaggaccggataccgcgcagcatcagcccccgtgcggtccaggaatagagcgcataggtgaagccgccgaccaggccgagcccgatgccggcgagcacggcatctccggtgtcagaggcccccacctcggtcaccccgaccccggcccctccttccgccaggcagagcagcaggatgccggcgacaccggtcagcgccccggccagccagcggggcgacaggcgggtgcggtcgaagatccgctcgatcagcgccgagagcagcggggcggagccgatggtgaccaccgtgccgatggtgacgccggccagccgcatggaggcatagaaggcgagcggatagaccgcgaccgccaccccgcccaggatcagcagcacccggttgcgggcaagatcgtgccgggcgcgcaggatgccgcgcccggcacgcagggcctgaagcagcccgcccagccccatggccgcggccccgatcgcggcggcgccgacctcgggcgcgaaggtcgcggccgtgccggtggtgccccagacgagggcggcaaacagcaccgccagactacccaacccctggtcgcgtgatgcgttattcacttcagaaccgccccgccatcggccatcatgtccctcaccatctcttccgccatgctgcgggcctcgatcatcagcgtgctttggccctccagcccggcgcgggccatggcgccttccagcagaaaggccagccgcttcgccagccgcgccgcccgcgcgccgtcgccgccggccagcccgaccagcggggcggccagcagggcctcgatttcttccttgtgccgccgcaccgcctggcggccgatatcgtcggcggcaagctcggccgcggcattcagcaggccgcagccgcgaaagccgtgctcataggcgaattcggcgtggtcgcgataggcatcgaaaaccgcaagcacatgatccagcggcgtttgcgccactgcggcccgccgggcgtaaagccccagccattcggcatggcgcgcctccagatactggttcaccagatcggccttggaggcgaagttgttgtaaaggctcttcttcgccaccccggcccgggccacgatggcgtcgatgccggtgccggcgatcccatgatcatagaacagcgccgccgccgctctcaggaggcggtcgcgcgcgggaagggcgccatcggcggggcggccggtcttgtcatccgtggcggcagggggtgtggcggcagggggcatgggcatcagcctcgataaataggtagaccgatctacctacttatccacccgcccgtcaagcgccgacagccccggccgccatcaaagatgacgccgccccgcctttccggcagactgatcccccgcaggcttttgcgcgaaccccaagcacacgtgaaaaccccgggaggttcgcagcggggattccccatatttatcaagcgtatgcattttgcagtgacatgacacacacgcgtcggcatggtctgccgcgaggttcgcgcaaaccggcttttttggcgccgaatcagggtattgaagaggggtaggtcgcaccccgcgggggtgcgtggattgaaacggcttctggccgtcttccttttataacatctgggtcgcgccccacagggccgcctgaaccgacctccagaacctgaaccgaccccacggccgggggccacgcccccggctatgggctttgtcatgcccgatggttgcggcttgtccggcatcgctggccggtcggcacaacctccgcgttttgcatcggaatcgactcgccttaagcgcgtttctgtgcgtacatattcatacgcatggtggcagaggcgtgatctgcggggcgtctggggcgggtgtctgcgccaggacgggccggcagggaccctggacgccccggcctgacctgcgtcaaccggcagggaggttaccgtgaccgaatttacccccattacgccctatggcgtcgccatccgcacggcgatggccagtggcaatgtcgatgcgctgaaggtggcgctgtcgcttgcccaggaactctatgcccgggacggggatgtccgctcggcggtttcggccgcccgcgctcatctggcgaccgcccgcaaacccaagaagtgatcagccctaagaactgatcttgccgcgcgatccatcacctgatcgcgacccagtcgaggagaccggagatgagtgattccgtcatccgcccgctttatgccgcgccgccgcagccccatccgatccccctttatgcggccaccctgcatgccgcggtggcccgcaacgatgtggatgagctggacagcctgatctgccaggccgaagcctatctggacaagtatggcgacctgccgtcgctgatcgaacagctgaagaccgagatcgcgaagctggaacgctgaacgtcgcggctgggagaaacgccatggtcgacaagacgtccgacggcgccaccgcaatggtgagtgcgctttatgggcccagtgtgcgcgctgcgatcgtcagcggcgatctgggggtgttgaaggcgacgctggccgcggccgagacgcagaaccgccagcagggcgatatccgtgtcgcgctggcggcggcccgtgccgcccatgccgggctgaagcggggctgaggccccggatcggtcccggtggttcccggtcccggtcgttcttggtcccggtggttccctggccggcatgcaccccgccgaccggccggggaaccgacttgcatcagattgccgtttgccccggagtgtcggaggtgcctgcatgcccgatggtcagaccccggcggagcgcgccatcccccgcgcccgcagcctggacgacatcgtcgatctggttcccgtccatgtggtgtgggagatcacgctggcctgcaatctgaagtgccagcattgcggatcgcgcgccggccatgtccgcaagggcgagctttccaccgccgaatgcctggatctggtcgaccagatggcccggctgggcacgcgtgaggtgacgctgatcggcggcgaggcctatctgcgtcgcgactggctggagatcctggcccgcgtgcgcgcccatggcatcctctgcctgatccagaccggcggccgcaacctgaccgacacgcggctggaggcggcgatcgccgccggcatcaacggcatcggcgtatcgatcgacgggctggcgccattgcacgaccggctgcgcggggtgcccggatccttcgatcaggcgatgtcggcgctgacccgcgcgaaggcggccgggctcagcatttcggtcaacacccagatcggcgccgagaccatggaggatctgcccgaactgatggaccggatcatcgcggccggcgccacccattggcagatccagatgaccgtcgccatgggcaatgcggtcgacaaccccgacatcctgctgcagccctatcggctgatcgaactgatgccgcttctggcccggctgtatcgcgagggggcaaggcgcgggctgaccatggtggtcggcaacaatatcggctatttcggcccctatgaatcgctctggcgcggcttcgggaacgaggcggtgcactggaccggctgcgccgccggccagaacgtgatcggcatcgaggccgacggcaccatcaagggctgcccgtcactggcgacgcaaggctatgccgccggcaatatccgcgatctcgcgctcgccgacatctggcggaaccaggaggcgatggccttcggccgcacccggtcggtggagaaggatctctggggctattgccgcagctgctattacgccgatgtctgccgtgcgggctgcacctggacctcggattcgctgctgggccggcggggcaacaacccctattgccattaccgggtgcgcgatctggcgaaaaagggccgccgcgaacgggtggtgaagatccgcgaggccgggcccgaaagcttcgcggtcggcgaattcgcgctgatcgaagaggcgatcccgcccgaggagctggcggccctgccgcaggatcgcctgccggccatttccgccaccgacagccggccggtgcatatcgcgcccgaaggcgacgacgatcccgcccgcgccgccggcgcccggggccgcattccgccgcatctggatctctgccggtcctgccatgaatatgtctggccgcacgagaccgactgcccgcattgcggcgccgacatcgccgccgccgccgccgcttatgccgcaaggctggcggaggtgcaggccctggccgcgcggatccgcgcccggctggacgaggcggtaccggaggtgtgaggcatcagccagcttgacggcgggcgacccgccgtttcagtcggcacaacatgcggccgcccgaaacatcagcgtggggcaagaccctgttgcccaccccctgacgaacctctacccggctgctgctgattctggtcccggcacggcccctggcggcaatcctgctcctggcggggggcctcaccggggccgccgcgatcgtgatgatgcggcgcgcaggcagcgaggccgagcagcgccagcatcagcaaagccagtgccatgatgggcagggcgggaagagtgatgcgtgcaatcctggtcatggcctgtcatcggctgtcgttgaagaggattataaagtatccgtagtgactgcagtagatgaagttaagtatctgtaaatcaaagatgggctgcgtggtgcggggcgggcggcagccctgccgctccggcgccgccatcctgccagcggcggcggaacagagcaggccgcggggagatgggatagatggggcttgcattcaggggcgcgccttcgtagaaaaagatatgttataacattcttaagaacgtcaaacggggttgtcatgatcgaaaccgcgcgccggacggtgctgctctgcaccaccgccctgggatcgctcttcggtgcggtcgccgcggccggggccgaagaggccacggttctgccgaacctggtggtgggggcggccagcccgatttcccgcgagggcacgcccgatgacggcctgccggggctgtcgccggtgaccaccggcggcttcatcgccaccaccatcgtcgatcgcgaccagctggacctgtcccgcggccagacgctgggcgatgtgctggacggcgagccgggcctcacctccagcagcttcgcccccggtgccagccggccggtgatccgcggcctggacaacgagcgggtacggatccaggagaacggcatcggcgcccatgacgtctcggcgctgggtgaagaccacggcgtgccgatcgatccgatgtcggccgagcgggtggaggtgatccgcgggcccggcacgctgcgttggggatcgacggcgatcggcggcgtggtcgatgtgtcgaacgaccgcatcccggtcgacatcgcccccggcatcacgcgcggccgcgttcaggccggcgccggatcgatcggcggcggggtcgatggcggggcgtcggtgacgacccgcagcggatcggtggcgctgcatgccgatgccttcgcgcgtaaatccaacgattacgacacccccgacggcgcccagcccaatagcggggtggaagccgacggccagtcgatcggggccacggtgttcttcgaccagggccatatcggcacctcgctgacccgctatggcagcgtctacgagatcccgggcggcgaagaggccgagctgcaaacccggatcgacatggagcagatcaagtggcgggcgctgggtgaataccggccggacagtggtttcctgaaggccgtgcgcggccagatcggcctgtcgcgctatgaccatgacgagatcgccctgccgcatgagcacgagcatggcgacgaccatgatcacgatcacgaccatgaccacgatcatgacgatgaccatgatcatgatcatgacgaggccgaagggctgggcgtccatggcagctatgccagccgcgagcaggaagcccggatcgaagccgagcatgtgcagatcgataccggcctcggcgccttgaacggtgccttcggcctgcagctcaaccaccagaagctctccaccaccggcgaggcggaggaactgctgctgccggccgagaccacggcggtggcgggcttcgtgttcgaagaattgcagctgggcggcgggctcaggcttcaggccgccggccgtctggaacaggtgcgggtcaaggggaccggcgccgatttcccggccgatctgctgcccggcgccgatgatccggccttgcgcgaccacaatctcgacttcctggccggcagcgccagcctgggcgcgctgcaggagctgggcggcggcatcgtcgcgcgggcgaccgcgcagtatgtggaacgggcgccaaccgcgaccgaactgttctccaagggctcgcaccacgcctcgggcactttcgagatcggcgatccgaacctcgacaaggaacgcgcgaccaccttcgagatcggcatcggccgggccaccggcggcctccgcttcgatgcctcggccttctacacccgcttcgacggcttcatctacaagcgtctgacgggggtgacctgcgacgaggatttcgcctcctgcggcggcacggatggcgagttcgatcaggtggcctatgaccagcgcgacgccgtattctatggcgccgagctgaagggccagctggatgtggcaccgctggccggcggcatgctgggcctggacggtcgcttcgacagtgtgcgtgccgagttcagcggtggtgagaacgtgccgcgcctgccgcccgagcggctgggtgccggcatctggtgggcggatgacgcctggtgggcgcgggtgggcgtgctgcacgccttcgaccagacccgcaccgggctcaacgagaccgaaaccgacggctatgaccttgtcgatgccgagatcacctggaccaccgccttcaccagcggtggcgtaccgaccttcgtcaccttcggcgtgaagggcaccaatctgctggacgaggacatccgcaacgcggtgtcgttcaagaaggacgaggtcctggcgccgggccgtgcggtgcgggcctttgcgacgttgcgcttctgaacccggctcgacgtcggagacgaaaagacaacggcggcggagggtgacctccgccgccgttgtcttgtgaggctgtctggtggtcagagcaggaaggccgccgcggtcagatcggtgacatcggcgtcgatatcgatgaccagatcgctgttcgcatcgccatccagatcgacggcgatgatcgagacgccgctgcccagccccacgacccgcatctcacccgccgtatgggtgaagacccccgtgccgagaaaagtgagtggctgatgcccggccgtaccggcgtcggcatcgatcgccgacatgtcgatgagatcgccgtcgctgcggctgaaatcggagatccggtcccgggtgccgccagcggtgccgctgtcggagatgaagccgtagacgaagtggtcggcaccggcgcctccggtcatcgtgtcggcaccggcgccgccgcgcaggacgtcattgccgtcaccgccgatcagaacgtcatcgccattgctgccgctcagggttgcgccatcatggccggcgatcagcacgtcgttgaaacgggagccgatgacggcctcgatcgagatcagctgatccccatcgctgtcgttgccggcagcaaggtttacggtcatgccggcagaggcactcagatagatcaccgtgtcgaagccgtcgccgccatccagcacatcggccccgccgaggccggccagaagatcgtcgccggcgccgcctgagaggtgattggcggtgtcgtcaccggtcaactgatcatcggcccagccgccgatcagattctcgatcgagatgaagctgtcgccatccgaactggtgccggtcgacaggctggcgctgaccggactcagacgataggcgaagctgacatagtcgttgccgcctccgccatcgatcagatcggcacctgcgccaccatccagcacattgctgccggcatcgccgatcagatgatcgtcgcccgcgccgccggtggcggcttcgatcgagatcagggtgtcgccgtcgctggtggtgccgaggccgagatcgaccgtgacggcagtggtgtggctggcgaagctgaccgtgtcatagccggcgccgccatcgacgaggtcggcgccggcaccgccgtccaggatgttgccaccggcattaccgatcaggtgatcatcgccgctgccgccgatcaggccttcgattccggtaaactggtcgccatcggaagcagtgccggcgaccagatcgaccgtgatgccggtggtgttcccggcatagctggcgatgtcgtatcctgcgccgccgtcgatgagatcggcaccggcgccgccggtgatcaggtcatcaccgccattgccgcgaatgtcgtcggcaccatcgccgccatcgatccggtcattcccgtccccggcgatgatcaggtcggcgccggacccgccatcgaagatgtcgctgccgccgatgccgtaaagggtgtcgtcaccggccccgccgtcaaagcggtcattgccggtgccgccggtgatgatgtcgttgccgtccccgccatagaaggtatcactgccaccgccgccggtgatgacgtcgtcgccctccagcccgcgatagacgtcgttgccgggggagccgccgagcatatcgtcgccgggcgtgccgatgatgtcggtcaagatcattctcccgtcatggatgaaccggtctggagctgtccggtgaaagattacctatcgcaataccattgcgcgatcaatatgttgaagaattgctgttttagattcatgcgttgaaacgcagaaggcggcggatgccaaggggcaccgccgccttctttcgtggagggatcagggtcagagcaggaaggcgtctgcggtgaaatcggccacggggagggcaacttcgatgatggcattgctgctgccatcaccgtcgctgtcgatggtgatggcggtatagccggggttggaggatgcggtgatgcgcatctcgccggcagtcccgctataggcgccggtgccgataaaggtcagaccttcgcgcgcggtggtcgagggatcgatgtcgagggttgagaaatcgatccggtcgcttgcggcgatatcgagatccatgatccggtcgcgggatgcgaggccagtgtcgctgtcggagatggactgaaacacgaagcgatcggcaccatcgccgccggtcatgatgtcgcggccgttaccgccgatcaggacgtcatcgccctcaccgcccagtagggtgtcattgccggaacgaccctcgagcagattgtccccagcattgccgatgatcgtatcgttgccgctgcctccgatgaccccttcaatggagatcagcgtgtcattgccgctgctggtaccctgcgcgagatcgaaggttgcgttggtcgtggcgatgttccagtcgccgatgtcatagccgtccccaccatccatgatgtcggcaccaccaccgccggacagcacgtcatcgccggcgctgccgcgaagcgtgtcgttgccatcgcctgcctcgaacttattgttgccagcattgccgatcagcgtgtcattgccgctgccgctgcgaacgccttcgattgaggtcaagctgtcattgtccggattttcgcccgtggtaaggttgacggtaatatctactccccgatcagaatagtcgaccagatccaggccgttgccgccattaagccagtcggtgcccagactgccctgcagcaggtcatcaccggcaccgcccgtcagacgatctgcgttgtcgccgccgatcagcaagtcattgtggtcgctgccgacgagggtctcgatgctgatcagtacgtcgccgaccgcttcgtcgtcgggacttgtgccgataccgccatggaccagactgacgacgacagcagcggtcgcataagcgtagcttgcggtgtctattccttcaccaccgtccagccggtcggcaccgagaccgccgatgagggtatcctggctatcacctccgagcaggatgtcatcgccaccccggcccatcagggtgtccatttcctgaccgccatcaaggatgttggcctgatcatcgccatagatgcggtcataggatttgccgccgatgaccttctcgatgcccgagtatgtgtcatctttcgcatcaccggcaccacgaccttgaaggagatcgacagagataaaaacggtagagctgctgtaatccgccgtatctataccctcgccaccattcattacatcagcgccagcgttgccgataagaatatcgtcgccgtttccgccattcagaatgtcatcaccagcgccaccgatgacacggtcattgccatcttctccattgaggacatcatcgcctgccgcgccgcccagggtgtcatcgccggcgccgcctgacactgtgtcgtcgccggactgtccatccagcagattgtctccgctattgccgatgatggtgtccttgccgctgcccccgatgacgccttcaatggagatcagcgtgtcattgccgctgctggtgccatttgcgagatcaatggttgcattggtggtggcgacgctccagtcgccgatgtcatagccgtcgccgccatccatgaggtcggcgccgccaccgcctgccagtacgtcatcgcccgcgccgccggtcaggctgtcggccccgtcaccgctttccagccggttgtccccgtcatcgccgatgagcgtgtcgttaccagagccggtgcgaaccccttcgatcgagatgaaggtatcgttgtccggattgacgccagtggcgaggttcactgtcacaggcccgtagcgatcgaggtaatcggccagatcgacgccatcgccgccttcaagtacgtccacgccgaagccgccccgcagcaggtcatcaccggcgccgccggtgagccggtttccggcgctgtcgccgatcagcaggtcgtcataggcgctgcccaaaagatcctcaatgccgatcagaacgtcgccgacagcctcgttatcgggggcggcgccgactcctccggtggccaggctgaccatgacacctgcggtcgcattggagtagctcgcaacgtcggttcctgcgccgccttcgagccggtccgctccgaggccccccacaagcaggtcgtcgccatcacctccagccaggtggtcgtcgcccgcacggccctcgagttggttgtgaccggcagatccggtcaggtgatcgtcgccctcgccaccgatggccccctcaatcgaggtaaaatgatcgtcttcaccctggcccgatgcgaggtcgacgaccacgggggatgtgctgtcttcatagctggcgatgtcgaagccgtctccgccgcgaaggtcgtcgctccctgcgttaccgagaaggatgtcgtcgccatcgccgccgtcgagcacgtcgtcgccgtcgccgcccaacagacgattcgcgccatcgtcgccgctgagcaggtcatcgctgctgccgccgataatgccttcgatggagctgtacgtgtcgccatcgggattcgtgccattgccaagatggatggtgatgcttgtggttcgttcggcatagctcgcaagatcgaacccgctgccacctgcaagtgtgtcggcaccattgccaccaagcagaatgtcgtcgccgtcctgacccatcagttggtcgtcgccgtcgcgaccctcgatgacctcgctggtggtgctcccgcggatgatgtcgttttggtttgtggcgatgatgtgctcgaacccgctggcacgaaaggttccgcgcgcataagcggaacttgtcccgagggtcaggttgacgcccgaggtcatgccggtgaggttgagggcgtcgtagccgatatcgcctctcacatccatagaggcgttgatcttcgtcgcctggctgatatggatggtatcgtctcccgaacttccgaccaggtaggcgtcgtctgtctctccgtagatgatgtcattacccaaatcatcccagatgaagtccgagccggcgccgccatatacgatgtcgtcaccgtcggcgccgtagagactatcattccccgcgccaccgtagaggatatcattgcccccgagacccgtgagtatgtcattgccgtcgcccccctcgaagatctggtttgaggcatcaccatacaggcgatcggcgaatgctgtcccgacaatgcgctcgatgcttatgagttgatccagaatggactcgagtccctctacgtcatagtaattctggtcagatcgataataaatgccgctgctataatcagagtagtcggctgtatcgaagccgtcaccaccattcaggacgtcgttgccggtcccgccgatcagaacatcgtcgccggcgctgcccgagagcgcgtcgttgccggccagaccatcgatgatgtcgtcgtcatcagtgccgacgaggatgtccgcagtctccgttccggtgatcatgtgtatctctccatctatcgttcagggcaggcgggcagcgggcgcgaggggaacagcaccgctgcaagccgcggatgtcgcagtcatgtgctcgtacagaagtatgcgcgcctgcaggttacatgatgaagcgtttttgatatgtgagttcatgttcagtcaaccatatgaaatgcgctgcttttagaaaaatgcattgtctatcaatattttactgaaatgtcggtgggatcactatgatgtggttaatgatctactaagaacttcatgcgtcgcgatgcgacgtcagctatgcctccctgggtatgatattctcccatatgggagaatgtggaatgccacctgcagatcatgccgcatggaggtgtccgccgactcagagcaggaaggcgtctgcggtgaaatcggccaggggcagggcgacttcgatgatgacgtcgctgatgcggtcaccgtcgccgtcgatggtaatggcggtatagccggggttggaggatgcggtgatgcgcatctcgccggcagtcccgctataggcgccggtgccgataaaggtcagaccttcgcgcgcggtggtcgagggatcgatgtcgagggttgaaaaatcgatccggtcgcctgcggcgatgtcgagacccatgatccggtcgcgggatgcgagggcagtgccgctgtcggagagagattgaaacacgaagcgatcggcaccatcgccgccggtcatgatgtcgcggccgttaccgccgatcaggacgtcatcgccctcaccgcccagcagggtgtcattgccggaacgaccctcgagcagattgtccccagcattgccgatgatcgtatcgttgccgctgcctccgatgaccccttcaatggagatcagcgtgtcattgccgctgctggtaccctgtgcgagatcgaaggttgcgttggtcgtggcgatgctccagtcgccgatgtcatagccgtccccaccatccatgatgtcggcaccaccaccgccagacagcacgtcatcgccagcgccaccgcggagcaggtcgtcgccgtcgccgcccaagagcgtgttgacgccgtcatcgccgcccagcacgtcgtcatacgcggagccttccaggttctcgataccgaccagcacatcgccttcggcatcgccccccgcaccgatgacggcatcggcgacggtgaccgtcgcgccgccggcaaagccggcccagctgccctcgatcgtctggcggttggccagatcgaccgtcacccccgctgccgagccggcgtaagaggccgtgtcggcatcctcggcagggtcgtagagatcggtggtgtcggcgggcagggtcagttcgccgccggcgatgagatccgcaccggcgccgccggtgagggtatcgttgcccaggccgccttcaaggaaatctgcacccgcgcaggcatcgatgatgtcgtcgccttcgccgccgaggatgctgtcgtcaccctggtcgccgtagacggtgtcgttgccgtcaccggcctcgattatgtcggcgccgtcgccgccatggatcatgtcctggccggcgcctccttcgatctcgtcgtccccgccgtcgccgcaaatcgtatcgtctccggcttccccgaggaggcgatcatcgcctgcaccaccatcgatgatgtcgttacccgcgcggcccctgagcgtgtcgtcgccacccaggcccagaagggtgtcgtcgccggacgtgccgttgatgatgttgttcgcatcggtaccggtgtaggtcgccatgccgcggttccctcgcctgcgggtcacatgatgcgggcatgttgatgcgtgtctgaatggtcagtcaactacaaggaaatcagacaattttacgttaatatcaatggtgttaaaaatgcgctgacagatcaaacaggtgaccatgtcatggttaacgaggttttaataaactttttgcgtgggatgggaggcggcagctcgcacgcccggttctgatggtgcgcagacaggaagacggcccgcggctgatgacaaccgcgggccgccgggtctgcgctgcctgccggacgtcagagcaggaaggcgtcggccgagaagtccgccacgggcagggcgacctcgaagaggaagttgctcgtcccatcaccgtcggtgtcaatgccgacgctggtatagccggcattgacggaggccgcgatccgcacctcgccggccgtgccggtataggcaccgctgccgatataggtcatggtctcgtgtgcgctggtcgagggatcgatatcgaaggtcgagaggtcgatccggtcgccggcggcgatgtcgagatccatgatccggtcacgcgaactggtgccggcgctgctgtcgctgagtgactggaacacgaaccggtcggcgccgtcgccgccggtcatgatgtcacggccggtattgccgatcaggacatcatcgccgtcgccgcccgacagcgtgtcattgcccgaatgaccatcgatccaattgttgcctgcatcgccggtgatggtgtcgccggcggtgccaccgatgacgccttcgatcgagatcagcgtgtcgccatgggtgttgtcgccggtcgaaagatcgatggtctggccggtccactggttcagatagctggcgatgtcgaagccgtcgccgccatccatgacatcgataccgttgccgccgcgcagcagatcgtcgcctgtaccgccgatcagtgtgtcatcaccattgccaccggcgagaacatcattgcctgctccgccgttgagtgtattggcgaattcgccgccactcaaggtgtcgttgccgctgccaccaatcaggttctcaatcgagatcagcgtgtctccatccgagttgacgccatcgatatcgatggtgagatcggtggtgaatacctcatagctgacggtatcactaccatagtggccatcgatgacgttggcgccgacggcactgatgatcaggtctcccgactgaccaccaatgacgttttcaatgtcgatcagctgatcgccttcactgcttgtgcccgccaccagatcgatcgtccgtccgacgacctgttcgacatagctcgcggtatcgatgccggccccgccttccagacgatcggcgccgctgccgccgcgcagcagatcgtcgccattgccgccgatgagaacgtcgtcgccattgccgccggccagacgatcattgccgtcaccacccgagaagatattgtcgaggctggtaccgttgagtacatcatcgccgctgccaccgatcaaaccttcgatcgacgaaaagcggtcttcattgccctccgcggtgccgagattgaccgtgatcccggtggtacgatcctcgtagctcgcatagtcgaagccgtcaccgccaaagagggcatcttcacccagaccaccgatcaggatgtcgtcgccgctgctgccgctcaggcgattttcgccggcatcgccgatgatggtgtcgttgaaggtggtgccggtgacgttttcgatggaggtgagggtgtcctggtccgaggtagtgccgctggcgaggtcgatggtcatgccggcagtggcatctgttgccacgaaggtatcgatgccgtcgccgccgtcaatctgatcgatgccggcgccaccatagatgatgtcgtcgccaagcccaccgtcgatcgcatcgtcaccggcgtaaccgagaagcgtgttcgcgccgtcgttgcccgtgatcacgtcgtcgaactggctgccgtagaggttttcgatgccggtatagatgtcgccgttcgcctcaccggccgtgcccgtgcccgtggcaagattagccgtcacgccacttgcagcctccagataggcgaccccgtccgtgccctcattgccgatgagcgtgtcgctgccggctgaactgatgaggatgtcgttgccgcggccaccatcgatcctggcgctggcgatcgagaagatgacgtcgttgtggtcgctgccgaggacggcttcgacattctggagctgatcgatgggcgtgccggtcgtgaagcccagataatttccctcgccggcgttcccgttggcgagatcgatacgcataccggtaccggcaccggcatagctcacggtgtcgaagccatccccgccgtcaatggtgtcggcgccgtcgccaccgtccagggtgtcatcgcccagaccaccgaggagggtatcgtcacccccgccaccctggaggatgttggcgccggcatcgccggtcagcatgtcatcgccccagccgccgatcaggttctcgatcgaggtgaagccgtcgccatcggtattggcgccggtcgcgagattggcagtgaccgaggtgaggcgataggcatagctgacatagtcgttgccgtcgccgccgtcgagggtgtcggcgcccaggccaccatccaggacattgttccagatatcgccggtgaggctgtcatcggcctcaccgccggtcgccgcttcgatcgaggtcagcgtgtcaccgtcgctggtcgtgccggtggcgaggttgacggtgaccgaggttgtccgcccggcgaaggtgagggtgtcgaagccgaggccaccatcgatcgcatccgcacccaatccgccatcgatgatgttggcgccgtcatcaccggtgatggtgtcgttgccgctgccgccgatggcaccttcgacattggtgaactggtcgccgtcggaggccgtgccggcggcgaggtcgatggtcaggccggtcgtataatcggcatagctgacccggtcgtagccggtgccgccgtcgatcacatcggcaccggcgccgcccatgaggaggtcgtcgccatcgccaccatcgaggatgtcggtgccgctgccggcggtaatcgtgtcattgccggcgccgccgtcgaaggtgtcgttgccgccaccgccggtgatcacgtcttcaccctcaaggccgtagaaggtttcgttcgcggtggtaccggtcagcgtgtcattgcctgccgtgccgatgatatcggtcaaggtcgatctccccatcccatctccgaagcacggcgccagggcccggcggccgtccttcccgtgcggtcaatgggcagatcttggtatgcgatcgaggcgttggtcaatcatgcgatgatcaagatcggatgacgctatcgtatgtaatggaattctgacgtgaaatcagccggctgcgatttttatcgtaaagacgtgatgaatgccgggcgcccgtttacctcatctcgtcacttgatccccgcccgcatgaacgactgcacgaaagcccgctgaaagatcaggaaggcgatcagcagaggggcggccgacagcagggtggcggcggtgatgatcgaccagtcgatgccctggtcggtggaggcgaagacggcgagccccacggtcagcggccgggtttcgaccgaacgcgccacgaccagcggccagaggaaattgttccagtggtggctgatcgaaaccaggccataggcgacatagaccggctttgccagcgggatatagaccctgcggagcaggccggcgaggctgcagccctcaagccgcgcggcgtcgtccagctctttcgggatggtcatgaaggtctggcggagcaggaagatgccgaaggccgaggcgacatagggaatggcgatgccggtgatggtgtcgaccaggaccagcttttcgagcgtggcgtagttctgcacgatcagcacgtcgggcatgatcgtcagctgaaccagcacgcccaggaacagcaggttgcggcccgggaactgcagccgcgcgaaggcgaaggcagcaagggtgccgatcaccagctggccggccagcgtgccggtgaccagcatcatggtgttcagcatgtagcgcgggaagggcgccgcctcccaggctgcacggaaattgtcgagggtgagcggcgccgtcaggtcgaagcgggtggcataggcgccgggatggaaggcggtccagaccgcatagagcaggggcgccgcccagatgaaggcgagcagccaggcgcccagatcgaccagccggggaaggcgggcgaccagccggggcaggcggtgacgcagcccggtcggaccggcgggcgagagcgggggcgtaatcacggtcatcgataatgcaccttccggtcgagcagcacgaactggccgatccccaccagcgccaggatgatcagcagcaccaccgagattgccgccgcatagcccgtgtcccagaagcggaagccggtttcatagacatagagcagcagcagcatggtggcgttgtcggggccgccgcgggtcatgatcatcacatggtcgaccatgcggcaggcattgatgatggcgttgaccagcacgaacagcgtggtgggcgcgaccagcggccagatcacccgccggaaccgcgaccagggaccggcgccttccagcgtcgccgcctcgatcagctggggcgggatctgggtgagggcagccaggtagaagatcatgaagaagccggcctccttccagatcgcgaccacgatcacggcgccgagcgccgtttcctgctggccgagccagttggtggcgccgaaaccgaacagtccggtcaactgatcgagcagaccgtaggagggggtgtagaagaacagccagatattcgcgaccgcgatcatcggcagcacggtgggggtgaagaaggcgagccgggcgaggccgcgaccgcggatcttcgacgacaccagcatcgccatgccgagcgaaatcaggatggtggcgggcacggtgcagagggcgaagatcagattgttccagagcgccttgagaaaggccggatcgtcgagcagccagagataatggtcgaggccgatgaatttcgacggccgcgcccccttggccgtggaatagagcgccgtgacgaaggtctgcaccgccggcacatgggtgaatgcggcgagcagcacgaccgccggcagcaacatcaggctggcgggcagaagatgggtgcggcggaaggtcatcggcggcgatccggtggtggtcgaaagacggagccggcccgccccctgcgcgcaggcaggggccgggccgggccgggggggggacggcgcctcagcgataggggcggaggatgcgggtggcctcggcctgggccgcctccagcgccggcttcggctcggcggcaccggtcagcaccgcctgcagcgcgttgttgagggcggtggtcacgcgctggttttcatgcgtcgacagctcggcgaccgcatagtccagctggtcacgggcgaccgcggcggccgggaagcccttcacataatcctgcatcgccggggtctgccaggcatcggggcgcaccgccacatagcccgtgtcgatgccccactgggcggcgcgctcgggcgtgctcatccaggtgacgaaggtcgcggcggccgccttctgggcgtcggtcgcgctggagaagacgtagaaattgccgccgccggtgggcgagccgcgccgcgccttggccggcagcatgccgacgccgaactcgaagggcgcattcttgcggatgttggtcaggttgccggtggtggtccagatcatcgccgccttgccttcgaagaagtcgcgcggcgtggtgccccattccacgatgccgggggcgtggatcttctccttggccgacaggtcgcgccagaaggtcagcgcctcgaccaccttcgggtcgtcgtaatgggtgacggtgccgtcatcgctggccagttcgacgtcgttctgggtggtcagcgcctggaacagccagtaggggaagcccgaggacgggatctgcacgccccagcggatgacattgcccgaggcgtcggtgcgggtcagcttgtggcccatggccacgtattcgtcccagctgtcgggacccttctccggatcgaggccggcctcgcggaaggcctccttgttccagtaggcgacgatggtggagcgctggaagggaatgccccaggtcttgccgccggcctggctgttggccatgaaggccgggtagaatttcgacggcagggccttttggtcatcggtggcggcgatgtcgtcgaaggcgacgatcgcgccctcgtcgatcagcgtgtacatgtcggtcgacagcatcaccgcgacctcgggcgcatcgccgcccttgaaggcggtcagcgccttggtgaccgtgtcctgatagctgcccgaatagatcgggttgacgtcgatctcgggatgttcggcttcgaaggccgcgacatagccgtcgatgatcttggtgatcggcccgccgacggcgaccggatagtagaagtcgagcgtggtcttgtctgcggcaaaggcgctgccggcgaccatggtcgaggccagcagggcggcagccagcgtgccggtgacggtgcggaacatgggtgcggttctccggtgagcaggcaggatcaaggtctgagcaggtcggccgcggttccggccggcgggtcgacgcgccggccggtggcagcgtcgaagacgtgcagccggccgggggcgatggagagcgccacggcggtgccgggcgcgatggcatggtggcccggaacccgggcggtgagacggccggcgcccggtgcatagccgtcgagatcaatgccgaggacggcatccgcccccagatattcgcgctcggccacgatgcccttcaggggggagccggtggcgtctggcgtcagaaccgggtcgccgagcggtgtgggtcggatgtcttcggcccgtgccccggccagcaggccgggcgcccgcgcgggctcgaccagcccgatcggcggctggccgatgaagcgggcggcgaagacggtctctgggcagtcgtagagccggtcggggcgggcggcctgttcgatccggccgccattcatcaacaccacctgatcggccatgctcatggcttcggcctgatcatgggtgacatagaccatggtcagccccaggcgctgctgcagggcgcggatttcgcgccgcatttccgcgcgaagccgggcatcgagattggagagcggctcgtccatcaggcagagcggtgcccgggcgaccagggcgcgggccagcgccacgcgctgctgctgcccgcccgacagctgagagggcctgcggtcgagcagctggccgaggcccagaagatcggctgcttcggccaggcggctgcgacgttccgtggccggaaccccgcgcacctccagcccgaacaggatgttgcgggcgacatccagatgcgggaacagggcgtaggactggaacaccatggcgaggccacgggccgccggcccgtcgcgggtgacgtcgcggccgccgatcagcacccggccctcgtcgggctgatccaggccggcgatgagccgcagcgtggtcgacttgccgcagcccgaggggccgaggagcaccagcatctcgcccggctctgcccggaccgacacgccgtcgagtgcggtcacccccgcccagcggcgggtgatgccgtcgagatcgaggccgataccggtgggggagggctgaggcgctctcatgcggcggtctccgcggcggtgacgatcacgcgggtgccggcagtgtcgagcagccgggcgagcgccggcggcggggccgcatcggtgaccagaagatgggcgtcctcgatccgtccgccgctggcgctggcggggcggccgaatttggtggcatcggcgatcagcacccgctgacggcaatgggccatgattgcctgacgcgcgatcacctcgtcaggggtgaagtcgagcagggtgccgtcgggatcgatgccgcccgcaccggcgatgccgaaatcgacccgataggcggcgaagacccgtgcggccgcctctccggtgacgccgcgatcgctgagccggccgcctgcaatggtcacatcgatccggggcgtttccgacagcagggcggcaatggcgacattgttggtgatgacggtgaaggcggtctcccgctccgccagcgcgcgggcgacctgttcgggcgtggtgccgatgccgagcgagaccgaggcgccgtcgggaatgagggctgcggccgcccgcccgatccggcgcttggcctccaggttcagcacctggcgggtgccgtaggcgatattgcggtcgggccaggctgccccgccatgcatgcgcttcagccggccgtcatcggacagcgcgttgacgtcgcggcggatggtctggggcgtcacccggaaacgggcggccagcgcgtcgatgccggcatagccggtctcgcggacaagcgacaggatttcggtgcggcggcgggtcgtgttcatgggcccgatcctgtccgtaccgcgtcatcggttcaaaggaaggttcggttttcgtttgatgacggttcggcgacagaaaaccgttcgttcgcgcaaaaggtgcttttcgaatgaacggtcgttggctcaggcaaatcgacactggccgtcgaacggggttggggatagaagcttcatttgatccacgggcaggcaatctgcgacactgaggcggccggcttccccgcatgccgcgacgcccgacgggcatgggccgcccgatggaaaacgggtcaggcccggttggatacgggccaggaacgagacagggacgaaggcgatcttatccatggacagacgagccggttcatccgacacgagcggggcagcgcgtccgccccagcgcgagctgccggtggccatccgcgaaggccggctggccgatgccgccgcggtgacccgtgtgggggtcgccgcctgggaaaaggggcccggcagcgtgctgccgtcgtcggcccgtgcaccaatggccgacggcaagatgtttgatgcgctgctgcgccagacgccggggcggattctggtcgccgatgtcggtggccatgtcctgggcctggcggtgggcgatcccgagggggagcagctgaccgatctctgggtcgatccgcgcgcctgggggcgggggcttgggagccgtctgctggccgccttcgaacaggcggccggagagcgcggccgcaagcggatcgtgatcgacgttctggaaggcgacgaacgcgggctgggcttctgccgtcgtcgcggctatcaggcggtcggccggtcgaccgtccgcgaccgggatcttcacatgatgatcggcaagatccgcctggagaagcgcctggcctgagcctgggcccccgacgaccgaaccgggtgactgttgctagaatgtgtcatcggggactgcgcgtgtatcgggtaaaccacggttaatcgccgtttacacgccgtttacatggatcggctatgacgagagcgtgacaccccccgaaatgcgggggccgggtggccgcgctgccccccgcgcgccccgcgagtgtgagtacgctctgaccatgatcaatgtcggatcgatccgcggccgccggagccgccgccctgcttcccgtctgcctgcttcccgtctgaccgcggccctggtggccggcaccgccctggcgggcgggctggctgccctggtgcccgcagggcccgcccgcgccgaccagccgggcggcatcatgaattcggtggacatgatcggcgcccgcgcgctttgggagcgcggcatcaccggtcagggcaccgtggtggtggtgatcgacagcggcgtcgagaccagccatcccttcctggacggcaaggtgatcgacgaggcttgcgtcggcatttcagtcggcggccggaccggcgattgtggcggcggcgcggactttgcgaccggcgagggtacggctgctccggattacaccgatgaagatgccaaccatggaacccatgtcgccggcacgatcgccggcaacaatggcgaggcctatggcgtggcgccggacgcgaagattgccgcgatcctggtcaagagccctgacggtttcgacgaggacgaggataactgcggcgagggcgaccccaattgcgccagcgccctgaatgacagtctgacccgcgcctattcgcacgtgatggagctggcccagcagtaccgggtcgtggcggtgaatatgagcctgggggctggtgaatattccggcatctgtgacgagcagacccccggcggcgcggcgctttccgaagccttccaggcggcccaggcttcgggcatcgccaatgtcgtggcctcgggcaacgagtatcacaccaccaccgtctcgacgcccgcctgcctgaccggagccatcccggtgggcgcggtggacagcgacgagatcatcgccgtgttctcgaaccagtcggaactggtggagttgatggcgccgggcgtcggcatcgtctcgtcggtgttcaacggcgaatatggcgagatggacggcacctcgatggcgacgccgcatgtggcgggtgccatcgcgcttctggcctcggcctctcccggtgcctcggtcaacgagatctatcaggccctggcgctgaccggcaaagaggtcacctatgacgaggcgaccctgatcgagcgggtggacggggagggccagcctctgcccgagaagctggtcttccgtctgatccaggtcgacaaggccgccttcctgctgatcgcgagccgggccgacgccatgacgctggccgcgacctccgaccggggccgggtgatgggcacgaccttccggaatctggtgggcgaggatttcgccaccgatccgctgacggtctatcgcgccctcgacgtggtcggccgctcgggcatggacggcgcgctgtcgcagctgagccccgaccgcaacaccgccaccgccgaggcgacgctggccctgctgggcgagatcggccggacggtgtcggcacggctcggcgccgtgcgccagggcggtgcgggcgtgaccgcggccatggatgcgccgcgccagtttgcggccgccgccaccgtgatggccgatgtcacctcgggcagctccagcctggcctcgctcgcccgcctgccgggcatggagggtggtgagaccggcggctgggtgcgcggtttcggccagtggctggatcgggacgcgacggcagagcgctatggctatcgggcgagcggcggcggcgtgatcgccggtatcgacaccatcgtcggcgagggctggcgggtcggcggcttcaccgcctatggccgcagcagcaccaagaccgatggcggcctgggcgagggcacggcggatctggcgaccctcggcgtctatggcggctataccaaggatcgctaccatctggatgggtcgctctcggtcggctatggctggagcgagaccgaccgcgtgatcgccctgccgggcctgctgcggaccgcgaagggtgagaccgagggtctgaccgtgcagagccggatcgcgctgggtgccacctatgacgtctccggctggtcggtcggccccgaggcctgggtgggctataccggcctgcagcagaagggctataccgaaaccggcgccggcagcctgaatgcgcgggtcgacgagctgtggctgggcgaggtcggcaccggcctgggcgtcacggtcggccgcggcttcgacctgggcggcccggtgctgatgccggcggtgacgctgggcatgggctatcgcagccccaccggcgacgacagcatgaccggcgtgctgggcggcacggcggcgggtgcctacaacctggatctggcgcgcgagaacgagctgaccttcgatcccgtcgtcgaggcggtgctggcggtcgacgggtcgaccagcgcctatgcctcgtggcgtggccgcttcggcgacggtgtcgccgaccaggccgggacggtgggtgtccgtatcacctggtgatcgccgacgcgatgaccaaaaacagggccggacgagcgatcgtccggcccttcgttctggtcgatccggcggcaggcggtcaggcggtcaggcggtctggcgggcgcgcatgtcgagcacggtcagccggccgctttcggtgaccgcggccagccagtcgccatcgtcgctgatcgcgatatcgacgaccgggctgcccgagggttcggtgatcggcgcaccggtgccggcccccggcaccgccaccaccagcccgtgatcatagccgatcatcagggtcggcgatttcggatgccagagcaccgccgtcacccccgtgccatagggctgggggatttcggtcggggccttgccttcggggccggtgcggccggcaaaggaccagacgatcacgttcgacgagccgctggtcgccagcatccggccattgggcgtgaaggcgaggctgcgcaccttggtgtcatagccggccatgcgcagcttgtggccatcggccaggcgccaggcattcagggtggaatcgcccgtggcggcgaccagccagtcgccatcgggcgagatccggccgccgatcaactgaccctcgaccggcagccgcttgggcgacttaccgaacgaggccgtccaccacagcgtcaccccgtcgccatggacaacggccagccgcttgcccttggggtggaaatccagtccggtgacggtgcgcggatgatcgtcgccatcgccggtgatccggccctggcgatcgatcagcaccacgcgcttgccggccgccgccgcgcgaagaccgccctggggcgaggtcgccacggcttccacccagcgccgccccagctctgccagcacggtgacgctgccctcggccgaaaccgaggtgaccttgccgtcatcgccgccggtcaggaaggcgccggcgccgatgtcgcgggcgaaggacagaacctggcccttgtgggcctgaacggcggcgcccagggtgaagccgtcattgcgccggaagatccgcacactgccgtcgcccagcgccacggccagggcctcgcccttgcgatcgaaggcgagacccacggccggggcgtcgagatcctcgctgcgccggcgcgaggccaggcggttgaaatagctgtcgggtgcggggttatcaagcaacgttgccatcgaatccccgcttcagctcggcggcatccaggtcgcggccgatcatcaccagacggctgcgccgggtctccccttccgcccaggggcggtcgagcgtgccttctgagatcatgtgcacgccctgcagcacgaagcgccggttctggccggcgaagttcagaatgcccttgaagcgcaggatgtcctggcccttggtcatcagcagcatgctgagccagctttcgaacagcgtcttgtcgagcggctggtcggtggtcagcgacaggctggagatcgacaggtcgtggtcatgggccagcacgccgggcgtcgcgggggtatgatcatggtcgtgatcgtggtggccatgcccgtgatcgtgcccatgatcatgatcgtggtgatggtggccgtcaccctcggtcaggaattccggctccagcgccagcgcccgcttcaggtcgaaggcgccgcgacccaggatcgcatccagggccacattgctgcgctcggtgcgatggatctgcgccagggggttcagccggcggatggtggcttccacccgtgccagcatgtcggcatcgaccagatcggtcttgttcagcacgatgatgtcggcgaaggcgacctgctgggcggcttccggcgcgtcgaccaggcgcttttcaaggttcagggcatcgaccaccgtcaccacgccatccagctgggtgcggctggcgatgtcgcggtccaggaagaaggtctgggcgaccggtgcgggttcggcaaggcccgtggtctcgatcaggatgccgtccagattgcccgagcgcttgagcagagcgccgacgatccggatcagatcgccgcgcaccgtgcagcacaggcagccattgttcatggtgaagacttcctcgtccgcgtccacgacgaggtcgccgtcgatgccgatctcaccgaactcgttgacgatgacggcatatttgcggccgtgctgttcggtcaggatgcggttgagcagcgtggtcttgccggcacccaggtaaccggtgagcacggtgacgggaatcttttccatgaggtcctcggacgggagggaatggttcaggcgtcggatatggcaggtccggcacgtcgcgccaaggccgggctgtccgccgggggcaaaagcatagcacccgtgcgggtacggcatcacccgccttgtgtggagacacaggctgccgggaaaccggttgcgacgaaacccgacatcgacgaaaccctgccgtgcagcgtatgtttcccctgatccgccaccttcaggtgacggggagggactgccatttcgggagcatcaggatgaccgacacccgcagcacgctctggaccggccttggtgccgctctggttcttggcgccacgctggcgggggtgccggcgccggcatcggcggcagcggcagccacgacatcggcgccggcggcagccgtgcttcagaccccggaattcgtggcccagctgggttatgtcgaagggcatctgcgggtcggtggcgcgctctacgccgatggccggcgggaagaggctctggtccatttccgccatcctgctgcccatatctacccgttgatcgcgccatcggtggcggcgcggggcctggcggggttcgaggccgaactcgatgccgtgcagaaggcggccgaggccggcaagcctgcggccgaggtgtcggccgcgattgatgcggtgatggcgaagctgaaggcggcggccagttccgtgcccgtggcggagcgtcgtgacattcataccgggctcaaggtggcgagcctgatgctggacaccatcgccgccgaatatggccaggcgatcagcggcgggcggatcaccaatgctgccggctatcaggatagtctgggctttatgcaggtggtgatcggcatcctgcgccaggcccagccgcgcttccaggaagccgatcccgaccgctggaaggcggtggcgggcgatctgcgccagctggcccgggcctggccgtcgctggtgccgccggctgatccggtactgcaggccggcgaggtcgatgcgctgacctcgcgcctgcgcctggcactcgacgggttctgagggcccggatgaagaccgcccatcgcgacgatggccggcccagggcccgccgacgaccgaaacggcgcccctggctggcgcttgccgccattctggtgccgctggtggctgcggcggtgctggcactggtccgcggcctgccctgagtcgatcagcctgagccgggcaacctgagccgggcagcctgagccgggcagcctgagccggtcagccggcggcttcggccgccagccagatcccgccggccatgagcgccagccccgccccgatatcgatgcgggccaggctgcgggcgccgagcctgcggccgaagcggctgccggccgccgacagcatcacccaccagccgagcgagccgaggaagacccccgtcgccagggcggccggcaccagggggccggcacccgccggtgtggcaccgaggccgagcccggcgaagaggcccgcgaaactcgcgatggtcatcgggttggagagggtgagcaggaaggcgccgagcacgtcgcgccccgcccggccggtgctggccgcagggccggcatcgccactggcgagcacggcccagccgcggcggaccgcccccaggccgatccagaggatcagcgcagccccggccagccgcggccagagcggatcgacggctgccacccccagcgccgcgccgaggccgaaggccgcaatcaccgcatagacgagatcggcggctgcgaccccgaagcccgaggcgagcccggctgtaaagccgccggtcacggcgcgtctgaggcagagcaggccgaccggccccaccggggctgcgaccgcaaggccgagggccatgccgcgtaagagtgcatcgagcggggtcatggcgtcacctcgggcggcagatcggagaggggcatgtcggggaagggggagggggcgccgtcatccttcggcgacgagagtgcgatcatgctgtggctgcggacgagcgcgccggtcgctttcagccggccgagcagggcttcgagcccggcgatgtccgcgaccctcactttcagcagataggaccagtcaccggtgacgtggtggcattccagcaccgccggatcggcacgaagcgtctcgacaaaggccgcttcgactgcagggccacccagcgccacgaacacgaagcccagcaccccccggccgatggccgcgggatcggcgcgcagcgtcatgccacggatcaccccgcgttcggtcaaccggcgcacgcgatcgtgggcggcggaggcggagaggcccgcggcctgccccagctcggccatcggcgtgcgggcatcggcctgaagccgggcgatgattttccggtcggcgtcgtctagcatcggacaaaatcccgagaaattcatattaatcgggattttatccgctttaatggggtatggaaagatggcgtcctgaaaattaccacgcacgatgaatgccatccggagtcaggtgatcggttctctggtaatgagaatgagttgcaattgcgtgagactccgtttaggtttcggcgtgtgaggcggttgcgacatgacgtcgcgatcgctcccccttagagccagccacccagcatgggggccgttccgccgtttggtcgcgctgcggccggggtggcccccatgccaggcagccagtgcccgctcccgggcgtggcgccgcgccccgttcgggagcggcactgcgcccgtccggtcataagaaccgccgtgagaaggcttggccccgtgtcgttctacgttctaaccaatcagggcatcgcccgccgccgcctgtcggcgctcggccttatgcttgcagccggtacggcccttgccgccggcaccgtgccccatgccgccgctgccgccgacgcggcgcaggagcttcagcttgccgccggccgggcgccgatcgaactcgatccggtaaccgtgctcggcacccgtaccgagaagacggcgagcgaggtgccggcctcgatcggcgtggtcggacaggaagagatcaagatccgccaggccgatgatctgggcgatctggtcgacgacatgcccggtgtcgaaatgtcgggcggcccgcgccgcaccgccatgcagccggtgatccgcggcctgaccggggagcgggtggtgctgcgcgtcgatggtgcgcggcagaatttcgaaagcggccatcgcggccggatcttcatcgacccctcgctgctggagcgggtggaagtgcggcgcggccccgcctcctcgctctatggcagcggcgccatcggcggcgtgatggaggtcgacacgctcagccccggccggttcctggaagacggtgagccctggggcggcgaggtcggtgtcagctgggaaagcaatggcgacggcttcggcgcccatgcgatcggtgcgacccggctgggtgccaatgccgaagccctggtcggcatcaccggcttcgatgccgacgatcttgagaacggctcgggcgaggccatcccctataccgccgacgaggtccgcagcggcctggccaagctggtcttccggccggccgaaggccacgagctgaccgcgtcctatctgcagttccgcgacgaccacatcatcccgtcggcggccaataccaacaccaacagcatcatcgtcgaccgcaagaccgaccagaagaccatgacgctcggctggcgcttcgacggcaacggcaacccctggttcgacctggatgcgaaggtctaccggacagagaccgccctggaagagcgccggaccgataccggccgcttcgacgagaccgatcttgcgaccaccggcatcgacatcgccaataccagccgcttccagctcggcggcttcggcagccatgccgtgacctatggtgtggaggcctatcgcgacgagcaggacggcaagcgtgacggcgatgcccggccgcaatatccggatgcgcagcaggacattttcggcctgttcattcaggacgagatcgtgttcttcgaacgcctgaccttcacgcccggcgtgcgcttcgaccgcttcgaccgcgaagccgatggcctggagggcaagtccgacgacgccgtcagcccgtcgatctcggtcgcctatgcggtcacgccctggctgaaggcctatgccagctatgccgaggccttccgcgcgccctcgctgaccgaactctatgccaccggcgaacacttcccgggcaacaacttcgtggccaacccggatctgcggcccgagacggcgaagaacaaggaaatcggcctgaccctgtcggaggcggatgtcctgacctcgggcgaccggctgaccggccgggttgccgccttccgcaatgatgtggaagacttcatcgagatgcaggtccggttcgacagctggccgggaaccaccacccggagcaacgtccaggacgcccggctggagggtgtggaattcgaactcgcctatgatgccccgctgtggttcgcgaccttcggcgccgcccgcatccgcggcgacgaccggaccgagggtgatccgctgggcgggctgccgggcgacaaggtgtcgctgggcggcggcctgaagttcatgggcggcgacgtggtgaccggctggcgcatggtcgcccatgaccgccaggaccggatcgccaatggcgagaccgtgaccccgggctatgccgtccatgacgcctggatcagcttccagccgtcggatggcgggttgcgcggggcgcgtttcgacctggccgtcgacaatgtcttcgacaagacctatcgccaggcgctgtcggaactggacgatccgggacggaccgtcaagctgaccgctgcctatcgcttctgatccgacccgccgttcttagcggaacgacccgacaaggaccgccgatcatgcacaccgaccctgcggacgtccgtatcgaagccgaaaccggccagcgctcgcaacagcgtaccggcccgggcgggccggccagcctggacagccatgcgctgctcggcgccgcgggggaggtgctgatcgcgcattgcggcgagacctaccgtctgcgccggacaagacagaacaagctgattttgaccaagtgaggcgaatgagatgaccatgccctccatcgatcagagcgccgaccttgccgcccgccgcgcggcccttgccgcggccgagccggggctgcgcgtccgcgaccaggcggcgcgtctcggcgtgtcggaaggcgaactcgtggcctccggcatcggcagcaacgtcatcctgctggatgccgagccgggtgacctgatccgggcggtagaaagcctgggcccggtgatggcgctgacccgcaacgagcatgcggtgcacgagatcgtcggcacctatggcaatgtctcgctcggcgcccatgccggcctggtgatcaacaagccgatcgatctgcgcctgttcctgaaccgctggttcgcgagcctggtggtcgaggaagcccgtggcgacacgaagctgtccagcctgcagttcttcgaccgccatggcgtcgccatgcacaagatctatctgcgcccggaaagcgaccgcgccgcctgggcggcgctgatcgaggcgaagcgtgccgccgtgcaggcgccgccggcctttgaaccggcgtccgaggccgacgagattccggcggaggcgccggccggtttcgatgccggctccttcctgtcggattgggagcatctggccgatacccacgacttcctgccgatgctgaagcgccatggcgtgtcacgccctgcggcgctgaagctggccgaaggacgtttcgcccgcaggctttcgcagggggccttccgcgcggcgctggaggctgcggcgcgcgatcaggtgaagatcatgatcttcgtgcccaatccgggctgcatccagatctcgggcggaaccatcaaccgggtggagccgcgcggtccctggatcaacatcctggatccgggcttcaacctgcatgtccgcgaggaccacatcgccgccgcctggcaggtcgacaagccgaccgtggacggcaccgtgaccgcggtcgagctgtacgacgcggcgggggagctgttcctgatcatggtcggcgtgcgcgagaccggcgtgccggagctgcccgaatggcgcgccctggttcatgccctgccgggggtaaccggctgatgcgcccggccgacctgaaccggcggcggttcctggcgggcctggccgcgctggggcttggcggcaccgtctccggcctggtcggccgggccgccttagcagcagatgccgccgcatcggaccggcttgtgaccatcggtgccgccgtcaccgaaaccgtctgggcgctgggggcgggggatcacatcgtcgcggtcgacaccaccagccagagtccggccgatgtgatgaaactgcccaaggtcggctatatgcgcacgctggccgcagaagggctgatcgccaccggtgcgacccgtgtgatcgccgatgacggcgcgggcccggcctcgacgctcgatcaggtgcgtgcggccggcatcgatgtgcggatgatccattccgcaacccggatcgacgaggtcgaggcggcgatcatggccgtggggaaggctgtcgggctggaaggttcggctgccgaactcggccggacggtcaccgctgaactcgcaagcctggccgcggcggcggagacccgcgcgcatcacccgtcggtgatgtgcgtgatcggcgtcggcaattccgggctgatggctgccggccgcgacaccgcggcggcagccgtgatccggctggccggcggccgtaacgcctttgacgaggtcgccgactatgccccggtctccgccgaggcggctgctgctgcggcacccgaggtgctggtgatgcctgaacatgccatcgcccgcatgggtggccacgatgccatcgtgaacctgccgcagctcaggctgacaccggccgcgcaggctggccggctgctttcgatcgacggccgggcgctcgccgggctcggcccctccaccgcccggatcgctgccggcttcgccgccgaactcgacagggcaggggtctgaggccgtggcggtcgtgaccgacgaggcctcttcgtccccgggcatggccggtatcgtcgacgcccgggcgcgtgcccggcggcgcatgggcacggcactggtgatcgcgcttctggcggtggcggtcgcggcactcgcgaccgggccgctcgccatcgcgccggccgattatccggcggtggcgcaggcgctgatggtccgctttggctggatcgatccggccgcggtcgatatcgcccgggccgatcaggtcaaggcggcggtgctgatggatatccgcctgccacgcctgatcctggggctgatggtgggcggcgtgctcggcctgtccggcgccgtgctccaggggctgttccgcaacccgctggccgatccggggctgatcggcgtgtcgtcgggtgccgcactcttcgcagtggccgccatcgtgctcggccatgcgctggtaccggcgctgcccggctgggcggcggcggcgatcgtgccggtcgccgccttctgtggggcgattgccgccaccatgctggtctggcggctggccggcggggctgcggtggacggggcagcggcagggcaggacatgtcgctgctgctgctggctggtgtggcgatcagcgcgatcgcggcggccggcgtcggactgttttcgtatatcggcgacgaccagcagctgcgggaactgaccttctgggccatgggcggcctgggcggggcgcgctgggggctgatctgggcgccggccatcgccatcgccattgcggcctggctgctgctgccgctggcccggccgctggacgcccatgcgctgggcgaccaggacgcctatcatctgggtatcgacggcacaaggctgcggcgccgggcggtgatcggtgccgcactgggggttggtgccgcggttgccgtgtcgggcacgatcagcttcgtggggctggtggtgccgcatctggtgcggctggccgtgggccctgcccatcgcggcgtgctgccgctgtcggtgctggccggtgccgtgctgctggtcggcgccgatctgccggcgcggctggtggcggcacccgccgaactgccgatcggcatcgtcaccgccctgatcggcgggccgtatttcattcatctgctgcgcgcccgcattcgcggtggcggcatctgatccaccggagggccccgatgctgagcctgacccgcgtcacctgccgccgtggcggccggaccctggtcgatgaagccgatctggacattcagccggggcgcctggtcgcgatcctgggttgcaatggcgcgggcaaatccacgctgctcggccttgccaccggtgcaatccgacccgatggcgggcgggtggcgctggacggggtgtcgctggagcggatcccggccgggaagcttgccctgaggcgggcggtgatggggcaggccgatatgctgggcttcgccttcaccgcggccgaggtggtggcgctggggcgggcgcccttccgcggtatcgcgacgccggacgaggatgcggtggcgatccgtcaggcgatggcggataccggcatcgggccgctggccgatcgtatcgtcacccggctgtcgggcggcgaacgccgccgggtgcagctggcccgaacgctggcccaggcggcgggctgccgggccgagccgggtacccgcgccctgctgctggacgagcccaatgccgcgctcgacatcgcccgccagcgcgatctggcgcgggtgatgcgtcaggcggccgatggcgggctggcggtggcggcggttctgcacgatccggatctggcggcggcggtcgccgacgaggtggtgctgatgcgggccgggcggattctggaccgcggcgcccccgcccgggtgctgacggcggcggcgctggatgccgtctatgacgtgaccgcccatgtggtgctggacggcaccaccggcaggccgcggatcggcttcagctggctttgagccgggccgcccgtcaggcgacggcggcaccgggcaggctggcggtggccgggcgccggcgcgggtccagcaccagggtcaggcgctgcggccggcggaaaccttcgccggtgatggtggggtcgcagtcctcggcgggtcggatgtcctgaaacccgccggccaggcggcgcagggcttcggcgatgatcgccgaggcgagcggccggcccggacaggcatggcgcccggccccgaaggagagtaccggcaccggcggccgcccgggcaggaaacgctccgggtcgaaacgatcggccgcccggaagacactttcatcgcgattggcactggccaggaaaacccggaccgaggtgccgcgccggacctcgatgccgcccagcatggtgtggccgcgcacgaagcgggtggtgtcgtgctggggcggctggaagcgcatcacctccagcgcgaaactgtcggccagactgggctccaccgccaggcggtcgatcagatggcgatgatccagcagcaccgccagcgcattggcgatggctgaaagcggggtttcgacaccggccgccatcatcagcagcatcagccgcatcagctgggtgcgttccagttccgaggccatgcgctgcaccctgagggccagcgcggcggggcgcggtgacagcccctcgtcgatcagccggccgatttcggcttcgagagcccggcggtcttcgaccacatcgcccagatcgacatcggcggtttcgatatagcggctgacccgcgacagatgccgggcaagacggtcgccggtttcggcatcgatgccgaacaggccgcggatcacgccgcgggcaatcggctcggccagagctgcgaccgcatcgaccggccggcccgccggcaggcccgatatcgtggcgccgatgatgcccggggcaagcccggccaccgccgcggccacgccctcgaagcccagcagatgctgggcggcgcggcgctgggcaagatggcgggcgccatcgatgtcgagcagggtttccccgaaggcctggcgggtacgtttgaacgggtattcgacggtgaagaccgggtcggtcagcacccgcatgacatcggcatggcgcacgacgcaaagctggcccagccggtccgaccaccagaccggccgatcgcggcgggcgctggcataggccggccagggatcggtgcggaaagccgcgctgccgaaatcgatcggctcggcctggccaccgtttccggccttgttgccctgtccgatcactgtcatcggtgcccccgcacggatccttcaccccgacccatgattaacgatagcatgatctgccgcatcgcaatacgaaaggcctctgcggcatcatatggggagccgggtttcccggaccagtggacgtgacgtcgcggagcgggcgctgcctccgggacttgccgttgtcacgtcgtcgcggcctaatcggggttcgggatgtcagggtggtggcgtttctttccatccgcggcctgcaatagaaaaggggtcctgcctatgaagctgatcgacgaattccgcatcttcgcggtcaaaggcaatgccttcgacctggcggtgggcgtcatcatcggtgccgccttcggcgccatcgtcacctcgctggtcaatgacgtgatcatgccgccgatcggctatgtcaccggcggtatcgatttcaccgacatcttcatcaatctgtccggcggcgactatccaagcctggcagccgccaaggaggcgggcgccgctacgatcaatgtcggcgtcttcctgaaccgggtgatcagcttcctgatcgtcgcctgggtcctgttcctgctggtccggcagatgaaccgtctgaagcggaaggaggaagcggcccccaccgccccggcggccccggcgccggaactggtggtcctgcaggagatccgcgatctgctggcggcagagcgcggtcagccgaaaccctgagcgggccggtcccggcgccgggtcagcccggcgccttgagcacgccgaccagaggcggggtggcggtgacggcgccgatcgcctcgcctgcgaccagatcggcgccggccgcggccgccatgtcgagccgctcgtcgtcgtcgacgccgagcgtgtagaggcgcagacccgcgcgctgcacgctcagccccagggctttcagcgcctgcggggacatgcgcacctccggtgtgaggctgccggtcaccagactggcagcctgccgggcggccgcatcggcgtggcggccaagatggatgccggtgcggcggatgccggcggcggtcgccgcctcgaagcgccggtgatccagtttgatgcgcatcagcaccatgcggcaatgcgggcggatcggcgcgaccatcgcttccagcatcgacggtgccacatccggcggacagccgacgatctcgggcgcgatccgcgcgccgctctgatcggcggcggcggccagcctgcccgcatagaccatccgtcgcgccgtgggggccagggtctcgaaatgcaccgacagggtcacgaacgttccccgcccctggcgctgcgcctccgtgaggtcggcggtcgcccgctgcaggcaatagagatcgagctgggcgatatccacagcatcggcctgcggtcccagaacggcatatccccgcaggacggcattgctgcgcttcagctttgggcggagcatcccggccgcgacccggccgtgaaccagagagaccacgggccgataatcgcaatccagctgggcctgcacgctctcgtcaagctttggtccatcctctgcgggcatctcggtgggtgggggcgttggctgatcgagctcacgcatgggctgccagagcggcccgagcgccgctcgtgccgtttcggcagctatggcgcgcaggtctggcaggggagcatggatcggtgccagtggcggcgatgatggcgggaccggaatccggctcgacggcggatctgccggagaccgtgcccgatcgggcgcggacagtgaggccacgagatcgtcaatctgcacgccggtaaattttggctcctcccccttcagcccgtctgcgaccgatatggcgggccaggggcctgcatcgtctccgccgaaggcaaaccgggtgatctcggcggcggctccggcggcggcggccagcaccatgtcgggcgtccggtcgggcgccacggcgatcagtgccagcgggccatggggcaggatcaccgccgtctggcccagccgcctgcccaggatcgcagatgccgcggtgcgcaccctggcggccgccgccggccaccggtcgcccagccggtcggcgatcggctccagcgacagccggaccacccggccggccatcgccgccgggcgggccttgagcaggcggctgacctctgcttccacctgacggcggacctgttccagccgtttgaggttctgccggtcgtcgtcggcttctgcgacggccgcgctcgatcgggccggcgcggcggtatcgctggtcagaagatctcgaacccagtgcagcagatccatgatgcctcgcaggacgcgggagagtccgacggcaaggtcagaatgccaggggaagagcggaaggccagggggagagcggaagggtagatgtcggatgggggcgaccggaccatgttaaaccttttcgtcatccggaagacatggttgtgcagcttttcagcgcaaggtggtcgatttctacaataaagttaccacatgatatgttgcatgaagtgcacaactgtggcagttctgtcggaagctggcgtccgagctgatgacaggcgccccgtcaacccccatagtaaaggggacggaagatgcatgtccggcatctgtcccaacggcggtgctggctgaatcaactgcgctgacgcggactgatccatacggtggacacttgccgtatgacgtttcggccgctatgacggttgcagacccccctgaaccggtggtgccacttttgcgggtggcgcggttgggggtggaacgtggccgacggcggtgaatggccggcggaaaccggactgcatcggttccaccaagacgaagatccgtctacaggagatcgacgagcgatgacccgcaagctgacggtggccgcgatggccgtcgcattctgcgccctccctgccttcgcatatgcgcaggatgtcgccagtgagatcgcgctccggcgcggtggggagccgggctggtacggctcgctgctcggcggcgccaatatggaaaccgacacgagcttcacctcgggccttgccggtggcaagatcgagcaggagtacaagaccggcttcggcgtgcttggcgccgtcggttacgatttcggtcgcgtcgcccagtggggcggcttccgcaccgaactcgaaatcggctatcgccagaacaacatcgacaaccacaccgtcggtggcgtggaccagccggagagcaacggcaagtccaaagtctggtcgggcatgctgaacgtctatcacgacttctacctgccggcttcgcgcctgaccccgtatctgggtctgggcgtcggtgcggcctatgtcgaggcagatggctattcggccgacggctcgcccaccctgctggacgatgacgacaccgtcttcgcctatcaggcgatgctgggtgcgtcctatgccctcagcccgtcgatgtcgctgatcggcgaataccgctacttcggcacccagggcgtggagctgaccacgaccgccgccgacggcgcgcgcaccagcagcgacagctatggctcgcacaacgtgatggtcggtctgcgcgtcaacttctgatccgcgccctctgtcgcgacggcttgtccggtcccggccggccagacctgcttcggaaccgcccgtgtctcttgcacgggcggtttcgtcgtttgaagggccggctgcggcaccatgacatatctctgccactggtgagccggcaggcggggtgccatatatgcagcgatggcggagggggtgcggcccgcacccggcgcgaccccgcccggtccggccccggcccgttatgccggggcgacaggtacagcggatgaccgatcccatgatgccgcagacccgccgccggcaccttgtccggccgcttatcgtgatcgccggccttagtctggcgctggccgcctgcgccgggcccacgccctaccagccgctgcttcacgggcagggctatgccaatcagcggctggaagccaaccgcttccgggtcagctttgccggcaattcggccacgccgcgttcggtggtcgaggactatctgctttatcgcgccgccgagatcacgaccaccaccggcaacgactatttcctggtcgtgaaccgcgatgtggaaccgcgcaatcgctatacctatgacgcgcccccggtctggggctatgggtatggctggggcgggcgtggcagcggctacggcgtgggcctgtcgaccggcacggccgagcccgatacccgctataccgcctggcttgagatcctggtcttctcgggcccccggcccgccgatcccaatgcctatgacgcgcgcgaggtgatgggtgccatcgggccggaattgcggcgcccggcccggagttgaggccggcagggcagaccggttgtgcgctgcggcaggatcattccgcgaatgatttgcaatcgcttaaatctcggtgtagcgtcgcacgcgatgtcctgacgaccggaggatctccgtgcgatgaccggcgaacccatcacccctgataccgctgcacccggcactgcgccggcggccatgacggccgcgcctgcgcccgtggccggatccgaacccggaagcggtgcgccgggggcgatgcacagcgctgctcctggatccgcgacgaccgatgcggtgcctgatgccgcaccggcggcggccccggtttctgcgccggccaccgatgccggcacgggagccccggctgcgccgccaccggtcgcgccggttcaggtggtcccggtgcaggtcactcagacacaggcagcccaggctcccgcgtctcaggctcccgcgtctcaggcttccacccctcagacttccacccctcaggcccccacctctcagactccggctgcaccgggccctggcgcgcctgccggtgctgcaatgccggccgctgatgccgccgggaccaatggtacaaccacggcggatggtgcggcgtcgggtgcgattgacggcacggtcgccgccgacgcgatcaccgcgctgccgggcatgacccagcccggcgataccgtcgccaccaccgaagccgatggcggcaccgggtcgtcgacgctggatctgctgatcgccggcggcccgatcgtgggcgtgctgggggtgctgtcggtgatcgcgaccgcgatcatcctgctcaagatctggcattttttgagcgccggcctcggcaatggccgcaagctggcccgggcggtcgaccgcgcggtgcgcgaggggcccgaggccgggcgcgcggcgctggacggggtgacccatcccggcaccgacgtgatccgcactgtgctcgacggccgcctgcatggcgtgcccgagccggccctgcgtgaagaggccgagcggatcggcctggagcgggtggaaagcctgcgcagccatctgcgcgcacttgaactgatgggcggcatcgcgccgctgctgggcctgctcggcaccgtgcttggcatgatcaccgtgttccagacgctggagaccgccggttcggcggtcgacccctcgcagctgtcgggtggcatctgggaggcgctgctgaccacggcggtcggcctgatcgtcgccatcccctgtgtcgtcgcccatgcctggctggaccggcgggtggagcgtgcggcccatgtgatcgaggattccgccacgcggctgttcgtctcgcgcgacatgatccgccaggcgggcgacgtccggcggcctgctgccatccatggcggcggcatggcccccgatctccggaccgcccgcgcggccggcccttccgcctgatcggccggcacgggaagcacatctcatgcgcctgacccgcagccgccgtcgtcatggcctggccatcggcctgacgccgctgatcgacgtggtcttcattctgctgctgttcttcatgctcgcttcgtcgctggccgactggcgggtgctggaggtggtgatgcccgaggcccggcctcaggcgaccccgccgccgccttcgtcgaccgtccgcaatcttgtggtggtcgccgtggccgccgatggcgccttgtcgatcgacgacgaggcggtcacccctgaaagccttgcccagcgcctgaccgcccgtgccgcggccgatcccacccttcgggtgcatgtgcggccggtggaggctgcccccatgcaggcggtcgtctcggcgcttgaagcggccggacagtcgggtgcggcctcggtggaggtgcggccgcgatgagactgcgccggcaacgcgctccctataacagcgacgacgcgctgatcccgctgatcaacgtcgtgtttctgctgctggttttcttcatggtcgccggcaccatcaccgcgggtgatgccttccgggtcgagccggcgcggatcgcggccgaggcgcgcaaggaagccgccgaggggcggcgtgtgctgctggtcggcgccgatggccgctatgccttcgatggtgagaccttcgaccgcgaggcgctggccgaacatctggcgcgtgcggtgcaggctgccgccgatcgtggccaggctttgcagccgctggcggtgaagaccgatgccgcggcaccggcaggggcggcgatcgccgcaaccgaagcggcaaggctggcgggattcccgggcgtggtgctgctggtgcagcgggtgccgaaatgacgcagcgcaaacggcagtcggcagaggcgcccggcggacgggcggtcaccgccgcggtgatggcggcgctcgccctgcatggcgcgggcgcgatctggctgctgaaccagccggtggagccggttggcatccccggtgaggtcgcgatcgtgatcggcttcggcggtgccggtggcgatggcggccagggcggcgagggcggtggcgtggccacacccgatgcccccgatgccgcgcccatggacgagccggctgctgctgctgcgcctgaagccgtggtcgaagagccgccactggaggaaccggagtccgagcctgaggtcgtgcaggcgccggaacccgaaccggagccagagatgccgccggtcgaagagatgccggtcaccccgccactcgagccggaaccggttccggagcccgagcctgagcctgttcaggaaccggagtccgaacccgaaccagagcccgagccggagcccgaacccgagccggagcccgaacccgagccggagcccgaacccgaaccgaagccaaccccgcaagaggtgcggcagatggcggcggtgatgccgcgcgccaagccgaccccgccgccggcgccggtgaagcccgcgcgtccggcaccacggccggcgccccagccgaccgaggcaccgaagccggcggcaggggccgaggccgaggcaccgaagacgggccctgcgggcacgcaggcggccggcatacccggtcgcctggcaggtgcggccggtgtcgccggggcagcgggtctgcctggcggcgggcagggcgggtccagtggcattgccgatccgaaagaggtcgacctctacaacgcccggatcatggcctggctggaacggcaccggcgctatccgcgatcggcccagttgcgcaaccagcagggcacggtgcagctggaattcacgattgatggcacgggtcaggtggtgtcgtggcggatcgtgcagcgctctggcatctcatcgctggaccgggagaccgagcggatgatcgaggcggcctcccccgtgccggcaccaccgcccgagatgctggatggcggcaccaagaccttcgtgatcccgatcgtcttccggctgcgctgaccgcccgtcacatccgatcagacatgcgaaacccccggcagcacgggctctgccgggggtttcctgcctccggccccggccgccggggagagccggcgacggcggggacgggatccgggatggtggtcagatgtcaggcatgctggccggtcttggccgccaggagctgggccttggccgccttgcgggccgcacgggtcttgcgcgcgggcagggcggcaatcagcgccatcaccagactggagccgtaattcgcggcctgcagcagcatcagcgccacccagaaccggctttcgacgaagggtgcgtagacgatcgagatgccgatcgccacgcccaccagggccaccgccaggatggtttcggcgcgggccatctggaaggcctgcatcaccgccggctgattctccgccttgggcgtgcggaagaagggcaggtgtttggtgatcagaccgtagagcacggccgtgccgatggtgaagctgaggctgagaccggcaaggcaggcgcccagccgctggccgatggtgcagttcacgcggccctgatagaggccgatgatgtgcatggtgcggatcgcgaagccggcgagtgccggaaccacgaacagcgaggagggcagttccacgatcgccgggaaagcgatggccagcgcaccccacagaaccgacagcacggcgatgatcagacccagggcatcagccgcccagccggcccagccggccaggaagtgatacttctgcatcggcttcagcgccgagcgcttgcggcccaggatatagcccagatggccgcgcatgatctgcatgccgccataggcccagcggaagcgctgcttcttgtaggccatgaagctgtcgggcgtgacaccccagccgaagcggtggttcgaatagaccgagctccagccgttctccatcaggcgcaggccaagctcggtgtcttcgcagatgcaccactccgaccagccgccgacactctccagcgccttgcggcggatcatggtcatggtgccgtgctggacgatcgcatcgtgatcgttgcgctgaaccatgccgatgtcgaagaagccggcatattcccagttggtcgcggtcttgaagggatgctcctgccagtcgcgatgatcctgcggcgactggacgaagcccaccttttcgtcggcgaaatgcggcgtcatcttccgcagccagtcgggcgagaccacgtagtccgcgtcgatgaccgcgatcacctcggaatcctcggccgtgtggcgcagcgcatagttcagagcgccggccttgaagccttcgagcggggcgacgtggaagaagcggaagcgggggccgagttcggcgcagatccgctccagcggccgccacacggcctcgtccttggtgttgttgtcgatgaccaggacctcgaagtccgggtagtcgagccgcgagagtgcgaccagggtctcgcgcatcatctcgggcggctcgttataggccggcacgtggatcgagaccttgggcaggcggtagccttcgggagcggcttccaccggttcgctcggccggcgacggccgcgggcgaacagaacctcgacgaattccagcgtctgggagagcagcaggatgaccagcatgcccatcagcaccgcgagcacgccgcccgcaactgcacccgagacgtccatgtactggacggcgaagcgatagccgacccaggcgaccagggccgccgcagcctgcaccagcaccacgaaggagagccggccggtccacgacatgtcacgacgacgcgccaggaaggtgaggttcagcggcagggcgataagggccgcggccagcgcgatggcgggccaggccggcagcggatcgaccggaccggtcaggtcgaatttcggctgacggtcggcattccaatagccccaataggcaccgacgccaccctcgtcataccgcttccacggctggtcgaaggcttccatcaggtagaagttgatgccttccttcttagcgcgcgcgaccagctggcggatgaacttggcttcttcggcaatcgagggcacggccttgttgaaagcgcggccatccgacggccagccggcctcggcaaccaggatcggcttgcccggatacatccgcttcaggcggttgtacatggccaccgtgtggtcgatcgactgctcgaccgtcagaccttcccaatagggcaggatatggacggcgaggaaatcggcggcacggccgagttcgggatgttcaagccacacatgccagggctccgcggtcgacaccggctggcggacctgactcttcacctggcggatgcgggcgatgatctgttcgggcgtctggtcggcgcgcaggatcgcctcgttacccaccagcacgcgggtgacgttggggttccggcgggcgccctggaccagggcctcgatctcgcgatcgttcttggcctcgtccttgtccagccacgagcccatggtgaccttcaggccgcgctcgcgcgccagggccggtacggccccctggatgccgagggccgaataggtccggatctcgcggaaccgggtggcgaccagcgccagatcttcccggacctgatcgacggtcggctcctcgccggccttcggatcattctccgggcgaaagggtgaataggcggcgccgagcaggggctcggtcacagcgggcaattcccgctcgtgctgattggggagggcccagaaggccacgttgccaagcgcgatgacggccgtgacggcaatggcgccgatccagccgcgcgtcttgccgcgcgtcttcttggtcggttcagcaggcatgtcgttcggcacgatcttgcgtcccaagtgatgccacggaaaaacggcgcgccccggaatggagtgcgccacgagccaaccatttgtcttttgagtgcacttgaaggctgcgcccgctgatctctttcgatcaccggactgaacgacatgcgtcttttcagacggcttgtgtcgttccttccacttccagctttacctcaaacgaaaccgggcttcgccacgcccgacctgtcctcgtttcttttttagttccgacgcagccccgcgtcggttacgagttatatatgctccgccccgggccacacaacagcggaacgtgcatagccatgtgtcaagatatgtcccgcgaacatccctccgccctgtttctgcccctcgctggtcttgggatcgccgcaaccatccttctggccctgtggttgagggtggaagtggtccagcccgaggcattgacgtgggcctgcgccgccgaggcgcgcccgctctggtgcggcccccggcagctgctgctggaagccttcaacatgggcgtgatcggcggcgccgcccttgtggtttcgatcgcagccctgatcatcgcccatccgctggggcagaaactggcgctggcggggctggtgctctcgatcttcgccttcgcgctctacaatgccggcgcggccgccccggccgcggtcttcgccctgttgcggctgttccgcagccggggataaccccttatgccagcaggaagtccgccgcggtcagcccgcccggctgcacgccgtcaaggatgatgctgccggcggcagtgacgaggacggcatcaccgccgaggcgcatgaaggccgcgcgggcggccccggccgaggcgaagagatcggcgtcgagcacgatcagatcgtgatcgtcggcatgggcgttgaaatcggtgatccggttcacgcccgcgatgccggccgaaaagtcgaaacggtcactgcccgtgccgcccgacagccggtcattgccggtgcctgcgatcagcaggtcgtcgcccgcggcaccgaacagggcgtcatcgcccgcgccaccgtcgagccggtcgccgccggccccgccatggagcagatcccggccgccgagccccgccaggacatcgtcgccggccaggccaaagatccggtcggtgccggccgtgcctgccagggtgtcggcggcgccgctgccctcgctatggccggcccaggcgatatccgccccgaaccacgaccggttgtcgagcccgtccgcgcccaggtcgaaggactggaaccagccgtcgaaatccacccgctcgaccgagcgcagctctttgagcccgagcgtcccggtttcgtcatagaggaagacggtgccgtcgccgaggcgcagcgcggtgatgtccgatgcgtcgcccgcgatctccacccggtcggtcccggccccgcccgcgaccgtgtcgttgccggtggacagtgccaccagatcatcgccgccgaagccgtcgaggaagtcgccaccccggccgtcccgcaggcgatcggcctgatcggtgcccaggatgaaggcgggcgcgccgtggtgatccgaggtggcgcgcggcgcatcctccacccagacggtgccgcggagcaggtcgctcaattgcgagatcaccaccacgctgtcggtcgtgatctgatcatagaagctcgaccggccgatcacgctcaccgccggttccgacaggatgccggtgacatgggcgttccagccgcccgcgatgttcaggatgccgaaggggccgtagggcgacagcgggttggcgtaaaaatcgttgaacagcacgatgttgtcggccgaacttgcgaagctctgatcctcgttgatcagcgcttcgagcaggccttcgccgaccgagccgtcggaggtgccgatgatgcggtagaccacgtcgttctcggcgccgaaattgagcaccacatccgggtcgtcatagatcgtcggcgaggagaagccgaaataatcggcatcggcatagaagccatcggccagttccccgcggcgttcggccagattgttcacggccgcgccacccaggctgtagccggtaaccagcacgtcggcgcccgtcaggccgatatcggctgcgaaaccggccgtggcctccagaagataggcgaattcatcgacataggcggcatcgaccagatccagatagtcgaccacatcccccgcatcgctggtgccggcgaaggcgaccgccagccgggtgatgctgccgtcagccgccgtctcggccaggatgcaagcctgcgggctgctggaggtctgaccgatgaaattgccgtaagcatcgacccgatcggcggaaagcccgagttcggcggcggtgaccgcacgccagccggcgggcagatctggatcaccgccgccggcttcggccaccacgccgatgacgccggcgagggcattgaaggcggcgaactgggcattgcgggcaagaccgaaggcggtctcgatatcggcgcgggcgtcctcgcccttataggtgaagatcggcatttcccctcctcagccgtgaccagggggtccggcgtctttttatcaaccaaaggttatgttaggggcggggtctcggcgcggtcaatgacgtttacgtaaacgttaatcacccggcccacggccttccgggctaggcagtgccggggtggcagggtatgaagggccgggtggcggcgctttcaagaaggatctgatgcgatgcgctttcccgacggcagcccctcgcagccggggcgcccgcagcggggcggttcgaagacggagcggccagcggcaccgcggccgcagcccgatctgctgatcgcggatctgggcggtaccaatctgcgcatcgcccggcgcgacggccgcggccggactgtcctgctcggccgcttcgccagccacgagatcgaggatctgcccgatctgctgcgccgggtctggctgaaggcggccggccgggtgccggcggcgctggccatcgccgtggcgggcccgatcgatcatggggccgggcaggcgcggttgaccaatcatccggcgctggcgatctcctccgccgccattgcacgggcgctgggcctgcgcggcattgcgatggtcaatgatctggcggcccaggcgatggggctggcactgggggcgggcggcacgcgcgagatggtggcgccgggcacgcccgatgacgaggcaccccggctgctgatcgggcttggcaccggcttcggcaccgcgctgatcctgcccgggcgtggcgggctgccgcaggtggtgccggccgaaggcgggcatgtgacgctggcggcggaaactgccgccgaatgggcggtgatcgaggcggcgcggccgctgcccggcacggccggggtgaatgatcacgtctcggccgaagatctcgtttccggccacggcctgccgcggctggcggcggcggttgccgcggtgcgcgggctggcccctgtccagggtgaagctgaggcggtgacagaggcggcccttgccggcgatgccggggcacgggaggcgttcgaactgttctccggctgggcgggggcggtggccggcgatctggcgatcgcgaccggcgcgcgcggcggcgtggtgctttcgggcgatctgctgcatcggctgggcgggctgttcgaccggcggcgggcggcggcgcggttcagggccaagggcaggttttcggcctatctcgcgaatgtgccgctggaactggcgccggccggggacgatctggcctttgcggggctgaccggcatcgccgatgcggtggcggcgcgggaggcggggccggtcttcgactgaccgggccgtctgaccgaggggaccagaagcggaagggggacgccatgaccggcgaccagacaagtccgacgccggcggcgcgcggttttcgcatgcccggcgaattcgcaccgcaggatggctgctggatgatctggccggagcggccggacaactggcggctgggcgccaagccggcccaggcggcctttaccgcggtcgcaacggcgattgccgacgtcgtgccggtgacggtggcggtctcggcccggcagtggtcgaatgcccgatcccggctgccgcaccaggcgcggctggtggagatgagcaccaacgacgcctggatgcgcgatgtcggccccagtttcgtgaccgacggcgccggcggccggctcggcatcgactggcggttcaacgcctggggcggctttcatgacgggctgtacttcccctgggaccaggacgatctggtggcggccaaggtgtcggagatcgatgccgatggcagctggcgggcacccgtggtgctggagggcggcgccatccacagcgatggcgagggcaccgtcttcaccaccgccgaatgcctgctctcccccggccgcaacggccccgacgggcgggcggcggtcgaggcggcgctggggcaggcgctgggcgccgagcaggtgatctggctgccgcgtggggtgttcctggacgaaaccaccggccacgtcgacaacctgatccatgtggtggcgccgggcgtggtgtgcctgacctggaccgatgatcgcggcgatccgcaatgggaacgctcggccgaggctgaggcgctgctggccgaagcacgcgacgcacgcggccggcggctgaccgtgcaccgggtgcatcagccgggcccccttgccctgaccgcagaagaagcggcgggggtggatgtcgtgcccggcagccagccgcgccgcgccggcgaccgcctggccgggtcttacgtcaattttctgatggcccacggggcggcatcgggccggcggcggatcgtgatgccgctgctggatcccgcacgcgatcaggcggcggccgatgcaatcgccaccgcctgtccgggatgggagatcctgggcgtgcccgggcgcgaaatcctgctgggcggcggcaatattcattgcattacccagcaggtgccggcgcgccgggggcgccagtcgtaaccgatcagaagcggccgcgacggtagtcgtcgatcgcctggatgatctctgcttcggtgttcatgacgaaggggccgtagcgggcgaccggctcgccgatcggccggccggcgaccaggatcgcccgggcgggctggtccgaggcattggcgaggccgagcccgccatccccgcccagaaccgccaggcgtgcggtgccgagcggccgcgccgcctctcccgtgccggcgatcagcgcgccgtcatagacatagaggaaggcggtgtggccggcagggaccggcagttccacctcaccgcccggcaccagctcgatatcgacatagagcgggtcgctggcgacgccggccaccgggccggtggtgccgaacacctcgcccgcgatcaccttgaccgtgccggcatcgccgggcagggcggcggcggggatgctctcgggcccgaattcgcgataggcggggcgcgccatcttttcggccgcgggcaggttcacccacagctgaaagccgcgcatcagcccttcggtctgctcgggcatctcttcatggatgatgccgcggccggcggacatccactgcacgccgcccggcaccagcacgcccttgtgcccggcattgtcggcatggcgcatgcggccggcgagcatataggtcacagtctcgaagccgcgatgcggatgggcgggaaaaccgccgatataggcgccgggatcgtcggagccgaattcatccagcatcaggaacgggtcgagcatgtcgagcgacggctgaccgatcacccgcttgagcttgaccccgtcaccatcggagacggcacggccgaccaccacctgcgtgacgtggcgaccggtcgtggcatccgcgggccggggcgaggaggtgagggtggtggtggcggtcatcgggcacaccctttcgaatggctgcgggcggcgcaccggcgccgccctgttttcccgatccaagatagggtgtcggagactgtttccgaagaccgtagaattgcaacgctccgtcgcgcagatggaaacgatgcgacgggcggcttacaccgggaccaccagatcttccagccggtccggggcgctggtcagcgacaggcagccggtttcggtcaccagcacggtgtcggaatggcggaagccacccagcccctcgatatagatgccgggctcgatgctgaacacctggccggcctcgacgagccggtcatagccctcggccagaaagggcgcctcgtggccggtgacgccgaaggcatggccggtgcgatgcagcaggtggtcgccatggccggcgcagatcagcgatgcattgaccgcctcgtcgatcgcggccatcgatgcaccgggcttcaacaggtcgaaggccagcgcccgggcctctgccatcgcgtcgaaagcgggcctggcggcggccggtatctcccccaggaagaaggtccgctccagctccgccgcatagccgtcggcccggcaggcgatgacgctgacatgcgggccgccccggcccagggccatgaacaggtcggtgaagttgtgcggatcgtgcgagacctcgggcggctgggccaccgcggcgaaattgcaggcgagcaggttcagatgcggattgccggcaagggctgcgccggtcatccggcgggatagcgcgccgtggatctcgatcaccttcaaccccggctgcgccatggcgagaagggcggcatgggcgtcggagaccagatcggcggcatggcgcagccggccgatctcccagggggatttcaccatccgcagatcctcgaccagggcggccggtaccggatcatggccggcggccgccagccgcccggcgacgaagagcgggcagtcgggttcgaccgcgagcctgaggccgggggcgagcagcccggtcagccggtcatcccagccctggccggcaggggcggggaattcgcgataggcgatgcagtcgatcgcgcccaggctgcggatgcggacatgggggatttcgagcgccggcacgatgaagcgcagcgggccgtcgcctgtcaccacaaggataaacgggcgttcgtggacgaagttcgcaaaatgggtgaggtagtagacgctgtcggggttggtgaggaccagggcgtcgatgccggcaagctccatggcggtgcgcagccggtcgacgcggccggtgatctcggagagcggcggggcgccggtgatgggggcggggcgggcgtcggtgggaaggatttctgtggtcattgaggggctcaaagctccggatcgatgcggcggcggcggttgagcgcggcctggaagaacaggccgctgatcaggggcggcagcagggtgacgatcagcgccaggcgcagcgaggcgccgccatcggcggccaggccatgggcgagggccagatcgctgatcagcccgaccagggcgggcgcgccgccatagctgatgatcgaggtggcgaagaccatgaaggcgatagcggtggcgcggacatgcgggccggccacgacctgcatgcacgacatcgacgggcccatgccgaggcccgagaccaggaaggccaggaagagcaggccataggcgaggccggtatcgcccaccaggaaagtggcggcgaagagcggggccgagaccaggcccgccagtgccggcaggcgaaactcccacgaccgggcgcggcggatcagccggttggcgagccagccgccggcgaaggtgccgatcagcacgccaagcccgagggcaagcccgccgctgcggccgaagtctgcgatgccgacgccgtggacgcgctggaaaaaggccgggatccaggtggcgaggccgacagtgacgtaatagaagggaatggcgatcagcagatgtatgacggcggccgagccgagcagatctgcgagcgcaggcttcagcgccggcggtcgtgtggcgccgccccgatcgaagcggccgcgcgggggctccctgaggaccagggggatgaccagggcgagggccaggcccggcaggccgaaatagaagaagaccatccgccagccatgttccgcgaccagcgcggccgcgaccaccaggccgatcatgctgccgagcgaaccgatgccggtgaagacggagaccgcccaggcgcgacgttcgggcggaaacaggtcgccgatcagcgaatgtgccgagggcacgcagccggcctcccccacgcccaccgtcatgcgggcggcgaaaaggccgatgaagctgcgggccaggccgcaggcggcggtggcgaggctccagagggcgagcgataccgcgatcacccgcacccggttggtccggtcggcgagccggcccatggcgaggccgaacacggcatagaacagcgcaaaggcgaagccgccgagcaggcccatccgggcgtcgctgaagcccagctcggccttgatcggctccagcaggaccgagaacagaacccggtccatgtagttgaaaagattgatcaggccgagcagcgcaagcgcgagcccggccccctgtgcaatcgtcggcccaccctcggacctgtcggtcgcaactccgtctgatgccgtcattgtcgttgtgctccctgtctgccgccttgatggcgggttgagggaagtgtggcgcgcgggctggcccggcgtctttccagggatgcacggagattttgcatttcgtccctccgcatgcgctgatacgagaccggatgcaaaattcttcggaagaaggtggatggtcatcgggagaaggtggatggcggcgggtatgggcacgccctggaccgatcagcgggcggtggtggcggcgctggaggccggcacgccgctgatggaggcggcgcctttcgaggggcggagccggttcgagatcatgccgggcgacatcgtcggctggtggctggacggacggctgaccgcggatctgaccctgcgccatgtgatggacgacaccgtcagcatccagttcgtccagaccggcggcgggcgccgccggatcaccgcccatggcactgagcgccatggcggcggcacgctctatatcgggctgtttccggccggcagccgccagatccggcgctggcgggcagggcggccgatccgctatgccgccttctgggttccgcccgcccatgcggcggcggtgctgttccccgaccgcaccggccggctgccggctttcaccgatctgctgaacgggggtctggaggcgcccttcggcctgtcggtgacgatgacgcccgccatgcatgcggtgatggacgcgctgatcgacggcccgccccggcctcaggcgctggcccgggcctatgagagcctgaaactgcaggaactgatgatcgaggcggcgggcgtgatggcggccgcggcggggccacgccgcgccgccgacggcgtgcccgcccggacccgccacgagatgcagatcgaacgggcggcggacatcctgcggcgggaactggccgacccgccgggttttcgcgacctggcgcgacgggtgggcatcagccacaaccggctggcggcggggttcgtgacacgtttcggctgcacaccccacgactatggcaagcgccatcgcatgcaggcggcccggcggatgatccgcgagggccgccatggtctggtcgacgtggcggccctggtcggattctcaggccaggcggcgttcggccgggcctataccgcctttttcggccatccgccgggcgtggacaggcgagcgggcgtggacaggcgggggcgtgcgatcaggccatgacgtgatggccggccggctgcggcaccagaacgatctgcgcgcccggcagggcctgggtgagggcggcgcgcatccggtccaggatgccggcgatctgcgagaaggggcggtcgccttcgaaggtcagcgtgatctcgacctcggcaccattgccgagccggcggctgcggacccggatgatatcgtcatattcgtcgaagaactgcgccaggaccttgttgatctccatctgcatcggctccgccagcgagcgatcgagcaggtccggcatggcttccttgagcatgccgtaggtggtggcgagcatgatgaaggcgaccaccgtcgagcccacgatatcggcccaaaaggacagcatgacattgccggccagctggtccagcgccacgcagccgaccacgaccaccgagccgatggtcttggcgatgcgggcgcgatattgcgaggccacgatgatcgaggcgccgtcgcgggctgcgcggcgcagcgacaacatctgaccgatgttcagaaacaggttgaaggtcacgaagaaggtggcgagataggcggcactgccggtttccgatgctgccggcaccttggtcgcgatcttgtagatgatgaaacaggccgccacgaccagcatcatcgcgatcaggatggagaccgcctgttccagcttggcggtgccgtattcgaaattgccggtgcggcggcggttgatgttgcgcagcgtggcataggacaccaaccccacgcagatcagcagcgtgccgcgcacgccgtcggcgatcatggtgagcgagcccgaccagattgcgaccgccacgaacggcccgcaaagggcaaggtctgccagaactgcgatcgcaaccgcgcgttcgcgtgcccgctcggctggcgacatgttggacatactgacgtctcccggtgaacgggtcgttgttcttccggccgccgggagatgccgatccccaccggcaggcccctgcggtgccggcgaaccggccccggcggatggcccccctgccatccggaccgatgatgcgtcaaaaggcgcggtgggcgaaagcgcgaagtgcgacgggttgatgactgtttcccgcccggcgggtgcggttcagacgctgtcggactggctgcggcgcggcgccacggcaactgccgcggcaaaaaccaggccgatcaatgcccagagatgcgcctcaccattctcgggcccctcgccgatggcgaccgcgagcgcgccgccgccgatcatcagcgccagcagtgcctcttcgattttcagccgcaaccgcggcgtgcgcgcccggccggccacgggcatcagcgcgtccaccgcccagccgatcgccgggatcaggaaggtgacgatggggaagtcccgatagcgcgggtcgagggcgagaccgatcatggcgatggccaccgccaccgccgcaagacccttgagcaggccgagacgcagcccgcgggggccgtcacccgcgcctagccagtcgatgccgagcgggcggcgcagtgcgcgcagcacctcgatcaccggggccggctggatccgggcttcggccggcccggcccagcggcgcgccagcaccacggcggtgaccgccgagaccagccagaggccgatgccgatcgcccattccaccgggccgcgattgaccagcgacagatgatcgatcgagagcagcagcgtggcgccggccagctgggcggcggtgacggccgatacccagcccgcgatttcacggcccagatgctcgtcgatttcgtgatcggggatccgccggccggcggcgatcatcagcaggccggcaaccaggatgccgccggccgccagccagtgccagttcggcatctcgaccaccgggccggtcagcgggaatttctgctcgcgatattcgtcgaccaggccccaatggccgccgaccgtgccttcctgcacccgtttccagggctggtcgaacgcctcgatgaggttgtagtcgacgcccagattgcgggcgagggggatgaagtcgcggatgaagctcgcctgattgaccaggctcggcaccgcagggccgcgggtgcggccttcgctgggccagccggtctcgccgatcatgatcggcttgttcgggaaggcggccttgacctcgtcgatgatccggcggagatgcgccatggcatcgtcgatcgagacgggctcgtcctcccaatagggcaggatatggacggtgacgaaatcgacctcgtcggcgaggtcgcgattcttcatccagaattcccagacatcggcataggtcaccggcttgtcggtgcgcgccttcaccgcgcggatcagcttgcgcaggttctccggcgactgttcccggcgcagcagcacctcgttgccgacgatgaccgccttgatcgcctgcggattgcgcgagacgacgtccagtgcagcatcgatctccatctgattgttctgggggttggcaccgatccagatgccctggagcacgctcatgcccagctgggcggcctgcaccgacacctcttccagcccctggcgggcggaatagagccgcacgcagtcggtgaccgatttcaggatcgccatgtcctcggcaatctgctcgggcggggccacgaagctttcgttatggggcgtctggcggccccggaagggggcataggaggtgcaggcgacgtgggcgttgggaacgtcgggcagctgcacgggcgcattcgcccatgaccagaagccccaggcgatcgcggcggtgacgacaaaggcgaccagtccgatcaggcgcgacgacatcgctcggcagttctcctaaagggcggggggcaggaccgaccatgcgccccgaccgaacatcgttagccgaaaccgggtgtcttgtcagccttccgtgtgtgacgcggcatcggcgagcgcgccttccagccgcgcccattcgcccgggcggccgagcgcgtcgtcttcggccgggatgccgaagcgcagccagccggcctgggccgggatggtgacggggcccggccagtcacggatcaggatgccgtggcggctggcgagccggtccaggatcgccgccgcccgcgcccggctgccggcatcgacggtgacgaaaagatcggtctggccgaccgggacaaggcctctgcgatgaagcaggtgcgagagccggtcggccccggcggcgaggcgggcccgggtctcagtgatccaggccgtatcgtcataggcccgtgccgccaccacaagtgccgggcccgacacggcccaggggcccagatggtcggtcatgcgcagggtggttgccggatccgcgatcgcaacgcccaggcgcaagcccgcaaggccaaagaattttccgaaggagcgcagcaccaccagcccgggcccggccagatcggccaccgaggcgtcgggcgtgatctcggcgaaggcctcgtcgaccaccagccggccgccgcgatcggccatcagccgtgccagccggcgcagctcgtcgcggccggtcagccggccgtcgggattgttggggttgacgatcagcacggtgtcgataccggcagccgtcagccggtcgggatcggtctcgaccgtaaccacgtggcctgcgcgttcccaggccggcccgtgctcgttataggtaggcccgagcacggcaacccgcccccggggtacggcaaagggcagggcctggatcagcgcctgcgatcccgggccggcacagagatgatcggggccgggggcaccgcagaagcgggcggcggcatcgaggcaggggccgatcaggtcgccatcgggcagccgcgtccaggcatcggcaggaatgtctcttggatcaaagggataggggtcgcggtttatgccggtgctgagatcgatccagggcgttggcgccgtgggatggctggccgccatggctgcaagccggccgccgtgatcgcggtgcgcggcggtcatggcagcaccggttcggctgcggccgcgaacagggcctcgatgtcgagtgccgcttccagatggtcggcgagggcatcgagggcggcctcgacggacgcctcatagtcgatcggcaccggccggcggccggtcagcgcctcgatcagggcggcgcgatagccgtcggcgccgaacaggccgtggagatagcagccggcgacccggccgtcatggccggtggcgccgtcggggcggccgtcggccagacgcagcatcggccgtgccgtgccggggccggtggtgacgccgacatgcatttcatagccgcgcacggccgcgccggtggtgatttcggtgccggtggtctcgatcagcgccttgtcgccgccgagccgggtttcgacgtcgagcaggccgagacccggcacggcgccggccggcccctcgatgccgtccggatcctcgatcacccggcccagcatctgatagccgccgcagatgccgatcacccggccgccgcggcggacatgggcggcaaggtcgacatcccagccctgggcgcggaagaaagcgagatcggcgatcgtcgccttgctgccgggcagcacgatcagatcggccaccggcaggggctggccgggcggcaccatggtcagcgccacctgcggttccagcttcagcggatccagatcgtcgaaattggcgatgcgggcgaacatcggcacggcgatcttcaggcccccgggccccggatcgcgcggcgtgtccagcgccaccgcatcttcggccggcagccgcgccgcggcgggcagccagggcaccaccccgaaactcttccagccggtgcgggtctcgatttcagtcaggccgccgtcgaacaggcggacatcgccgcgaaaccggttgatgatgaagcccttgatcagcgacagctcatcttccggcagaagcgcatggctgccgaccatctgggcgatcaccccgccgcgatcgatgtcgcccaccagcaccaccggcgcccggaccagggtcgcgaagcccatattggcgatgtcgccggcgcgcagattgacctccgagaccgagcccgcgccttcgatcagcaccagatcggacccggcggcgagacgggcgaagctctccagcaccttcggcatcagccgatcgcgccagccgcgatattcggcggcgcgcgccgtgccggccatgcggccctgcaccaccacctgcgcgccgatatcggtctgcggcttcagcaagaccgggttcatgtcgaccgaaagcggcacgccggcggcacgggcctgcaacgcctgggcgcggccgatttcgccgccatcggcggtgacggccgcgttgttcgacatgttctgcggcttgaacggcagcaccttcagcccgcggcgcaccgcgatgcgggcaagccccgccaccagcagcgatttgccgacgtcggatccggtacccatcaccatcaggcagcttgccatcggcgacgtctcccaatgtcagaaggcgacccggaggccgacatagaggcttcgaccaggggtggcgtagccgtccacttcctgatagtccacgtcgaagacattgtcgagccgggcataggcggtgaccgcgtcggtcaggcgctgattgccattgatccccatgatggtatagcggcggatcttggtcggccggctggcggaattgacctgcgcgccgacatgggacgcctcgatgccgatccgggtaccgtccagcggatagacatcggcggcggcgaacagggtgtggcgcggacggcgcggcagggccgtgccggtctccagatccgtcgtctccagataggtataggccgcctgaagcgtcagccagtcggccggcaccgcctttgccgtcgcctccagcccctcggtgcgggcgcgggcggtgttgcggtagcggctggcggcggaatcgaagctcagcatgttgcggatgtcgttgcggaaccaggtgaggcccagggtcagcgcctcgtccagcagctgctgttcgatcccgatatcccagccccggctcttctccacctccagatcggcatcgccataggtcgggtgataaagctggtagagcgacggcgccttggagccggtgccccaactgccgcgcagcgtcgtgccggtgccgggcacgatccaggcaccggtgaagcgccaggtggtgtcggccccgaaggccgaatgatcatcgcggcgaagaccggcggtcagatagagctggtcccagagcccggcccggtactggccgaagatcgcggtggtatcggcatcggccgagagcgtgttgatcaccggatcgccgggggccttcgcatcaccgatcgaggcggcctcgtgctcgcgcgagaggccgatggtggccacgtcgtcatgaccgtcgacggtgatgtcggtctggttctcgatcccggtccgccggccgtcgaaatcggtgcgaaccgaaaagctggaggtcgggtccttcgagctgcggtcgagccgcgagcccgagaccgtggtgcggttttcaacccggccgtcgaacagggtagcgatggccgtcacccggccgctcaggctgtcggcctcgttctcgcccggcgcctcgggcttgcgcgacggatcgaaatcggccgaagtgcgggcggccgtgccggtggcctcgatcgcgaactggtcgctcagggtcaacccgccgctcaggccgatctgggtgccggtgaaaccgtcatcctcgcgcccgccttccaggcgcgagaacccctcggtgcggaagtcgatgatcgagacggcgccgtcccagcgctcgccggcgccgcgcagcgccgcggaatgccgacggctgcgataggcgccgtattctgccgaggcgtcgccctccaccccggtgccgccattgcgcagaccccggcgggtgacgatgttaaccacgccgcccatggcatcggcgccgtaaagcgcgctctgcgggccgcgcagcacctcgatccggtcgacatcgtcggcaagcagccgaccgagatcgaaggccccgctggcgctggccgggtcgttcacctccaccccgtcgatcaggatcttggtctggctgtcatcggtgccgcgcagcctgagattggtcgcggccccggggccgccggtgcggctgaacgacacgccgggcgcgcggcgcagcgcatcgaccacgaagacggtgccggcacggcgcagctcttcgccgtcgatcaccgttaccgaactgccgacggtggcggggtcgacggctgtgcgggtggcggtcaccaccagcggtgtcagggtctgacgggttttttcgtcatcggcgaatgccggggcggcaccggtggtggcggcaagggcggtgccgagcagaaacaggcggacggcggcggtcatgggtctggcgtggtcccgcgatggctggcgcaccgacgcgaacgggatggccggcacctgtccggatctccctgccgccggtcatgcccgcccgacgaccgcgcgatacgcggggtggtgacggcaggtctcctggctcgcgggtccaggcccggacccccggccttcccggcctgttaccgccagtggctgtcatgggggtgggctcaccgcctacagttgcgggtacagccgcggcctgggcgccctggcgccgcaccgcattccctcttcgccggcctcctttccggggaaaggcggcacggaaccgtcgccccgcaccataaagaccgggatgccctggggcaagcggcacgaaagaagggcgccatcctcgcggggggaggatggcgcccgaagtgatcaggcagggagacgttcgggaggaaacgtcagtggtccaggggaagaccgtcgtcagtcagtcagtcgtcgtccacgtcaggcccggatcagccgcctgagggggcggtggtgggggcgggagtggtgctcatcggctgggtgccggtggcggcatcagcatcgctcttcacggcttcctgcgacttgaaggccggcatctgttccagctgctcgggcgtcaccgaggcaatcaaggcctgctcggccggctcggccttcagctgatcccagggcaccatcacttccttggcgccgaaacccagcacgccgccataggcgagcaccgcatgggtgatctgaccgtcggtcccgaaaatcacgccctgaagggaggcgacttcctcaccatccggcgtccggaccacggtgtcgttcgacagcagcgtgtcagccggctgcggatcctcggcctcggccgtgtcgccgccgccagccggcggggtggcgggcatggcgcccgagggggctgccgcgctgccggcacctgcacccatgccgctgccggccggggcctgctgttcagtgggtgccgcacccggcgaggcggcctgagccagtgcgctgccggccgcgagggggacggcaccgagaccgacgatgatcgcaagagccgaggtcgtgccgcgcatggacttgaacatggtcaattactcctgtgttcggcaatccggcaagttctcttgccttctccaatgatctgggaacttggatgaaaattgttaagtgctgcgctgtggcataatcatgtgaggtttggtcttcaaatactggtagaagatgatgaagcagccgccggctgtgagcgggcgatgtcagacggcccgaatggggcctgcccgtgtccgggcggtgtcgctgccgtgcttgacgccggccacgacccgtcgcaggctgccgccgcagaggggacaatggctgtccgcaacccccgcggggccgaatttcggtgcaggagatctgccgatgcgtatggatgttctggggctggccggcgccgcggtgatcgccgtgggcattgccgccggtggctggctggtcggccagggtgttgtcgaggcccgtctcggcaaccgcaccgtccaggtcaagggcctggcggagcgcgaggtgaaggccgatctggcggtctggtcgctgcgctatgtcgcctcgggcaacgagctgaacgaagtgctgggccagttgaagcgcgataccgagacggtcagacgcttcttcgtcgatgccggcctgccggctgagacgatcgagatgctgagcctggaggtgacggaccagaacgcgcagctctatcgctcggggccggtcgaggtgcgttatatcgtggcgcagacggtgtcggtgcggaccaccgatgtcgacaaggtcgaggccgcctcgcagaaggtgggcgatctggtcgaggccggggtggtgctgtccaacgacatgggcgcctggggcagcggcccgtcttatatcttcacgaagctcaatgatctgaagccgcagatgatcgccgaggcgaccgccaatgcccgcgacggtgccgcgcagttcgcgaccgacagcggcagccatgtcggcgcgatccgcaatgcctctcaggggctgttccagatcctgcctgccaccgacatcccgaacatgcccgagaaccgccaggtgacgaagacggtgcgggtggtgacgaccatcgacttcttcctggaagactgaccccgtcttgacgtcggacgcccccctgcctgatcccgcattgcccgaccggatcgcccgtgcaatccggtccctgcccgtggcggagcttgcccgcccgatccgcgacgccctcgcgcgcgggcgcgatctggtgatcgaggcgccgcccggcgccggcaagaccaccgccgtgccgctgatgctgctggatgccccctgggcggctggcgggcgcatcctgatgctggagccgcgccggctggcggcgcgtgcctcggcggcacgcatggcggcgatgctgggcgaggcggtgggggagacggtgggctaccgggtccggctggaccagaaggtcgggcccgccacccggatcgaggtcgtgaccgagggcatctttacccgccggattcagggcgatcccgagcttcagggcgtcgcggcggtgatcttcgacgaaattcacgaacgcagcctggatggcgatctgggcctggcgctggcgctggaggcgaaacaggcgctgcgcccggatctgcgcctgatcgccatgtcggcgacgctggatgccgagcgggtggcggcgctgatcggcggggccgagcggctgcaggccgaaggccggatgttcccggtgacggtgatccacgacgatcgccggccggagccgcgcgacctggccccggccatggcggcggccgtgcggcggatgctggcggcggagccgggcgacatcctggcctttctgccgggtgccggagagattgcacgcaccgccgagctgctggccggtgccggcggggctgcggtcgacatcctgccgctggcgggggagctgacggcagaggcgcaggaccgtgccatccgcccctcggtgcccggccggcgtaaggtggtgctggcgaccgccatcgccgagaccagcctgacgatcgagggcgtgcgcgtggtgatcgatggcggcttcgcccgccggccgcgtttcgacccgtcgaccggcatgagccggctggagacgatgcgggtgtcgcgcgccgaggccgagcagcgccgcggccgtgccggtcgtattgccgaagggatttgcctgaggctgtggcccgaggcggagacccgcgccctggcgggttttgccgccccgcagatcaccgtcgacgacccggcgccgctggcgctggaactggcggtctggggcgtggacgatacccgcgccctggccttcgccgaccatccctcggcggctgcctggggccaggcccgggagctgctcggtcgcctgggtgccctggacgaggccgggcgcgtgaccggccatggtcgggcgatggccgagctgggcctgcatccgcggcttgcccatctggcgatcgagggtgcccggcggggggctgggcgcgaggcggcgcgcctggcccagatcctggcggaacgcgatccgttcaagcgcgcccgcgccgatgccgatcttgcccggcgcatgactctggtggcggatggccgcgacccgatgggcggtgccgatggggcggtggtcgaccgcggcacgctcgcccggctgcgtgacggcgcccgggcactggagcgccggctgcccaagccgcagcgggcagcgggggtggaaccgccctcgctcggccagttggtggcgctggcctatcctgaacggctggcgcaggcgcgcgggcgtgacgctgtcttccggctgatgggtggcggcggggttgcgcttgatccgctcgacccgctggccgcagaggactggcttgcggtcgcaacgactggtggcggcacacagggtgggggcgacgttcgtgcctttctcgccgcccggatcaccccggctgagatcgtggagagcttcgccggcgagatccgcacggtggaccgggtggaattcgaccagcgatccggcggcctggtggcggtgcgcgaacggcggctgggtcagctggtcatcgatgcgaaaccgctggcgaagctcgcgcccgagcatcatgccgcggcggtggccgaaggggtgcgcgggctgggcctcgaccggctggactggagcgaggcggcgaaggcgctgagggcccgtatcgccttcctggcgcggatcgacgggcccggggccggctggccggatgtgtcggatgacgggctgctcgccaggctcgacgactggctggggccggatctggggcgggtgcggcggctggacgatcttacccggatcgacctcaagggcgcgctgctcaggctgctggactggcgccagcgcagccggctggatcaggcggcgcccgagcgggtgaccgtgccgtcgggccgcagccatgcggtggactatgcgagcgacccgccggtgctggcggtgaagctgcaggagatgttcggtgcggccgaaggcccgagggtcgccgacggccgggtggcgctgctggtccacctgctgtcgccggcgggccggccggtccaggtgaccgccgacctcgccggcttctggaccggcagctatgcccaggtcaggtcggagctgcgcggccgctatcccaaacatccctggcccgaggatccgaccggtgcggtcgcgacccatcgggccaagccgcgcggcagctgagccgcgcgcgacctgtgacggatcagcccttggccggccggggcaccaccggcgcgcccgcggccttccagccgctgaagccgccttccagatgggcgacgggttcaagccccatctgctgcagggtgtcggcggccagcgctgaacgccaggcgccgccgcaatagagcacgaagctcttgcccgaggcgaagaccggcttgtgataggggctttccgggtcgacccagaattccagcatgccgcgcggggcgtggaaggcgccggggatcatgccctcgcgctccagctcgcggacgtcgcggatgtcgacgaacagggtgtccgggtcgtcgagcagggtctgggcctcgtcgatcgggatggtgcggatgcgggcggtcgcctctgccaccatctgcttcacggtcttcttcagcgccatcgggggatctcctggtgtttccgtgcccgcagcatagcccgtccatgcccggccgggcttcgataaaccgacgggcggtgctaaggtccggggatcctgcatccggatgccgccgatgaaacccctgccgcccttccgatcgatcgaggcctttgccgccgccgtggagctgcggagcctgaccgcggccgccgaggcgctggggctgtcgctgcctgcactcagccggcggatccggatcctggaagagcatctgggtgcgccgctgctggagcggctgccgcgcggcgtggtgccgaccgcccggggggccgcctatgccgccgagctgttgccggcgctcgacgccctgcgccaggcgaccgagcgggcgcgtcaggtcgatcgccgggcggtcaggatcagcctgatcccgacccttgcgatgacctggctgctgccgcggctgccgggctttcaggtggcccatccgggcatccggcttgatctgcacggctcggccgactgcatcgaacccggcgccggtgtcgccgatctggcgcttcgcctgggggagggcggctggccgggggtgatgcgggtggcgtcgatgccgctgcatctggtggtggtggcgagccccgatctgcctttggaccagccgcaggatctgctgcatctgccgctgctgggccccgcccaccggccggaattctggcccgaatgggcgcgggcggtcggcatcgaccccaccctgttgccgccggtgcggggcttcgacagcctgcagatgctgtatgaagcggcagcccacgggctgggtgtggccattgctctggatcagctggtgcggccctggatcgagagcgggcggctggtggcgccgctggatcaccgggtggcgagttcgcgcggcatccatctgttgaccggcagccggccggcaccgccggtgcgggtggtgcgcgactggttgcgggcggaaatgacgcgcagcgccgcctgagcggccatgcgccttcagctttccggaaggcccgcggccgcaaagcgaattgtgacgaggcagcggtgggcacaggatcggcaggccgtgaccacctgcccgggagcccccgccatggacgccaccgatctctgttttctggacgcgaccgcgctggccgcgatgatccatgcccgcgaggtctcgccggtcgaggtggtcgcggcccatctggagcggatcgcgcggatcgatccgctgctgggggccgcggtcgaggtcatggccgacagcgcgctcggcgcggcccacgctgccgaggcggcggtgatcgcgggggaggcggcaggtcccctccacggcgtgccgttctcgatcaaggattgcatcgacaccgcaggcgtgccgacccggcgcggctccaggctgtttgccgaccgggtgcccgggcgcgatgcgaccgtggtggcacggctgaaagctgcgggtgccattccgttgatcaagaccaatctgccagaattctcgtactggaccgagaccgacaacccgctgtcggggccgacccgcaacccctgggacagaagccgcacccccggcgggtcgagcggcggcgaggcggcggcgatcgcggccgggctgtcgccgctggggctgggcagcgatgtggcgatctcggtacgcgggcccgcggcgatgaccggcatcctggcgctgaaggcgacccatggccggatccccgtcaccggccactggccggggcttcggcgctggtggcatgtcggaccgatggcgcgcagtgtccgcgatctcgcgctggcgctcgatctgctggcggggccggatggtgccgacggctatgcggtacaggcggtacccctgatgcgcggcgacgccagcagcctgcggatcggctggatggcggcagaggggttcgggccggtggatcccgaaatcgtcgccacggtcgccctggccgccgacgccctggccgcggccggacaccgggtggcgccggccggcattccggcgctggcggatcacgactggacggaggcgagtgcggtgctgcacgcgcccgagatcggcccgctcttccgggccgtggtcggcgggcgggtggaggaggtgcatccggtgatccgtcatgttatgacccgggccgagccgtcgctggcggattacgtcgccgcggaacaggcggtgcaggggctgcgggatgccttcgccggctggttcggggccaatgatctgctgctttgcccggtgttgcccatgaccgccccccgtcctgggcaggccgggtatgaggtggcggaggcaaaggtcccggcccgtcatgtgatgcgcgccaccgtgccctttaatctgaccggcctgccggccttgtcgctgccgttcgggttgagccgcgaaggcttgccgatcggcgtgcagctggtggctccctggtggcgggaagaccggctgcttgccgtgggccgtcagctggaagcccaaagcccgatgcgaaaccggcgaccaccgctctgacgggtccgaaatccctgggccggccgtcagcgcgctggacgtcacccccacctccggtgtaggaatgcaagtcattcgcacttgcggaatggcatgtgcgggacggcaccatggaccgagggagcgacagatggtgggcaagacgggcaggctgggcggcatgctgctggggggcgttctgctcgcctccggttcggcgctggcggcgacgggcggtgatgcccgcgcggtggtgaccaattacgcgaacatcgccgaggcggcctatggcgacagcctgaccgcggcgaagacgctgcagacggccgtgaaggccttcatcgccaagcccggccccgagacgctggcggcggcgaaggccgcctggatcgcggccaacgtgccctacaagcagaccgaagccttccgcttcggcaatgccatcgtcgacgagtgggaggggcaggtgaatgcctggccgctcgacgagggcctgatcgactatgtcgacagctcgtatatgggggccgagggcaatgcggcggcggcgctgaacgtgatcgccaacaagagcttcacgctgtcgggcaagacggtcgacgcctcgaagatcacccccgacctgctgcgcgcgctgcacgaggcggaaggcgaggaggcgaacgtcgcgaccggctatcacgccatcgaattcctgctctggggccaggatctgaacggcaccggcccgggcgccggtaaccgcccctggaccgattacgacaccgccaactgcaccggcggcaattgcgaccgtcgcgccgcctatcttcaggccgcgaccgacctgctggtcgaggatctgtcgtggatggccgcccagtggggcaaggatggcgaggcgcgcaaggcgctggccgatgtgagccccgaagccggtctcagcaccatgttcaccggcctcggcagcctgtcctatggcgagctggcgggcgagcgcatgaagctgggcctgctgctcaacgacccggaagaggagcatgactgcttctcggacaacacccacaactcccactattacgacgccgtgggcatgtggaacgtctataccggccattatgtccgcatcgacggttcggtggtcgagggaccgtcgctgtcgtcgctggtggctgcggcggaccagaaggtcgatgccgatgtccgcgcccatatggcgacgacgctggcggcgctgggctcggtgaaggcgacggccgaggccggcacccattacgaccagctgctcgcccccggcaatgatgccggcgcggcgctgctgaacaccgccatcgacgccctggttcagcagacccgctcgatcgaacgcgcggtgacggcgctgaagctggagccggtggcgatcgaggggtcggacagcctggaccagccgacggccgtgttcaagtaagcgaccgacgtccagccagacggccggcggcgctctgcgtcgccggccattggcgttcaggggcagagacgggtttggggagcaggcaggggtggtgaggaccggactggtcgctctggcggtgctggccggggtggccgtggcgagcgatgcatcggcaggggatgcaattccgtccgatgtgctggaacagcccgacccgcatctgaaccaggtgccgcgcacggcggcagagcgtgcccgcatcctgaaggtcgtggaaccgacccgcgattttacccggccggaagattacgagctgaacatgggcggggcggccacgacgcaggcggccgtcaatcgcgatgtcttttcgcagttctcggccaacatgcccttcgcgcatgagatggacttcaagctcggcaacgggctgttccgcaaattctgggtctcctcgccatcgtcgaccaaggcctccgacggtctggggccgctgttcaatgcccgatcctgccagagctgccatgtaaaggacggtcgcggccatccgccggcaaaccccgacgatgaccgcatctcgatgttcctgcggctgtcgatcccggccgataccgacgagctgaaggccgccatcgccagccaccggctgatggtggtgccggaaccggtctacggcacccagcttcaggacatgtcgatccagggcattccggccgagggtcggatggagattgtttacgacgagatcccggttgaactggccgacggcgaggtcgtacatctgcgccggccgagctatagcatcgccgacccggcttatgggccgctgcacccggatgtgatgctctcgccgcgtgtggcgccgccgatgatcggattgggtctgctggaggcgatcccggccgaggacatcctggcgctcgcggaccctgaggatgccgatggcgacggcatttccggccggcccaatttcgcctggagcccggaatacggccgggtgatgctgggccgcttcggctggaaggccggcacccccaccgtgcaccagcaatcggccgatgccttcgccggcgatatgggcatctccaacccgctgcatccggcgggttacggtgaatgcacacccgcccagaccgattgccgcgcggcccccgatgggggagatgcgcctggcaccgacgggctggagatcgacgccgcggcgatggatctggtcagtttctatgcccgaaatctggcggtgccggcccggcgcgatctcgacgacccggtcgtgctgcgcggcaagcagctgttcgccgaggcgaattgcatcgcctgccaccggccgaaattcgtcaccgcgcggctgaaggaccggccggaacagagtttccagctgatctggccctatagcgacctgctgctccacgacatggggcccggcctggccgatggccggcccgaaggcatggccgacggccgcgaatggcgcaccgcgccgctctggggtataggtctgacggcaagcgtcgccgaaccggccagctatcttcatgacggccgggcgcgcagcctgctggaggccgtgctctggcacggcggtgaggcggaggccgcgaaacaggcggtggtcgccctgccgaaatccgatcgtgatgccctgatccgtttcctggagtcgctctgatgcgccgcccgatcctgttcgccacgctggccgccgtgcttgtcgccactccgatactgtctgctgccatggcggcagacacaccggccgcggcagcggccgaggcggccggtccggaccatgcggcgctgacggcgcgcgcgctcgacggctatatccgccccgaattcgaccgcttcgtggcggcgacacgggcgctggccgacaaggccgagaccgaccagagccccgaggcgctgctgccgctctatgacgccgcctatgacgcctggatgcggatctggttcttccgcttcggtccgctggaagaagagggccggcgcttccggctggaattctggcccgagcgcagcggcatcgcctatcgggcgatcggcgccctggtcaaggcgaagaacccgatcgtcgacgatccggaggcctttgccggcgcctcggccggggcgcagaacctggtgtcgatggaacggctgctgcgcccgcgtgaggcggtgccggccgccggcacgcctgcggccgagtatcgcaaccggctgatccgggcggtggcccgcaatctggcccggatggcggtctcggcgcgcgagggctgggaaggaccggaaggggcggcacatgtgctgaccacggccggcgacgacgagaaccagatctatctctcggccgacgagaccaccttcgccttcttcaacgccttccacggggcgctgcaggagctggaggaactgcgcctggcggccatcaccgctgaccagaccggcggcaccccgcgggctgcgcacgagcgggcgggcgcgtcgcttgagaacatccgcgccggcatcggcgggctgatcgatttcgaacgggtggtcttcgccccggcggccagcgatcaggtggcgcaggtcgacatggccgcggcgctggagaaagcggccgccgctgcggatgcggccctggcccgcgccccggacgatgcggaggcgatgaaggcgctgaaggccgcgcttgccgctgcccgccggctggctgtggccgaactcgccccggcgctgggcgtgcgggtcggcttcaattccttcgacggcgattgaggggggagggggatcatgaccggcaccatcacccgccgcaccatgctgcgcggccttgggctggcggcgggggccgccgccgtgctcaggcccgatcacgcgctctgggcagcgccgggcgcccctgacttcctggcggcggcgaaacaggccgatgggtcccatgcgcttcacgggctgatgcggagcggcgagatccgtttcaccatcccgctcggccagcggggccatggcggcgtcgtccatcccgcccggcccgaggcggtggccgttgcccgccggcccggccgcgaagccgtggtggtggactgtgccgaagggcgggagcagctgcgcttcaccccgcccgagggccgggtgttttatggccacggcgccttctcggccgacggccggaccttcttcacgcccgagaatgattacgagggcgcgcgcggccgggtcggcatctgggatgtggaggcaggctacaagcggctgggagaggtgtcgtcgggcggggtgggtccgcacgaaatccggctcgaagccggcggcgccaccctgctggttgccaatggcggcaatgccacccatcccgacatgggccgcgaggtgctgaaccccggcaccatgcagcccaatctgacccggatccgcgtggcggacggggccgtgatcgatgcggtggagaacgagcccgcgctgcgcatgaacagcatccgccatctcgccacccgtcccgacgggctgggtgcggcggtgatgcagtggcagggcgacggccatgaacgcccgccgctgatgatgctccatcggatgggcgaggccgtgcggctgctcgcggcacccgagcccgcccatgcggcgatgcgcaattatgccggctcggtcgccttcaaccgcagcggcgatctggttgcgatgacctcaccggtcggcgggcggctgcaggtgttcgaaaccgagaccggccgcttccgcgcggcgctggtggccgccgatgtctgcggtctggcggcggatccggagggcgagggcttcattgccaccgacggccgcggccgggtgctggcggtggtggccgatccggcggcggaagcgggcttccggctgaagctgcgcgccacgcatccggtcgcctgggataatcacgtcgtggtgctctgagagcacgggcatatcgtggtgctctaggagagcacgcggcccggccgtcggggaggcggaccgggccggctttgcgtcaggcgatctgcttcaggcggatcacttcgaacttcgcgatacccttcagtgcccggcccagggcgcggaaatggtcggatttgccatgggcgacggtggccgcctcatcggtccattcctcgagcatgacgaagcgatggtcgttggtgacgtcgacatgcaggtcatagcgatggcagccatcctcggcgcggctgggacccgtgcattcggccagggcggcgcgaacggtttcggcatggccgggctcggcggtgatgatcgcggtgatgaccagattgggggtcatgggagcgtttcctcggggtatgttctggttggcggctcagactacagcaatccgcaacttgacgcgacggattgctgatcttggcgctgtttcgccgttttgatcagcgtttgaacggagacttgtcagagagcccgtgccatcgcatcgatcgcctcggccagctgcccgggttcgtcgaccagcccatcggctccggcgctctccagctcttcgcgcccgccataaccccagagcacgcccaacgcccgcaccttgttggcatgggcgcccgagatgtcgtagcgccggtcaccgaccatgatcgcgcgggcgggatcgatcccttcgccggcgatcgcccgggcgatcacctcgggcttctcgccgccggtatcgtcggcattggcgccataggtgccggcgaagagcgccatcagcccatggcgttccagaatcatccgcgcggcgggcagggccttggaggtggtcagaaccagccgccgaccctcggcgccgaagcggtccagcacctcgcggatgccggggaagagcgggctttccgccagcaccagctcgtcatggtggcgctggaacacggcaacgccttccgccacccggtcgtcgccatgccgccccagcagcagcgccatggtgtcggtcagcggcggcccgatcgtccagcccagatcctccgtccgatccgccggatggcccatttcctccatggtcatatggatgcagcggaccacggcgtcgtgggaatcgatcagcgtgccgtccatgtcgagcaggacggtgatatcggcaggtgcagccaagacggatactccggacattcgcgaaccggtggccggttctggttctgacgcggtgatcccgcaacgcagcatcaccgcactcttcgagttctacgccccgtgatgcccggggacacgtgaaaaaaatgcggccctcccgttcggggagggccgcattgcaggaataatgacgagtcggttcaggccttgccggccatctcgcgcagcatgcggacgatgcccgagaagtcggcgccgccctggccggcgtcggagtactgctggtagagggcagcggcagcagcgccgagcggcgtggcggcgcccgaggagccggcggcgtcctgggcgagcttcaggtccttcagcatcatgtcgaccgcaaagccgggcttgtagtcgttattggccggcgaggtcggcaccgggcccgggaccgggcaataggtggtgagcgaccagcactggcccgaggcggtcgacgagatgtcgaacagggtctggtgctcgacgcccagcttttcggccagcgcaaaggcctcgcagacgccgatcatcgagatgccgagcagcatgttgttgcagatcttggccgcctggccgttgccggcgccgccggcatggacgatcttcttgcccatcttctgcaggtaaggttcggccgccgcgaaggcggccccggtgccgccgaccatgaaggtcagcgtgccggcggccgcgccgccgacgccgcccgagaccggggcgtcgaccatcggccggccggcggcttcggcggccgcgatcacctcgcgcgcgctgtcgacgtcgatggtcgagcagtcgatgaagagggtgccggggcgcgaggcggcgatgatgccggcatcgcccagatacacgcccttcacatggcgcccggcaggcagcatcgagaccaccacgtcgacatccgtcgcggccgcgacggcgctgtccgccttgctgccgccggcatcgacgatgcgctgcaccgcctcgtccgagaggtcgaagcccttcaccgcatggccggccttgagcaggttgagcgccatggggccgcccatattgccgaggccgatgaaaccgatggtcgccatcttcggaacgtctccctgaagtcgtcgatcttgtgtgatcgggtcgatcttgtctgatctttaaggtcgtgcagcgtgtggtcgcgccggtccggtgcgggccaggctcaatcgatcgccatgccctggagcaggcggcgggcgatgatcacacgcatgatctcgttggtgccttccaggatctggtggacccgggcgtcgcgcagatagcgctcgatcggatagtccatcagatagccatagccgccatgcagctgcagcgcctcgttgcagatccggaagccggcatcggtggcgaaccgcttggcggacgcacagatcgcggtcttctcgggatgctggctgtccagcgaccaggcggcccggcggatcatcagccgggcagcttcaagctccgtcatcatatcggccaggcggaactgggtggcctggaactcggccagtgccttgccgaactgctggcggccctgaacgtattcccgcgcggcgtccagcgaggcgcgtgcggcaccgatcgaacaggcaccgatattgatgcggccgccatccagccccatcatcgcgatcttgaagccgtcgccttcttcgccgaggcgattttccaccggcacccgacagtcttcgaagatcaccgccgcggtcggctggctgttccagcccagcttgcgctcattggcgccgaaggacaggccgggcgtgtccttttcgaccacgagggtggaaatgcccttcgggccgtcgccgccggtgcggaccatcacgacatagatgtcggagcggccgccgccggaaatgaacgccttggagccgttgaggacatagtggtcgccatcgcgcaccgcccgggtgcggagcgaggccgcatcggagccggcccccggttccgtcaggcagtagctggcgaaatgttccatggagcacagcttcggcaggaagcggttgcgctgctcgtcattgccgaagcggtcgatcatccacgcggccatgttgtggatggagatataggccgccgtcgaggtgcagccggcggccagctcctcgaagatgatcgcggcgtcgaggcgggtgaggcccgagccgccgacgtcgtcgcggacatagatgccgccgaaaccgagggccgccgcctcgcgcagctccgcctcgggaaagatcttcttcgcgtcccactccgcggccccgggggccagccggtcggtcgcgaaaccgcgggccatctcctggaaggcgcgctggtcttcggtcagggagaaatccacggatgtcacctccacgatcttattgcaccccaccgccccgcgatccggaagatccggtccgcggggcggtgcggcgaaagccggacgcgacgggcgatcagcccatggtcgggatgtggaagtccgcacccgagcggatgccggtcggccagcggctggtcatggtcttgatcttggtgaagaaccgcacgccctcggggccgtgctggttggtgtcaccgaaggccgagttcttccagccgccgaaggtgtggaaggccaccggcaccgggatcggcacgttcacgccgaccatgccgacctggacgttgcgggcaaactcgcgggcggtgtcgccgtcgcgggtgaagatcgacacgccgttgccgaattcgtgctcggtgggcagggctgccgcttcgtcgaaggacttcgcacgcacgatgctgagcaccgggccgaagatctcttccttgtagatgcgcatctcaggcgtgacccggtcgaacaggcagccacccatgtagaagccgttctcgtagccctggatgttgacttcgcggccgtccacgaccagctcggcgccttcctgcacgcccagatccacatagccgcggaccttgcgcagatggtcacccgaaaccagcgggccgaaatcgccatcggccatcgaggggccgaacttcagattctggacccgcggaaccagacgctcgcggagggcttccgcggtcgcctcgcccaccggcaccgccaccgagatcgccatgcagcgctcaccggccgagccgaagccggcgccgatcagcgcgtcggccgcctggtcgaggtcggcgtcgggcatgatgatcatgtggttcttggcgccgcccatggcctggacgcgcttgccgtgcgccgcaccggtcgcatagacgtatttcgcaatcggggtcgagcccacgaagctgatcgccggcacgcgcggatcggtcaggatggtgtcgaccgcttccttgccgccgttgacgacgttcagcacgccggccggcgcacccgcttccatcatcaactcggccagacgcatcgggaccgaggggtccttctccgacggcttcagcacgaaggtgttgccgcaggcgatcgccaccgcgaacatccacatcggcaccatggccgggaagttgaacggcgtgatgccggcgcagacgcccagcgcctgacgcatcgaatagacgtcgatgccgcgggcgacgttctcggaatactcgcccttcagcagatgcgggatgccgcaggcgaaatcgaccacgtcgaggccgcgggtgacgtcacccttggcgtcggtgaaggtcttgccatgctcgctggacagcagctcggccaggctgtccatgttctgctcgacgagctgcttgaacttgaacatcaccttggcacgggccatgggcgaggtgttcgaccagatcgggaaggcttccgccgcattggcgatgccggcctcgacctcggccctggtcgccagcgcgaccttcgccgacagctcaccggtcgacgggttgaacacgtcgccgaaattgccgctggtgccctcgacgatcttgccgccgataaagtgatggatctgcttgaccatcccgcgtttcctcaacgttgcgagggtgtaggaccgagcccgttccccggcttgcacggagggtgagggccccggggcctgcaccgccctgattgttacgccgccggtatcccggacaatctctgtccggacggcttggtgacgctacgataacgatgtaaaactgcacggccagcccaaaacgcgcagaggccgtctgcgcggatgcacacctgacacgaggcccggatgttcgactggaacgacctccgcttcttcctggaagtcagccgccgcggccggctggtgaccgctgcgcgtcatctggcggtcgatcataccaccgtcagtcggcgtatccaggccctggaagagcggatgaacaccaagctgttcgatcgtacccccgcaggctacagcctgacaccggcgggcgcacagctggtggaatatgccgaggcgatggaaaccaccgccttcgccatccaggaaagcatcgcgggccaggatctgcatctgtcgggcaccgtgcgggtcggggcgcctgaaggcttcgccacggcctttcttggggcccggctgcaacccttcttcgccacccatccgggtatccagatcgatcttgtggcggcgccacgttatctcagcctgtcgaagcgcgaagcggatctggccatcgggctcgcccggccgacctcgggccggctggtggcgcgcaagctgaccgattatcgcctctgtctttatgcgacgcccgcctatctggagcgggccggcacgccccgcacgctgaaggagctggaggggcacgatttcatcggctatgtcgacgacctgatcttcgcccccgaactgcgctatctggacaagctggtccgggcgccgcaggtggtgatgcgatcgaccagcctggtggtgcagcgcgatgcgacgctggccgggctcggcctctgtatcctgccctgtttcgtggcggcgaccgtgcccgggctggtgccggtgatgccgcgcgagaccagcatccagcgcagcttctggctggtgacccatgccgatctgcgcgacatcgttcgggtgcgcacggttgccgaatacatccgcgatctggtccgccgggaacaggatctgctgatcggccgcgggctggacgagacggcgtgaccggccccgcacggttctggaccgccgggccggtttgcgcctagagtcggctccatgacagggtgtctcgcgtttcggttgggggccgggcgcagagctggcacaagacgcgacggcagtgggggcaggggcatatggacggagtaaccggagcgtcgttcggcggcgttgcgcagagcgcgttcggggtgctggcgctggtggcgctggcctggatgatcggccgggcgccgaagggagtgccctggcgggcggtgggcatcggcatcgtgatccaggtggcgatcgcgctgatcctgctgaaactgcccccggtgcaggcggtgttcgtctggatcaaccaggcggtttcggccctggtcgccgccaccaaagccggcacctccgtggtcttcggctatctggggggcggtgcggccccgttcgaggcaaccaatccggccaattccttcgtgctcgcctttcagggcctgccgctgatcctggtggtgggcgccattgccgggctgctttatcactggggcgtgatcccgttcttcgtgcgcgcattctccaggctgctgcgccggaccatgggcatcggcggcgcggtgggggtatcgaccgcggccaatgtcttcgtgggcatggtcgaggcgccgctcttcgtgcggccctatctggcgcgactgtcgaaccccgagctgttcatggtgatgacggcgggcctcgcgacgctggccggcaatatgatggtgctttatgccgccttcctgaccggcacggtcgaagacccgatcggccagctgctgaccgcatcgctgatctcggcgcctgcggcgctggtggtggcgatggtcatgatgccgccggcgcatggcgagcggactgtggacgatgatgcgaccgccccgccatcggatgcagcgaccagcctggaagcggcggtcgatgggggtgatcaacggcgtcaacctgctgatcagcgtggtggcgatgctgatcgccggcatcgcgctcgccgccctcgccaacatgatcctgggccttgccggtgacgtctggggcgcgccgctgacgctggagcggatgctgggctggatcatggcgccggtcgcctgggcgatggggatgagctggcccgaagccctggcggcgggcccgctgctcggcaccaaggtcgtgatcaacgaactggtcgcctatctgcagttcaccgccgacccctcggccttcagcccgcgtgcacgggtgatcctgacctatgccctgggcagcttcgccaatatcggcagcctgggcatcatgatcggcggcatggtggccatggtgccggaacgccgcaccgacatcgtccggctggcgccgctgtcgctggtgtcgggcacgatcgcgacctgcatgaccggcgcggtggtggggctggtggtctggtgatcttgaactgcgatatgtctgcaaagattctgcaatttttggttgatggtgattggtgattcaaaatatcatcatcccaagacgatggcctgtcgcgacaaagacgacaacggtcaaccgctgaccatcatgcgccgtcggacctgatgccggagtggtgaaactggcagacaccggaagtgcggccctggtcgttcttccgccggggccttcgtgtccttgcaggttcaagtcctgcctccggcaccaccttcctcttccgctcaagtgctgccctgatgattgtgccgtcctgccgacagtcgatggggcacccctgcgtcgatttcgaggaacgtgcccgatgaccgatgccgtgctggtcttcccgccctcctattacccgtggttcgtggcacccggcctgtcgcaccttaccgcctggttgcggtcgcgcggctggcaggtggtacagcgcgacgccaacatccccgcgatcgagcatgcgctgcgccccgatgcgctggcccgcgccgacgccccggccgagctggtgtcggggatcggcccggcgctcgccaccatgcgcgactggcaggcgcatcacgcgcttgaaccctatctcgccgccaagcaggtgatcgaacaggcctcgctggtgatcgatgcggcggtgcccgacaccttccgcatcttccgcaacacgctgcaatacatctcggcccatgatgcccgccggcgtgcgggggtgatggcggcggtgcgcgaccgcgaaacccatctcttccacgactattaccgcgacgtcgaggtaccggcgatccgggcgctgcagccgcggctggtcgggctgtcggtgaacgaccatcaccagctgatcccgtcgatggtgctggcctcgatgctgcgcgaggcgctgcccgacacccatatcaccatcggcggcaatctgatcgcgcggctgaagacctcgctggaagccgacgaacccgagaccgcagcgctctactccgtggtcgacagcttcatccatcacgagggcgaacagccgctggaccagctgctccaggaactggtccatggccgggtcgccaaccggccggtgccgcaagtgatccgtttcgacggcacgcggccggtctccggcccgccctccatgccgatcgcgctcgaccgcctgccgcggcccgaccccgaggcctatgcgccctggacgcccgagccggtgacggcactgaacatctatcgcggctgctattactcggggatctgcagcttctgcgacattaacgagggctatgacagcgtcacccacgagacccagcccgacggggcggtgaaggtgaagttccgcaagcgcctccggccgatcgagatggttgccgaggatctggcggtctggcatggcgagaccggccgcacccggttcagcttcaccgatgaatggtttcgggtctcggaaatgctggaactgggggaacacctggccaggcgcggcctctccgagatccattgggaggcctatgcgcggttcgagcgcgcctatctggagcccgatacctgcgtgcagatccgcgaggccggcgggcgcttcctgcaattcgggctggagagcatcgcgcccgccacattgaaggcgatgaagaagggcaacacgcccgacgaatatgcccgcagcctggccaataccaccgcggcgggcatctggaaccatgtcttcttcatcgtgggctatccgggtgagcccatccaccatgtcctgccgctgttccgcttcctgaccgagaaggggcgggacgtgctgaccgtgaagccgacccgctttcagctggcccgacgcgcacctctgatccactccccgcccgagggtatcgaggtggtgcccgaggccgattgggattttttcatcaacatcccattccagtacagccagagctggtggtgcaagcgctgccgcaccgaacttgccgaggacgccatggtcatgaagcagggccggccgaaatgcgctgcctgcaacagctgggccgaacgctgggcgcccctcagccgcaaggcggtcgacgggatctataccctgtcggaagtgctgtgcgagcggcactggtcgcatccggccaccagcctgttcccctatgtggcgcggctgttcctgtcggaagcacagatgaccgacttcgccgcccgcctgcccaggctgtcgacggtcgatgagtcggcgatcgatcaggcgctggtcaaggtccgcggcgcgcttgcccgcgaggccgagatgatcgacggcatcggccgggtctatgccgacagcggcttgaaactgccgaaaaaattcgacggctatgacgatttcctggaccattgcatggcctggacggaagcggcggcggcctgaccctgcgcttgatcagtcgacgcaggctcagctgtcgggcaatatgcgcggacagacgttttgaacgaacgtctgaatgacagagccgccgcgcatcttccggcagggcatccgcccgccgggcgggccgaggcggccgcccagcggaggaatgcccgtcgatgaccgccgatcccttcgacctggcccggccagaggtgcaggaccgcctgaccgcatacctggaacgggcggtgcccggctttcgcggccccgcgcgcctgcatcgcttcaccaatggccagtcgaacccgaccttccggctggataccgatggcgggtcctatgtgctgcgcaagcagccggccggcaagctgctgcccaaggcccatcagatcgatcgcgaataccgggtgctctcggcgctggggcccacgcccgtgccggtgccggcggcgctgcattactgcgaggacgcatcgatcctgggcacgcccttctatctgatggggcatgtggcgggtgccaccttcggcgatatgcgcctgccggagctgacgcccgatcagcgccgcaccgtgtgcttccggctgatcgagacgctcgccgccctgcacgaggtggatgtggcggcggtcgggttgggcgattacggccggccgggcgggttctacgagcggcagatcgcggtctggacccgcaattaccgcgcggccgagaccgaccggatcgagggtatggaagccctgatcgcctggctgccggccaatatgcccaaggaccccgagcgcaccaccctggtccatggcgatttccggctggaaaactgcatcgcggccgaagacggctccgagatccgcgccgtgctcgactgggagctgtcgaccctgggcgagccgctggctgatctgggctatcatctgatgcaccactacatgccggcggatgacttcggcggctatgtcggcatcgatatcgcagccctcggcctgccggcagaggccgagctgctggaccattacgcccggctgacagggcggccggcgatcaacgactggaccttccacgtcgccttcgcgctgttccgttcggtcggcatcctgcaaggggtctatgcccgcgccctgcagggcaatgcctcgtcgccttacgcacttgaacgcggccgcaaggcccggctggtggccgatgtcggccgccggctgatcgaggcgcgcggctgacctttgcctatacgttccgctttccaaaacgatcagacccgggaaccaatgatgaccacgcccacccgcaacaccttcgacgtcgccggccgcggcatcctgatcaccggcgccagccaggggctgggggcgaatttcgcccgcacgcttgcggcccatggcgcgaagctggtgcttgccgcccgccaggtgtcgaagctcgaagcgcttcaggccgagatcgaggcggccggcggcagtgccgcaaccgtggccatggacgtgacctcgggtgccgccgccatcgatgccgcaatcgccgagacggccgagaagctgggtgggcggatcgacgtgctgatcaacaatgccggcatcgccgtatccaagcccttcctgaagctgacggaagaggattgggatgcgacggtcgacaccaatctgaagggcgctttcctggtcgcccaggcggtggcgaagcggatggtcgagaccggcggcggcagcatcgtcaacatcgcttcggtgctgggaaccgaggtgatgggcaatctggtgccctattgcgcgtcgaaggccggcgtcaaccacatgacccgggccatggcgctggaactggcccgctacaacatccgggtcaatgcgatcgcccccggctatatcgaaaccgacatcaacgcctcgttcttcgagaccgagggcggccagaagctgctgcgcaaggtggcccagcgcaagctgggggctgcggtcgatctggacggcgcgctgctgctgctgtcgtcggacgcttcagccttcatgaccgggtcggtcgtcaccgtcgacggcggcttcggtctggcgtaatctctgaccccatgtcacgggccgcttccacataccttcactctttcggggtgcgcttctccggcggccccggtccgttcgctgcgccgggcggcgcatgaccgacaccggcgggcgggccctgattttccggcgtttcggcgacccggccgaggtgctggcgctggaggcgcagcccgcaccggcaccggctgccggagaggcggtggtcgccatgacccatcgctcgatcaatccttcggacctgatcccgatcaccggcgcctatgcccatcgcgtggcgccgccgcgtatcgcggggtacgagggcgtcggcatcgtcgaacgggcgccgggcggctcggctctggcccccggcgaccgggtgctggcgctgcgcggcagcggtacctgggccagtcgggtgacggcgccggcgtcgttctgcgtggccgtgccggcggccatttccgacgaggccgcggcccaggcctatatcaatccgctgaccgcctgggcgctgctggcccacgaactggccctgccggccggtgcggtgatcgcgatcgatgccgccggatcggccttcggagcctgtgtgctggccttcgcccggcggcatggctggcaggtggtggcggtgaccacggcggcggcacgaacaggtgccctgcaggcggccggcgctgccgctgtggtggtgaccgaagcgggcgagccggcggtggagctggcggtccggctgcgccgggccgcgggcgggcggatcgatgccgggctggacgccgtgggcggcgagatcgggacgggcgtggcgcttgccgtgtcggcgggcggcgcgttccgcttctatggcctgctttccggccgcagccttggggctggtcttgccggagaggtcgcatccggtgtaacggtaagaccgttctggttgcggcattggcaggatcaggccggcgccgatgcctggcgggatggctttgcggagatcttcgatgccatccggtcgggcgatctgtgcctgccggccgaggcggccttcgcgctcgacgactggcgggcggcgctggccgcggccgggcgccgcgaccgtcggggcaagatcctgctgacgggcggctgacatcgcccgcgcggcctgccccatccgaggggagatgcgcaatgcgggccagcggcaacacacggcaccacgccatgtttcaggccttcgcggagcgcgcccgggcccgccctgccgacgaggctctggtgctgggccatgtccggctggattatggccggctgctgagccgcggcctggcggtggcgggcgccattgccggcctgccgcgtccgtcgccctctgccatggcgcgacggccgcggcccttgcgttcattgcggctggttgccctggtcgccggcaatcggatcgagttcgtcgaagcctttctcggcaccgtcatggccggcgcggtggtgctggtcgtcgaccccaagctgaccactgaccaggggctgaaactgttcgagcggctggcgccggatctggtgatccacgaccccgccgtcgccggctgggtgtcgagccccgaggccgggttgctggcgggcggatttctggcgctgacaggcggcatgggctgcccctaccggctgtggcgcgaccgggcgatgggggagcagccggcaaccgcagatctgccggccgccgtggcacccgatcagcccttcctgatcgccaccacatcgggcacctcgtccgaacccaaggcattcatccgcgatcatcagagctgggcggagagcttccgcaacagcatcgccgaattcgccatcgcacctggcgagacggttctggcaatggggccgttggtccatggcctgtcgctctatgcgaccatggaggcgctggccgccggcgcaacggcggtgctgctggatcggttcgacgcgacccgcgccgccgcggtggccgcggcggaacgcgccgatctgctggtcggcgtgccgacgatgttcgaggcgctggggcgggggctggatcatgcgcgcgcccggctgccgggcgtgcgggctgtggtctcggccggggccaaactgccgccggcgctggcccgaagccttggcgccgcgctgccgcgtgccgagatccacgaatattacggcgcgtcggagctgagcttcgtgacccttgcccgcagcggccggggcgacccggcggagtcggtcgggcgtgccttccggggcgtggagctgcgcatcaccggccctgcgggcgaggcactgcccgcgggcgaggtggggcggatcgacatccgcagccgcatggtttcggccgggtacgtgatggggggcgaggacggcagcggcttcgtggcgctggaggagggctggtccacggtgggcgatctgggccggttggatgcagacggacatctgtacattctgggccgggccggcggcatgatcatcaccggcgggctgaacgtctatccgggcgaggtggaggcggcgatcgccgccctgcccggactgggagaggcgctggtcttcggcgtgcccgacccctattggggtgaagcggtggccgccgtgctgcgggccgggcctgagacgccgccggtcgatctgatcgagctgcgcagccggctggccgggcggctggcgcgccacaagctgccgcggatgctgtggcatgtgcaggactggccgctgggcagttccggcaagatcgcccgcgggcgcgtgcgcgcgacgatcgccgccggcgaggccgggccgccgcagttgctggacgagggcgtggcgggggccctgcccacccggtgaccgccaacccggtgaccacacatcgagatttcgccgacgggtccattgacgcctgaaggctgacgaattatctctttcgtcaggaatcagtcgtcagatccggagaacgaggctcgcccgcacgccatggccccccgcaccgaccacgacgaaacccgcgtccgcatcgccgacgtcgccgaagagctgttccggcggctgggctatgccaagaccacggtcgccgacatcgccgccgaactcggcatgtcgccggccaatgtctatcgcttcttcccgtcgaagggcgcgatcgtcgaaagcatctgcagccgttatctggaagaggtggtggtgctttgcgatcgcatcgccgaccggccggagccggcggcggcacggatcgaggcactggtgctgggggtgctggactatcaccgccggatcgtgctgcgcgaacagcgcatccacgatgtggtggtgatcgcgattcgcgagaactggcaggcgatcctggcccataaagaccggatccgcaccgtgatggcccggattctggccgacggcgtccggcgcggcgagtttccgggcctggatgccgaagatgcggcctctgccttgttgagcgccgggacccgcttctgtcatccgatgatgatcgccgaccatctggacgacgatctggatgccgaggcaaggcagatgctgcgctatctgctggcgggtttcgcaaccgccggacgccctgccggttgaccaccggacctcgcgctgcggccgcccccccaccggccgtggttcataaagcctgaccgccgcagaccgcggccgaggagccagacgatccatgaaccgcaccgaaaccgggcctgcacgccctgacctcgcccgttctgcacggcgcccggccgtcctgtttcgcagcgtgtccgctgcggcgctgatcgtggcggcggtggggctcgccggctgcaaggagcagacccgcgccgatgccccgccgccggaacggccggtgaaggtggcgacggtgcgttatgcctctacggccgagacccgcgatttcgtgggcgtgatccgtgcgcgcaccgaaagcgcgctgggctttcgggtggcgggcaagctggtcgagcggccggtggatgtgggcgaccgggtgacggcggggcaggtggtggccaggctggaccggaccgatctggccctgcaggtgcgcagcgccgaggccgagctggatgcggcgcggtcgaactacacccaggccaaatccgacgaggcgcgctatgccagcctgcgctcgcgcgggtttgccccggtggccgaatacgaacgtaagaaggcggcactggacgccgccgccagccgggttgaacaggcccgccagtcgctggatctggcccgcaaccagctggcctatggcgacctggtcgccgatgccgacggcgtggtggtctcggtgggcgccgagccggggcaggtggtggcgaccggccagacggtggtgacggtcgcccgcgacggcccgcgcgaggccgaggtcgccctgccggaaagctggttgaccgaggcgcggcgcgccaacgcggctgtccggctctgggccgatcggggcgatgcctggcctgccagcctgcgcgaactcgccccccaggccgatccggtgacccgcacctatgccgcccgcttcaccatcgatgcggccggggccgaccttccggcactgggcatgaccgcgaccgtaaccctggcgctgccgggcaatggcgaggtggcgcgcctgccgctggcggcggtgatgaatgacggctctggcgcctcggtgttcgtggtcgaccccgatacctcgatcctgcatcgccgcaaggtggcgctgcgcagcttcaccgaagaggtggcgctggtcgaagccgggctgaagcccggcgaacaggtggtgacgctgggcgttcaccagctgcgcgacggcgttgccgtccggatgctgaaggacggctgagcttccgcttcgtcgccgtcacccgctgctgaaggcccgccgtcgagaggccccgatgtccgaagagacgccgcaccgcgcccccggtgccgacgccccctccacccatgatgccccctctggccatgacgccccctctggccatgacgctgcacctgctcaggatcaggggccggtgcgcttcaacctgtccgcctgggcgatcagccaccgggcgctggtgctgttcatgatcctgatcctgggtgtgggcgggatctggtcctatatccagctcggccgggccgaggatccgtcgttcaccatcaagaccatggtggtctcggcccgctggccgggggcgaccacgctggagatgcagtctcaggtcgccgacgagatcgagaagaagcttcaggagctgccccatctcgaacggctggatacctattcccagcccggcgccacattcgtgcaggtgactctgtcggatgcgacaccgccgcgcgacgtggcggggctgtggtaccaggtgcgcaagaagatcggcgacatacgcaaccgcttgccatcgggcgtgcaggggccgttcttcaacgacgaatatggcgacgtctattcggcgctctacatgatcaccgccgacgggctggacccggccgcccttgaaaaggtggccgagggcatgcgcagccggctgctgaaggtgcccgacgtcaccaaggtcgacgtgatcggcaaccaggatcagcgggtctgggtggaattcagtcacacgcgcattgcgacgctgggcatcaccccgcaggcgatcttcgaaagcgttgcccggcagaatgcggtggcaccggcagggtccgtcgataccaccgccgaccgggtctatctgcgcgtcaccggcgccttcgatgcggtggagcggatcgccgccacgccgatccaggccggcggccgggtgttccggctgggcgacgtggcggatgtccgccgcggctatgaagatccggccgactatctggtccgccagggcggcaagactgcggtgggcgtgggcgttgccatggaagacggcgccaacatcctgactctgggcgagaatctgaccgcggccatggccgatatccgtgccgaactgccggtcggtatcgatgtcgtccagatcgccgatcagccgcatgtcgtggacgaatcggtcgccgaattcgtgaaggtgttcatcgaggcgctggtgatcgtgctggcggtgagcttcctgtcattgggcctgcgtaccggtatcgtggtcgccttctcggtgccgctggtgctcgcgatcgtcttcctggtgatgttcgcgatcgacatggacctgcaccgcatttctctgggagcgctgatcatcgcgctcggcctgctggtcgatgatgcgatcatcgccatcgagatgatggtggtgaagatggaacagggctggagccgggcgcgcgccgccaccttcgcctggacctccaccgccttcccgatgctgaccggcacgctggtcaccgccgcgggcttcctgccggtcggtttcgccaaatccagctcgggcgagtatgccggcgcaatcttctgggtggtgggcattgcgctgatcgcgtcctggttcgtggcggtgatcttcacgccctatctgggctacaagctcttgcccgatttctcgaagaagaagggcgcccatcacgacccggacgcggtctacgacacccggatctatcgcatcctccgccggatgatcggctggtgcgtcggccaccggatcatcgtcattctgatgacggtcggcatgttcgcggcctcgatcgtcggcaccggcatggtacagcagcagttcttcccgacatcgacccggccggaactgttcttcgaactgcgcatgcccgagggcacggcgatcggggtgaccgatgccgccgcgcgcacggcggaacggctgctggtcggcgacgaggacatcctctcttacaccacctatgtcggccagggctcgccacgcttctggctgggcctgaacccggtgctgcccaacaccgccttcgcccagatcgtgatcctgacccgcgacaccgaggcgcgggaacgggtgaaggcgcggctcgacaaggcgatcgaagagggggccgtcactcaggcgcgcgcccgcgtcgaccgcttcgtcttcggcccgccggtgggtttcccggtccagttccgggtggtgggcgacgacccgctgaaggtgcgcgagatcgcctatcgggtccgcgatgtgatgctgcagaatgacaaggtcgtcgacccgcatctgaactggaacgagcagcagaaaagcctgcgtctggtggtggatcaggatcgcgcccgggcgctgggcatgacgccggccgacatttcggaatcgctccgcaccctgctcgacggctacaccatcacccagtatcgcgagggcaacgatctgatcgacgtcgtcgcccgggcggtgcccgaggaacggctggatctggaccatctggcggggctgacgatcgccacgcgcgacggtgtacccgtgccgctcgatcaggtggtgcgcatcgactatgtcttcgaagagccgatcatctggcgccgcaaccgcgagatcgtgctgaccgtgcgcggcgacgtgatcgacggcgttcagccacccgacgtcaccaatgaactgctgccggccctggccgggctgaaggcggagctgccggccggttaccggatcgataccggcggctcgatcgaagagagcgccaaggccaacaaggcgatcgcggcggtgatgccggtgatgctgatcgtgatgctgaccatcctgatggttcagctgcagtcgttctcgcggctcatcctggtgatcctgaccgcaccgctggggctgatcggcgcggtgggcgccttgctggtgaccaaccagcccttcggcttcgtggctctgctggggttgatcgcgctcgccggcatgatcatgcgcaacaccgtgatcctgatcgaccagatcgaggccgatgtccgtgccggccacagccgggcccaggcgatcgtcgatgccaccgtgcgccggtcgcggccggtggtgctgacggcactggccgccatcctgggcatgatcccgctgtcgcacagcgtgttctgggggccgctggcgctgaccatcatgggcgggctgatgggtgccaccgtgctgaccctgctggcgttgccggccatctacgccctgtggttccgggtaccgcgcaccgaggtgaaggcgaccgtgcaggccgagaatcaggcggcgcaggatcacactcacggctgacgaaaaacgccccgccgtccggaagggcggcggggccagtcgctgctcaggcggagcagaagcggaagcgtcaggaaccgactgctcccacccggcgcttcaggcgccgggggcgaggcagtcggtcatggaacgcacaagagcggtgatcagttccggataggcgtcggggccgggggtgagatcggcgccgaccgggtcgagcacggcacttttggccgatgtgccctcggtcagcgttttcaccaggcgcggatcgaattgcggttctgcgaagacgcaggcgacgccgccatcggtgatccgctggcgcagctccgtgatacggcgtgcgcccggcggctgctcggggttgagggtcaccgagccgacgccggccagaccataggcggtctcgaaatactgataggcgtcgtggaagacgatgaagggccgcgtcttcaccggcgccagttcggccgtgactgtctggtccagctttgccagacgcgcatcataggcggcggcattgtcgcgatagcgcgcggcatgctccggatcggcttcggccagcacatgggcgatttcagccaccatcgcgcgggcattggccggcgacagccagacatggccgtccatggcgccgtgatcgtggtcgtgatccccgtgcccgtggtcgtcgtgcccgtggtcgtcgtgggcatggtcgtcatggtcatgcccgtcgtcgtcatgcccatgatcttcatggtcatgatcatgattgtcgtgatcaccatgggcgtgttcatgcggttcccagaccccgccttcgcggatcggcaggggcttcacccccggcgcgtcgatcatggcgagcgtgcgggccttgccggccagaccgtcgacgatccggggcatgaagctttcgaccccggggccggcccagatcaccacgcctgcccggtcgagcaggcgggcatcagagggcttcagcgcatagtcatgcgggctggcggcgccctggaccagcaggtcgggcgtgcccacgccggccatcacgccggccgccagcgcgtgcagcggcttgatcgtcgccacgaccacgggcacgtcagcccgtgccgaagacgcaccaccaagggcggttccggccagcagcagggctgccgccgcggttgcctgcacacccgtcatgcctcgcataggccctcctaggatctgcccgggctggcaatgatccgggcatcgatataacataactcagtgaacccgcagagtacggaatgttatagcgtagcgcaagatggccgatcacgctcatgaccacgcccatgccagcccgcgtcccgcacccgccgagggcgcggcggacgcctttccgcagggcgaccacgatcatcacgcctgtgtcgccaccgcgctcgatgcggcggagcggatctgtgcggccaatggcgcacggctgaccgatctgcgccgccgggtgctggagctggtgctggacgggcacgagccggtgcgcgcctatgacgtgctggaccggctgaaggacgagcgcagcggcgccgcaccgcccacggtctatcgggcgctcgacttcctgctcgaacagggactggtgcaccggatcgagtcgatgaacgcctttgtcggctgcggtctggccgggcgcagccatgccggccagttcctgatctgcgatgcctgcggccgggtggccgaggtgaccgatgccggcaccagcgaccgcctggcggcgctggccagggcggccggcttcacgctgaagcggcagatggtggagctgcacgggctttgccccgcctgcaccaccgcggccggcgaaggggatgccgcatgaccgcggtcggcctgatgtcggacagtcgcccggcgaccaggccctccgggccgccactggtcgagatccgcaacctgctggtggagcgcgacggccgccggctgctggacggcatcgaccttgccatcgcaccggggcggatcgtcaccctgatcggcccgaacggggccggcaagtcgacgctggtcaaggcggcgctcggcctggtggcgccgtccgccggcacggtggtgcggcggccggggctgcggatcggctatgtgccgcaatcgctcgccgtagatcgcaccctgccgctgaccgcgcggcgctttatgacacttgccgatgtccatggccgccggcccagggcatccgagatcgccgaggccctggccgaagccggggcggaaggtctggagacccggtccttccacaagctgtcggggggcgaggccaagcgggtgatgctggcccgcgccctgttgcagcagcccgatctgctggtgctggacgaggcggcggcccatctggacatgcccggccagatcgccttctaccgcacgctgcgggcgatccgcgaccggcgcggttgcggcatcctgatggtcagccatgatctgcatctggtgatgtcggcgaccgaccatgtgctgtgcctgaacggccatgtctgctgttcgggccaccccgacgatgtcagccgcgacccggccttccttgccctgttcgggccgctgggggcggatgcgctggcgccctatcaccacgcccatgaccatgtgcacgaccatgtccacgggcccggggggtgcaccgcgggctgcgggccggacgaggtaccgcatgatcatgctgccgtcggccaccaccatcaccactgaccggaccctgtccccctgatgatcttcgacgcattcctgctccgggcgcttgccggcggcatcggtctcgccctggtgatggggccgctcggctgtttcgtggtctggcggcgcatggcctatttcggcgacacgctggcccattcggcgctgctcggcatcacgctcggcaccgtcaccgggctcggcttcgggccgggcatcgtgatcgcctgcctgtcggtcgcggtgctgctggtgatgatgaagcgtcgccagccgcttgccgaagacacgctgctgggcatcctggcccattcggcgctgtcgctggggctggtcgccatggcgctggccggcaatccgcgggtcgacctgatggcctatctgttcggcgacatcctggcgatccatggcggcgatctctggtcgatctggctgggcggcgctgccgtgctggcggtgctggcgctgctctggcgccggctgctgaccatcaccgtcgacgaggatctggcccgcgtggagggcgtgccggtgctgggcgtgcaactggccttcatggcactgatcgcgctggtgatcgcactcgccatgaagatcgtcggcgttctgctggtgacgtcgctgctggtcatcccggccgccgccgcgcggcggctggcgccaacccctgaggcaatggcggtgatcgcggccctgaccggcgccgtggcggtcacgctggggctgggcgcctcgctgttctgggatctgccgtccggacccgccgtggtggtggcggcggccatgatcttcggcctggtcaccctgctgccgcagcgactggtggcgccatagcccgcaaggcgcgccgcattaccctgacgtctggcatgcggcaacaccacgcgccttgatttttatgtgcgccaatctgaacctctctcccatcacggccgacagggagaggggcgaggctgatggcgaccatgatccatttcgcgaccaaccgcagaccggcaccgaagacggtgttctcggaaagcttcaacgacgacccggacgagctgcgcttcggcaccgcaagcttcgacggatccgcgctctatcgcgcgccgctggacgcggtcgccgccagtgccgaggtgacgatccggcccgagaatctggcccgcaatcgcctgggcagcaccgatgccttcgccgccattcgccaggccgtttccggcaatcgcgatgtgcttttgtttgttcatggttacaatcacagcttccgcgagtcgctggggcgggccgtgcagatccagcaatggctggccgatggcgggcgggacatggtgatggttctgttcgcctggccgtcgctcggccgcggggtgagcggccgcacctatcgggacgagcgcggccgggcgcagatgtcgggcccggcgctcggccggctgctgctcaaggccgccgatttcctgcgcgccggcccggccggggcgggggaccccggggcggtgtgcatcgcgcggattcaccttctggcccacagcatgggcaactgggtgctgcgtgggggcatcggccatatgcgcaccttcgtcggcgacaacattccgccgctgttcgacgaggtgatcctgacggccgcggacgaggacgacgacaccttgaccgcgccgaaaaaactggcgccgctgctgcgcggctgccgccggctgacggtctattacaaccagcaggatctggcgctgaaggcgagtgatgtggcgatgggcaatcccgaccggctgggcctgtcgggtccgctcaggcccgacaccctgccggccaagattgccgcgatcaacgtctctccggccatcctgcgcaatctgaccggggatcgcgcctgggaggacgacccgaccggccaccagtatttccgcaacaatgccgtggtgcgtgccgatatgctgcatgtgatgaccggcgcgctggacgaggacatcccgaaccgcagccgccgccctggctggtggcggctggggtaggggcgggtcggggccagggtcgggacggggcaggggtcgggacgggcgatcagccggcgggggcgatgcgcttggcggcccgccggcggttcagctcccagatcaccgcgcccagaatggtgagcgcgatcaggatcagccccagcgcattgaccgcgggggtgacaccggtgcgcaccttgcttgcgatatagacggtgagcggcgtatcgaagccgcgcacgaacagggtggtgttgtagttctcgaagctctgcaggaaggcgatgaaggcggcggccagcatggtcggcgccagaaagggcagggtgatgcggcggaacgaggtccaggggctggcccccagatcgcgcgcggcttcctccagcccacggtcgaagcgctgcagccgcgcctggaccatcagcatcacataggccgcgatataggtggactgggcgacgatgatcaggaacaacccgccgccgacctcgatctggcgccagaagaccagggtcgagatgccgatgatcacgcccggcgtcagcaggggagagaccatcagcgcgaagccgaagctgcgcgcccgcccgcgcagcccgtcgagcagcagggctgcggcggtaccgaccggcaccgtgaccgcgaccacgccggccgcggccagcaggctggtggtcagcccttcccacatctgcctgtcggaccagagggcgtcgaaccatttgagcgtggtgccggcccagggggtgatggtgggcaggcggctgtcgttgaaggtggccgcccccatcacgatcagcggcaggaagaggtagaacagaaacaggcccagatagagccgcatcatcatgcggcccagacggtcttcgccggtggcggttccggtgctcatctcgcgatgtctcccacgccgaccttgaacacccgcatcatgatcatgatgaagcccatgcagatcagcagcagcacgaaggcataggccgcacccatatgccagttgccgccctcgaagaaccagtcatagatgatctgggtgaaccagcggctgccgggcgagccgagcagggccggtacggcataggatccggcggcgagcatgaaggtcatgatgcagccggtggcgatgccgggtttggcatgggggatcaccacccggcggtggatgcgcggccagccggcccccagatcgcgggcggcctcgatctgcgcccggtccaggctttcgatcgcgttgtagatcggaaagaccatgaacagcacataggcatagaccatgccgaccagcaccgcgccgttgccgtcgatccagcgcaccggctgatcgatgacgccgaggccgagcagaaggccgttcagcggcccgttcagcgccaggatgatgtaccaggcgaaagtacgcagcacctcgttgatccagaacggaatgatcaggatcagcatcacggtcgccgcccgcctgcgggtggcgacctgggccaggtaataggcgatggggtagcaggcgaccagggtcagcagggtgaccagtgcgctcgcccagatcgtcttgatgaagatggcgaaatggatctggttcgagaacagcgcggcatagttggcgaagctgcggatgtcctccggtccgccgaccttcgagggcggcaggttggggcgcagcgaatagtccaacatccagagctgcggcagcaccaccaggatcagcacccagaccgcgctgatccccagaatggcgaaggcgagggccgggccgcgtcggcggatcatgtcacccatcggccagcaccaccgcatcctgcggcccgaaggcgaggccgatgcgcacacccggcgccagcggcggcagattgccgtcattgaccagctgggccaggaattcggccggtagccccggaccatggccctcgggccgggcgaccagatgcaggaaggggccttcgaagcgctgatcggtcaccaccgccggcagggcgccgatggcggagagaccctcggcggcggtcaggcgcatgcgttcggggcgcacgaacagggcggccggctggccggccttgagcggtgccggtgcgatgccggccatcgggccgaaggcggtgtcgaccaccgcctcgttgccgtccatgccggtcacccggccggggatgcggttggcctcgcccacgaagccggcgacgaaggcggtgcgcggccggtcgtagagttcggccggggctgcgacctgctggacgcggccggcgctcatcaccgccacctcgtcggacatggccagcgcctcgccctgatcatgggtgatgtagatgaaggtgacgccggtgcgctgctgcagggcgcggagttcggcccgcatgtgctggcgcagcttcagatccagtgccgacagcggctcgtcgagcagcagcacctggggctccaccgccagcgcgcgggcgatggcgacgcgctgacgctgaccgcccgagaggtcggtgaccttcttgtcggcgatgccgggcagggcgatcacgtcgagcagcttctcgacccgcttgcggcgctcggccgcggcgatgccgcggacttccaggccgaagccgatattttcggccacggtcatcagcgggaacagcgccaggttctggaagatcatggcggtcggccgctgttcgggccgctggccggccatgtcgcggccaccgatcagcacccggccggaggtcggctccaggaacccgccgatcatgcgcagcagcgtggtcttgccacagcccgaggggcccaggatcgagaagaaatggccgggggcgatggtcaggtcgacgtcgtcgacggccgcagggccggcgccgaagcgcatggtgacgtgttcaagggtgacgccgtggctcatggggtgccgtttcgtctccggtgggtggactccgaaagcggcgcccccgggcccgggggcgccgcttcaggccgttccggctcaggcggacaggaactggtcctgatagccgttgcgcttggcgacgaaccagctttcctgcaccggccaccaccacagcttgtccagcgcgtcgcccggataggcggcggcgaagaaggccttgttctcgggcgtcagcagcgcgtcggcgcccttgacggtggagttgtagcccatgtggttggccagcatcgcgcccgcttccggggtcagcagccagttgatgaaggcataggcattgtcgaggttgggcgccttggaggtgaggcacacaccttccatccaggccagcgcgccttccttgggcgccacatagccgaagggcaggccttccttggacagggcgagcgacgacgaatcccaggtctggccgatcacgcagccattggcgcggaaggcgccctgggcctcgttttcgttgctccagaactggccgacattcttcttgtgcttgatggcctcggcgatgatgacgtcgtagttcttcgtcatcgtggcctcgtccttgaagctgtcgcgatagggcgcgggcagcttgccttcggattcgagccagagacccaggcccgccagggccgaatgggcgcggacggtgaccttgccggcgaagtccggcttccacagatcaccgaagctggccttgccgtattccagcggcgcctgctgcttgtggaaggtcagcgcctcggtgccccagtcgaccggcacgatatagcgcttgccgctgatcacgccgcccatgccggccgagcccgaaatggtggcgggcagcaggcggtcgaaggcgaccttgccctcgtcgatcggctgcaccagctcgaactcgacatagttgggcacgcggtcgacggtcggccagatgatgtcgaaaccgccgccctggctggcgcggagctggttcagcagctcgtcattagtgccgtattcagtgcgcaccggggtgatgccggtggccgccttgaaggcgtccagcatctcgtcggtgacatagccggcccaggcgaagatccggacctcgccacctgccgcgcgggccgggttcaggatcgccggacccgtgagggcgagggcggcgccgccgagagccgaggccttgagcaggccacggcgggtgaaggcacgggccgcggcggcggtcccggccgccacggagttggcatcgaccttgtcggtcatcgtcggctcctctcgaacgcagtctggatccggcaccggggcgtatcgcccgacccggagggctgtttcaggcaggggctgcggagggtgaccttgtgcccggcgtacgtcttcccgcgatggactgccaatgcaggtcgacgttcacgctccccgaaacgctttcgctgcgcggggtagcatcgcacgtcaccgatcattcgcaaagacgggaccgcaccacctggggtggcggtctatcccggttgcgacggaggcccctcccgctccctgatccggcgcaccatagtccgattgcgtgtcgcttttttgacgacccggtatcgatccgtgacaccgcggcgaatttcggcttccgccgtggcgcggggccggtccgggcgctaaacttcggctccggagcccgtgctgcccgccacgcggattgtgcatctgcggtgccagggctccggcgcgcgacaccggacgttccggggtcccggagcgtctgacaccttggaacgagggaagccggccgatgaagacgatactggtccccatgcatggcgacgatggcgacgccgtggcgctcgagaccgcccattccgtcgcgcagcatttcaagagccatatcgaagccctgctgatccgccacgacccgcagatcctggccggtgacggcctggtcatcccgtcggactatctggtcgagatgggcaatcgctggcagaacatggccgagcgggtgcgcaaggtgtatgaggagacggtcacccggctgggcattcagaaggccgagatcgatgccggcggtgcggcactcggctgcccgaccgcttcctggcgcgagctttcgggccaggaagccgaggtggtcggccatcagtcgcgggtcttcgatctgaccatcgtcgcccgccccgacgatccggcgcgcgacctctggcgggtgaccgccgaggcggtgctgttcgacggcggccggccggttctggtcaccccgcaggccccgcgcgccgagctgggccgcaaggtgctggtcgcctggaacggcagcaccgagaccgcgcaatgcgtggcgatggcgatgccctggctgaccaccgccgacgaggtgctggtgctggcggtgaagggcggcatggtgcccggtccctcggccgaggaactggcgcggcatctggcccgcaacggcgtcgccgccggcgcgcgcacgctggacgagggtgaccgcagcgtcgccgaggtgatcatcgccgaggcccatgccatgggcgccgacctgatcgtgaagggcgcctatacccagagccgcttccggcagatgatcttcggcggcgtcaccaacgacctgctgcaccgttcgccgctgccggtgctgttcgcgcattgatgtcggaaccggggcgaggctcagccctcgctccggcccgatgcggcacttcctgcaaggccggcctcgatccgcggcaggcgggtccaggcgtatgcggcccctgccgccgcgatcagggcggccgcgagcaggggcagggtgatgccgaccagatcggcggcgctgccgatggcgagcgcgcccagcgccggcacgccgcgcatgacgacgagataaagcccgatcacccggccccggcggtcgggcggcgcatgcagctgcagcagggtctggatcgagatgccgttggaggtgatggcgaagccgaccagggtcagcagggcgatcgccaccggttcggtgggggcgagggccgacagcgccgtaccgacggcgccgagggcggtggccaccaccgccacctgcaccaggcgtcgttcgcccgcaccgatcgccatccacagccccgccgccagcgcgccgatgccgatggcggcggtgaaggcggcatagccgccggcaccggcaccgaaatggccatcggccagggccggcaggatctcgggcaaggcgcgggcgccgaggctggcgaaacagagcagagcgagcagcggcccgatacccccatggcgcacggcgaaggccaggccgtctcggaaatcggcgatcaggccggggcgggtggcggtgcgcgcgcggccgctgccggcgtcttccgccaccggtacgcgcaggcgaatcagctgcaccaggaacaggatcagcgtcagcggataggcggcaaaagcggccgtgccgtcctccagcgccagcagcggggcggcgatcgccgggcccaggaagcgtgccaggttaaagaggctggcattcagcgcgaccgcggctggcagatcgtcgcgcggcaccagttcgggcaccagcgccagacgtgccggctgaccgaaggcggtgaccacgcccagcaccagacccagcgccaccagccagccgatggtgatcagcccggtcgccaccagggtgaaggcggtcagggactggaccagcatcaggccctgggtggcgatgatcagccggcggcggtccagccggtcggccagcgcgccgaccgcggggctcaggatcaccgtcggcagcaactcgcacatggcgagcacgcccagccaggcgccggaccccgtcagcttccaggccatccaaccgatggcgaggcgctgcacccacatgccgatcagcgaggtggcattgccgatcgtatactggcgataggcgggtgcggcgagcgcacggaaaagcggcttcagccggttgcgggccatgggggggtgggtccgggagcggttggtgccgggcggtcacgcccgggcaggtatgccccgggattgtgggccggccatggcggggatcgcaagcccggtgacgggggcggcccgcagccatgcgcaggacgcaggcttgatcccgccgcccggctcgggcatggtccggcgatcaggacgggaaccaggggggagagggcagctgccatgaccatcggggcggaacggcccaggatcgaagcgatcctgttcgacaaggacggcacgctggtcgatttcgatgccagctggggccctgtcaatcgccgggtcgccgagcgtctggcgcggggcgatctccgcctggcccatcgcctgcttgaagcggccggccacgaccccgaaaccgaccgggtgctgcccggatccctgtttgcaatgggcgacagcatcagcctggcgcggacctggtcgcccttcctgcccggccagcccgatgcgctgcggctgtcgcgagagatcgatcgcatgttcgtgagcttcggcgccggcgcggcccagccggtctgcgatctgccggcgctgttcggcgcattgcgcgccggcggcctgcggctcggcatcgccaccaatgacagcgccgcaggggctgaggccctggtcgcccagtgcgggctgcatgcccatctggacttcgtcgccggctatgacagcggccatggcgccaagcccgggccgggcatgctgaccgcctttgccgccacgatcggccggcctgcttccgtggtggccgtggtgggcgacagcctgcacgacgtcgccctggcgcgggcgggtggtgcaggacttgccgtggtggtgaagggcggggcgcgcatcgaccccacggttgccgcggccgccgatctggtgcttgaccggcttgaggatgtaaccgggctggtccctaagctcgcggccggctgagcggtcggctcacccgagagcgggggccgccagaaacaggatcaccatcccggccgcaagccccgggccgaaaggcaggcggcggtcggccgagaccttgaccgcgagcagccccgccagggcgacggtgagtgcggcccccagcgccagcccccagggcagcgccgcgcccagccaggcaccgccggcggccgccagtttcacatcacccatgccgatgccgtcgcgcccgcgccccagccgataggccatggcgaccagccacatgccgccgaagcccgcggctgcggcaagcgtgcgctcgcccagtgcggcatcgtcgggggaggcgagcagacccaggatcagcagcccccaggtcagcggatcgggcaggcggccctggagcagatcggccgcgccgagggcggcacagccggcggccaggatcgcgacctgtgctggcggcgcgggagagccgatcagcaggccgaccagaaccgccagggcggcgagcagcccggcgcccagggcggcacgaccgggggaggccggcggcgtccagccgaagccgtctgcctcgggtgcgatcgcccctgcatcctgccggttccgctggtgccgccaggcctcggcatcctcttcggccgtggtggcgcggcggccgcgggtgatcaggcggcggagatgatcgacgcgcgatctgacggggccggcgcggccttcattgcgggcgatggcggcggcgatggcatagcgggcgaggccccagccgcccgcggcagcggcgagcgtcggaaccaggccctggatcatgccgctcatcgccacctccccatgacaggctacatcatcggcatcgttcagcgtggcggcagggccgccgtgccggcatcgatcgcccagaccaccagctcctgcaggaaccggtcggtcgcggcgtcgaaggcgttgatcaccggctgcacgccgtcggtcacggccggctggcggatctcgaaccgcttctgggccacgatccgccggtcgggcatggtgaccagccgggtgttgacctccagccggatcaccggtgcgcccgcgccttcggccgggtactgcgcctgatagttcagcagttccgactgcagggtgaaatcgggcctgagcccgaccgaggccggcgccaccgagacatgcgagcgggcgttcaggaaggcatcgaccatcagcgactgcatcatgccggtggtgcggtcggtccagttggccttggcgaaatagccgatctcggaccgtccgcgctgcaacaccacccgcgaggtatccagggcggcggaggccgtgggccgttcgaccgacagctgccagtccgggccgccggtcgccacccccgggatctgttcgggcgccgtcagacgatagagctgcggcggatcgccgagcagcagcgagcccggcgagcaggcggagaggacgagcgccgcggtggcggcgagcatgccggtccgcaacacggcgcgacggttgatctggggtgcggtcgcgtcagtcaccgggggtgtatccctgttgctggccgccgagcaggaagcgctgcgggtcgcgctcgatctgcacggcgaggctgttcaaggtggtgacgaggctgcgggcctcggccagcagcgccgtcagttcataaaggccgttggacgtaaagtcgttgatcggcgtgcggttttcgtcgatcaggctgttgaggttgcggttggtgccgcgcagctcggtgagcagctgggtcgccccctgatcgatattgccgactgtgctgcgcagctcggtgagcgtccggctcagctggctgtcgagattgcccgccgtgccttcaagcttcgtcatcatgccgtcgaagcgttcggcggcggcgcgggccgccgcgaccgtcgcctctgcatcagccatcaccttgtcgagccgttcggggttctgcgcgatcgcaccgctcaccgtcttcagatccgacagggtggccgtgatcatggcgcggttttcgggaccgaagacctcgttggcctgatcgagcagggtgatggcgcgcgagatcagatccggagcgccggcgatgatctggtcgatccgcgaggccttggacgggatcacccgatggccgctggggctttcggcccgtatccccgtggtggcgagtgcaccggaatcatcggtgtcgagcaggatataggcgccgccggtgatgccctgcagggcgagcgtcgccacggtgttgggaccgatcggcgtggtctcggcgatgtcggcggtgaccaggatgtaatccgggttctggggcgcgatgcggatcgaggcgatctgccccaccgggatgccccgatagctgaccggatcgccggtcctgaggccggtgatcgcctgggcgaagaagatgtcgtactgggtataggactggtcggagcggctgcccgccacccagagcacgaagcccacgagcccgatgagcaggaccagcacgaagctgccgacgatcagatgattggcacgggtttccatcggtttcgtccccggtgttcaacgggccggcggcgcatccggccgcgcctcgggttcgggagtgccggccgaagcccgcggcatctccgtcgccctgagcgcggcgcggccgcgcggcccgccgaaataggattgcagccatggatgcgggtcgcgggcaagctcggcgatcggcgcaatgcggatctgcttgtcgacgagtgcggcgacccggtcgcagatggcgtgcagggtgtcgaggtcgtgggtgaccagcatgacggtcacccccagcgcgtggttgaggtccaggatcagctggtcgaagccctcggccgaaatcggatcgaggccggcggtcggttcgtcgagcaggagaagctcggggtcgagcgccagcgcccgggcgaggccggcgcgcttgcgcatgccgcccgaaagttccgagggcagcttgccgccatcccccggcttgaggcccaccagcaccagcttctcgatcgcgagccgatgcgcggtgtcggcccggacattggcatgttcgatcagcggcatggcgacgttttcggcaatggtcagctggctgaacagcgcgccgtcctggaacagcatgcccatgcgccgctggcggcggctgcgcgcggcatcgtcggagccggtgatttcttcacccagcaggcggatgcggccctcggccggatggatcaggcccaggatcgtccgcagcatcaccgacttgcccgagccagagccgccgaccacgcccatgatctcgccgcgatcgacggtgaagctcagatgatcgtggatgacggtgctgccgaagcgggtcaccagcccctcgacctcgacgatcggttccccggagggtttgcgtgtcgaactggtcatgccctcacacccccaggatcgagaacaggaccgagaacagcgcgtcgagcaggatcaccacgaacacgccttcgaccaccgaggcggtggtcgcccggccgacagccgccgccgaccggccgacccggaggccctggaagcagccgatcaccgcgatcatcgccgcgaagatcggcgccttgaccatgccgaccaggaaagtggtcagcgtgatcgccgtgccgagctggcggaagtactgcgaaaacgagatgtcgagggcgagcagcgccatcaccgcgccgccgaagatgcccatcatgtcggcgaagaaggtgagcaggggcagggtgatcatcagcgccagcatgcgcggcatcaccagcaggtcgaccgggtcgaggcccagcgtgcggatcgcatcgacctcttcgttcagcgtcatcgagccgatctctgccgtgaaggcactgcccgagcggccggcgacgatgatcgccgtcaacaggatgcccatttcacgcagcacgccgacaccgaccagattgacggtgaagatctcggcgccgaactggcggagctggtctgcaccctgataggccagcaccacaccgatcagaaagcccagcaggcctacgatcggcatggcgtccaggccggtgcgctcgatatggctgaccagcgccgtccagcgcatccgccgtggctggaagacggtgcgcatcagcgcgatggtcacgaggccgatgaaggccaccaggtcgcgcgcttccttgaacgccccgatcgtggcgcggcccagggtttcgaccatgccgaggaagccaccggcacggcggcgggtgccgcaatcgaccgaggccgccggcatcaatgtcttcagcagatcgcgataacggtcatcgccgccggcgaccgcaagccggccgtcggtctgctcaggggcttccgagacaccggcgagcgtcagcagcatcagcccgccattggcatccatggcggtgacctcaccgatatcgatctcgccggccggcggttccttgccccgccggatccgctcgatccggtcgagccttgcggtcgtccagtcgccgcggaccacgagcctgcgcccgtgggggccgtcggtccagctggcctcgggccaacgggtctcgggcgaattggtctgtgtgatgtcggaagcgtcggatcgacgcggtccggcgcctgtcggcatgcacctctcccggctgattgcctcacatccgcgccaagttagtcggtttccgggtggaaggccaagccggcgcgacgtgactcaatcatgttacacgggatcggactgttcggatgcgccacacatcactttttttgcgccgcagtgtaaagcccggcatgctcgctccgcagccgcgccttttcgatcttgcccatggtgttgcgcggcagccggtcgaccaccagcacccgcttcgggcatttataggcagcaagcgcggcacgcagggccggcaggatccgggcctcgtcgggccggggcgccccctgggccggctccacgacggcggtcaccgcctcgccgaaatcggcatggggcaggccgatcaccgcgctttcgcccaccccctccatgtcgtcgagcaggatttcgacctcgcgggggtagacattgtagccaccggtgatgatcaggtctttcgaccggccgacgatcgacagccggccgtcggcgtcggcgcgggcgagatcaccggtgcggaagaagccgtcagcggtaaaggcctcggccgtcgcttcggggcggtgccagtagccgcggaacaccgccggcccgcggatctgcagctcgccggtctcgccggccggcaggggcatgtcgccggcgccggcgatccgcgcctcgatgccgggcagggggtagccgatgctgcccgggcggcgctcgccgtcgagcgggttggacaccacgatgctcatctcggtcgcgccatagcgctcgaggatggcgtggccggtggccgcttcgaatcgtcggaacagatcggggccgagcggggccgaaccggcggtggcgagccggagcttcagacagtcggcggccccgaaacccggcaggtcgagcagccgggcatagaaggtcggtacgcccatgaacaccgtcgactcgggcaggcgggcccggaccgtctccgcgtcgaagcgcggcagcaggatcatgctgccgccggcggcaaggatggtgccggcggcgacgaagaggccatgggcatgaaacagcggcagggcgtgcagcagcacgtcggacgaggtcatgccccaggcggtgcagagagtctcgacattgctgcgcaggttgtcgtggctgagcagcgcacccttgggcctgccggtggtgcccgaggtgtagagcatggccgccggatcgtcaggcccgagctcaggtgcaggtgccgccacgccgcccgcgatggcggcatcggccgcggcggcgagatcgccctcgccccgggtgccgagggtgcgaagcgcggtgccctcggggattgccgcgcggcattgatcgaccgctgccgggtcggtgacgaagatccggggggcggcatccgcgagcagggggccaagttcggccggggtgtaggcggtgttgagcggcaggaacaccgcgcctgcccgcagcgtgccgaggaagagggcgatggcatcgacgctcttctccacccgcaccgccacccggtcgcccggctgcaccccggccgcagccagggcggaggcgaagccccgggcccgtaccccaagcgcccgcgcggtcaccgtgccgccatcgccggtccggatggcgatggcgtcggggctgcgggcaaggcccgcatcgatcagggcgtgcagggtacgggtcatcggctgagggcttccggtggtgatgcgggtgaaagcgggagggtcagttgccggtgaaggcgggcgcgcggcgctcggtcagcgcggccagaccctcggcatagtcggcgctgccattgcaggcggcgattgccgcgcgggcggcggtgacggcggcggcgtcctcggggcgggtggcggcgcggaccgagtatttcgacgcccggatcgagagcggcgcgttttcgcgcagcgtgtcgaggatggcctcgacatggccgtcgagcgcgtcgaccggcagcacggcgttcaccagccccatcgccttcgccgcggcggcgtcatagcgctttgcggtcatcagcaattcgcgggcgggggcggcgccgatcgcgtcgaccagccggcggacgccggtttcgtgatagccgatgccgagccgggcggcggggatgccgaaggtcgcacgctcgtcggcatagcgcaggtcgcaggccagcgcgacacccatgccggcgccgatgcaggcgccgtggatcagcgcgatggtcggcaccggcatcgcttccagggccgccgaggcggcttccaccgccgcatcgtaccgcttcggcccctcggtgcccgaccgggcctcgttgaactcgctgagatcggcgcccgatacgaaggcgcgctcgccatggccgcgcacgaccacggcgtgcagctcgcccggcctcatgtcgcgcagcccggccagatgctctgccatcgccacccacatgccgtagctgacggcattgcgcttggccgggttgcggatttccagcacggcaacgccgcggtcgagggaaagcgtgaccgccggggtgtcggcggcctgggtctggtcggtcatctgtctgccttccggggaggggatctgtggggcgtgaagtccgggtcgaacgaaaactcagccggtctcggcaaggccgggcggcgggcgaaggatgaagtcgcgcagcacatcgccctggatgacgacatgggcgcgcatcagatcggcggcgcggtcggcctctccggccagaatcgcggccatcacctcgccatgctcgtcgtcagaccggccgagccggccggggctgcggccctgatgcaggcgatagggccgcagccggtcgcgcagccgctgggtttcctgttccagatagcggttatgggcggcttcgtagatcagctcgtggaagcgctcgttgacctcgtaataggcgttcacatcgcccttcaccgcctgggcatgggcgtcggcgcaggcctgctgcagggcgacacggccacgctcggtgatccggcgggcggcgaggcgggcgcagagcccttccagctcggccatcacctcgaacatttccagcaccgacgacatcgtgggccgggcgaccaccgcccgctgccgggggcgggtttcgatcagcccgctttccgccagtcgccgcaccgcttcgcgcaccggggtgcgcgagacgccatagcgttcggcgagatgggtttcctcgacgacggaacctggcggcagctcgcccgacaggatgtcgtcggccaggcgcttctgaacgctttccgcaatcgtcgggcggcgtgggcgggtctgctcggtcatcgggtcccggatccggtttgcgggtgcatgcgtctgcacattctagggtgcggtcgtccaaagtgtcgcggcttcgggtgcggcgcaacagtattccttttgcagtgcaatgcatcccgtatttagaaaagtatatacactttgatcggcgccgcctacactgatgttcatcacgaagcctgccgggcaaaccggcggcgatccctcggggaggaccttcatgaaagtgatcctggccggcgccgaccgcctggcccgtgccgcctttgcactctcggccgtgctggtgatgtgcctggcggtgttcgtgttctacgaggtggtcgcccgctacgtcgtcggccggccgaccatctgggtgaacgaggtcagcggctatctgctggttgcgaccaccttccttgccggtggatgggtcctgcgccagggcggccatgtccgcatggaaatgctggaagaaatgaccgggccgcggggtcgggcggcgctggcgctgttcggcaacctgatcgccggcgccgtgggcgccgccatgacctggaccggcgcctggatggcctatgacagctgggatttcggctgggaaagccccaccatgctcgccaccccgctctggctgccgcaggccgcgatcccggtgggggcggcggtgctgaccctgtcggcgcttgccggggcgctggatgccgtcacccgtctgaccggttccgccgcggcacccgaggtgcggtcatgaccggtggcgtcgtcgctcttatcctgctgctgggcttcgtcttctttgccgtaccgatcggcttcgcactgtcgggtgcgacgctggccgggctgctcgccttcggcgatgcgggggcgttgaccgcgctttccaacatcagctggggggccacctcggaattcgtgctgaccgcggtgccgctgttcattctgatgagcgagatcatcagcttcaccggaatcggccgcgacctgttcctggcgatcgagcgctggctgggccggctgcccggagggcttgccatgaccggcgtggtggcctgtgccgccttcggcgccgtcgccggcaccggcgtcggtgtggccgcggtgatcggcggcgtggccatccccgaaatggtccgtcgcggctatacgcgcgagatgtcgaccggcacggtcgccgcctccagcgcactcggcatgatcattccgcccagcctgccgctgatcctctacggcgtggtgaccgaaaccccgatcgccgatctgttcctggccggcctggtgccgggggcgctgatcatcgccgccttctgcctgtacatcatggtcgccgtctcgctgggccacggcatcgagcccgacgcgccgcggccgcgcttcacctgggcggagcggctggcctcgatccgtctggccggcccgacggtggtgctgatcgtggcggtcatcggcagcatctatgtcggcatcgcgacgccgaccgaggcggctgccgtgggcgtgatcggcgcgctgctgctggcggcggtgtcgggcaagctcagctggccggccttccgcaccgcacttgtcaatgccacccgcacctcctgcatggtgatgttcgtgctgatcggcgccatgctgttcggctatctgctgggcctgctgcgcgtgccccaggggttgagcgactgggtgctgcatatggggctgtcgcgctgggccgtcttcgctctgctgatggccgcctatttcgtgctcggcatgttcctggaggtcacctcgatcatcctgatcaccatgccgatcgtgtacccgaccatcatcaagctgggtttcgacccggtctggttcgcgatggtgctgatcgtgaacatgtccttcgccgtgatcacgccgccggtcgggctctgcctgtatgtcgccaaatcctgcctgcctggtaccagcatttcccaggtcgtgcgcggaacgttgcctttcatggggctgctggcggcggtgatcgtggtgctctgccttttccccgagctcgtcaccggcttcatccgctgacgcctgccggccggcggccccgaggctgccggcccaaaacccaatgacagtcgaactcgtccaaagggaggacacgccatgcccctgttccggaccaatgcgcgccgcccgcggctgcgcgcccggctcgccgccggtgtcgccgcggcgaccctcgccctgatctcggccggtgccgcgagtgccgccgaggtgacactccgcttcggccattatttcgcgaccgaggatttccgcggccgtaccgcgcagtacctggccgaccgcatccagaccctgtcgaagacgatcaaggtcgaggtcttcccggccgagagcctggtgaaaggccgcgaaggactgcaggcgacggctcagggcaccgtcgacatgtattccatctatgcgggctacatcaccggccaggccaagctgctcaacatcttcaccctgccgttcccgccggcgagctatgacgatgccgcccaggcgaagtttgcgtccgatccggaggtccgtgaggtcatcgaccgctcgctcggccgcttcggcgtgcgcatgctgggcgtgatcaacagctcgggcgatgtcggcatgttcatgcgcgacccgatcgagagcgtcgccgacctgaacggccgcaagatccgcggcgccggcggcctctccgacgaagcgctgcgtgccatgggcgcctcgatcgtgttcatgagcgcggccgaacagttcctggcgctgcagaccggcacggtggacggcatcgccaccacctggtcgtcctatgtgaacaacaatctcgcgaccgtcgcaccggtgcatgtcgacgccaatctggtgcgctcgccctatctgctgatcatgaacggccgcaaatggcaggcgctggatgccgagcagcagaaggcggtggaacaggcagtggccgagaccatcacctggtcgaccgagaacttcaaggccgagcaggacaagctttatgccgagatcaagaagctggccaaggtgagccaggatctctcggccgaggatcgcgcccgcatcgacgagctgatgaagccgatctatcagggctatgtcgatgcccatggcgaggacggcgccaagctgatggagctgtggaagcgctatgccggggtctcctgatcgggatcaggtgggccggacggcaggcgagggggccccgcgcggccccctcgccgggctgaccgtgctcgacctgtcgcgggtgcgctcgggcccggcggcgacgcgactgctcgccgactggggtgcacgggtgatccgcatagaaccgcccgagaccgcttcgggtggcgacggcatgatggggcgcgagggcagcgatttcgccaatctgaaccgcggcaaggccagcatgacgctggacctgaaggcgccggaggggctggatctcttccgccgtctggtcgcgcgcgccgatgtggtgatcgagaatttccgccccgacgtgaaacagcgcctcggcatcgcctgggaggatctgaaaccgatcaaccccgccctggtgatggcctcgatctcgggcttcggccaggacgggccctatgccgggcggccgggtttcgaccagatcgcccagggcatgggcgggctgatgtcggtgaccgggctgccggggcaggggcccgtgcgagccggcatccccgtggccgatctgacggcggggatgttctgcgcgctgggcatcctggcggccctgctgcatgcgcgtgcgaccggcgagggccagtggctgcacacctcgctgctggaagcccaggtcttcatgatggacttccaggccgcccgcaccctggtcgagggcgaggtgccggcccaggccggcaacaaccacccgacctcgatcccgaccggtgttttcccgaccgcggaccggccgatcaatctggcggtggcaggcgaggtgatctggcagcgcttctgcaaagtggcagagctggagcatctggcagccgatccggatttcgccgatcgggaggcgcggctcgtcaatcgtgaccggttgaatgggctgatcgccgagcggttgaaagcccggacggcggacgagtggacgcgtgtgttcaacgccgccggcgtgccggccgggccgatcaacgacatggcccaggtcttcgccgatgaccaggtccgccatctgcggctcgcaacccccgtcgacctgccggggcacgcggctggcagcacggcgctgctgcggctgccggtcacgctgaccacgaccccgggcggcatcgcggggccgccgccggcgctcggcgccgatacggatcgcgtgctgagcgatctgggtcttgcagccgatgcgatcgacggcttgcgggaccggggcgtcatctgatctgatctgaccggtccgtcaccgtcctcgatcgaggggaaacacgcctatgtccatgcccgaagccgggcgcatccgcgtcgacacccagggcgcggtcgccaccctggtcatcgacaatcccgaccggcgcaatgccatcggcctgcacatgtggcacgcgatggcccaggcgctggacgagctttcggccgataccagcatccgcgccctggtgatccggggcgagggcagccgtgcctttgcctctggggccgacatctcccgcttcgaccaggaacggtcggaaccggcgggcgtgcaggcctatgccgaggccacgaggtcggtgctgcatcgcatcgcccgcagccggctgccggtgatcgcgatgatccacggcgcctgtgtcggcggcgggctcaacctcgctctcgcctgcgatatccggatctccgacgagcatgcggtcttcgccattccggcagcgaagctgggcgtgggctatggccgcgaggcgctggcccggcttgccgccgcggtcggcccggcccgggcgcgggaaatggtggtctcggcccgccggctggaggcgagccaggccctggcctgggggctggtgtcggatgtggtgccgcatgtggcgctggccgatgtggtcaccgaacgggcccagatgttggccggtctggcgccgctgacgatcatggcggccaagctgtcggtcgaacatgtgctgctgggcgacccggccatggccgaggccgccgatctggcggtcgatgcctgcttcgccagcgacgactatgtcgagggtcggcgggccttcggcgagaagcgggcgccggtcttcgacggcagatagaggcacgggccgttccctataatgcggcgaggttgcagactgccggcttgacgtcggaggcgacctcgccggatcatcggcgggtcacgcgaccagccaggggagtgccggtgttcactttcgacggcctgcatccgcaggcgcagctgttcatcgacatgctgcgcgccagcccgccaccgccctatgaccagatggcgctgggcgaggcgcgtgccctgttccgcgacaccatgctccgcttccgcggccctgtgcagggcggtgtggcggtaaatgccctggtgctgaagggggccgccggcgaccggcccgcgcgcatctatcggccggatggttgcgacggaagccctgcgccggccctgctgttcctgcatggcggcggctgggtgctgggcgatctggatacccatgacgacatctgccgccggctggcggtcggatcgggggccgtggtcatctcgttcgattatcgtctggcccccgaacatccgtttccggccgggttcgacgatgccgtcgcggccttccgcgatctggcggggcgggccggcgcgctggggctcgacccggcccggctggcgatcggcggtgacagcgccggcggcaatctggccgcggcggccgcgatcgcgctccgcgatgccggcgatgcggtgcagccggtcttccagctgctgatctatcccgcaaccgatctgggcactggcgaaaagcgcgagaagaagcccggcgaaggactgttcctgaccgagcggctgctgcgctggttccgcgcctgctatatccccgatcaggctgtttcgctggaagatccgcggctgtcgccgatccacgcgccaagcctggccgggctgccacccgcccatattctgaccgcgcgtttcgacccgctgcagagcgagggagaggcctatgccgcggtgctgaaggcggccggcgttgcggccgaccaccattgcgccgaaggcatgttccacggcttcctgcacatgaccgcctggttcgcggatgcgcgcagcgccattgacggtctggcccggcggctggcgcaggggctggctgccacgacccccgggagatgaggcggtgatgcctggcctgccgcaggttctgctggtcagacccgagggtgatgccctgaccgccgccgcctggcggaccggccttgccgccgtgaccgcgacgccgccgatcgaggtgacggcgtctgatctgccgggacgcctggccgatcatccggacctcttgatcgtgatgccgctgcgccggccgctgacggcggccgaggacgggatccgtgccctgctcgggcggctgccggcccgccggctgctggtggtggcggccgaaggcgaccggccgccggccgtgcttgccgcgggcctgctggcggccggggcggccggtgtgctggatgatccgggcacgcccgaggcgctgtttgccgcggttgcccgcagcctgctgcggattgccgatggcggccgggtgctgcccgaccagcccgacgcccagggcccgggcgccgaacttgccggccggatcgccgccgaaatcgcggccatcggctggcgccgccccccggccgacgaagacgaccccgaaccggtttcctgagcgcctacctctcccccctgaaaggccgaccatcatgagcctgcccgacgatctctgcttcgccgacgcatcatcgctggtcgaggcctatgccgcccggcgggtttcgccggtggaggtggccgaggcctgccttgcgcgcatcgccgaggttcagcccgagctgaacccctgcgccttcctcgaccccgaaaccacccggtcccaggcgcgggcttcggaactgcgctggatcgcgggtgagccggcggggccgctcgacggcgtgccggccaccatcaaggacctgctcctctcggccggctggccgacgctgcgcggcagccgcgcggtcgaccccgggcaggactgggacgaggattcgccggccgtggcccggctgcgtgaaagcggcgtggttttcaccgccaagaccaccacgcccgaattcggccacaaaggggtgaccgacagcccgcttgccggcatcacccgcaatccctgggacagcgaccgcacacccggcggctcgtcgggcggggcggcagtggcggcggcgaccgggctgggcgtgctcaatatcggcaccgatggcggcgggtcgatccgcatccccgccagcttcaccggcattttcggcctgaagccgagcttcggccgggtgccggcctggccggccagcccgctgtccagcgtgtcgcatgtcgggccgatgacccggaccgtgcgcgatgcagcgctgatgctggcggtgctggcccggcctgatgcgcgcgactggtacgcgaaaccgtttccggtggaggatttcaccgccgagctggaagagggcgtgcgcgggctccgcatcggctatgcgccgaccattaatgacgagccggtcgacgacgacgttgccgccgcggtcgatgccgcgatcgacgttttccgtgccgaaggcgcgatggtcgagccggtgacggtggatctgcccgaaacccgccggatctttcagatcatctggaccacgggcgcggccctgatggccgcgggcatgagcgacgaccagcgccgccggctggaccagaccctgatggcggcggccaatatcggccagggcttcgatgccgtgacactcgcccaggcgcagttccgccgcgcggggctggcggcgcatatggccgggctgcatcggcgcttcgatgtgatcctgacgccgaccctgccggataccgccttcaaggccgggcgcaaccatccgggcgatccggcggcgaccacctggaacgactggacgccctttacctacccgttcaacctgaccggccagccggcggcctcgatcccctgtggcttcgatcgcgacggcctgccggtcgggctgcagatcgtggggccggtgggggcggatgcgctggttctgcgggtggcgcgagccttcgagcgggtgcgcccgatccccctgccgccgcgcagcgccgaagactgagccccgccgtcactggcgggaaaataaaccatgggtataatgatcgccggatagagttctcaaaacgagaagagtgccagaacgagactggtccggacgctcagacctgcggcggctcgtgcccggtggccgggatgtcgcgcagacaggagaggacgatgacggagatcatcctccatcactacgattcgtcgccttttgccgagaaggcccggttgatgctgggcttcaaggggctgacctggaattcggtggtccagccgatctgggcgccgaagccgaagctgacgccgttgaccggcggctatcgccgcacgccggtcatgcagatcggggccgacgtttatgtcgacaccaatctgatcgccgaagagctggagcgccgccatccgcagccgaccctgttccccgagaacggcaccgccgccggcggctggggcggcctgctcgccttctcgctctgggccgagcgcatgctgttctggccggcggtgcgctatgccatggcgttcaatgccgacaagctgccgccggaacttctggaagaccgtgcgcggatgaacggcgcgccgcgggccgatgtggagcggatgaaggcggcggcgccgatgttcaaggaacagctccacaatgcgcttgccgtgctcgacgatgcgctggggcagggcacgctctatctgttcggcgacgagccgagcctggcggatttcgccgcctatcatccgatctggttcctagagaacaacggccgcaaggtcggcggggtgatggccgaatatctgaacgcccaggcctggaacggccgtgtgcgtgagttccgccacggcacgcgcatcgagatggagccggatgccgcactcgccatcgcccgcgaagcgaccccgctgccgcccgagacgatgggggaggcggacgacaatgccccgcagcccggcaccagtgtgacggtcacgcccgaggatttcggcaaggacccggtggccggcgaggtgaccgcgatcagccggcggcggatcagcatccggcgcgaggatcccgcgctgggagagatcgccgtgcacttcccccgcatcggctacgttgtccgacccgcctgaacggtataccgtaagcgccgcctgccggatgccgcccgcgagcccgctcgcgggcggcatcgtcgcgacggccgccccacatcccttgccggagccgttccatgacacggatcgtcgactgctacctgccgctgatgtcgccctgggcctatctgggccatgaccgcttcgtggcgatcgccgatcgtggccgcgccgtcattcgctggcatccggtggattttgcgaagatcttcgcagcgtcgggcggggtgccgctgaaacagcgcccggtgcagcgccagacctatcgcatgtacgagctgaagcgctggcgcgaccggctgggcgtgccgctggagctggagccgcgcttcttcccggtcgacgacacccgggcggcgcatctggtgctgcaggccatggccgagggcgtggatcccgccgggctgatcggcggcgtgctcggcgcggtctgggccgaggggcgggacatcacggataccgaaacgctcgccgacctgctgcggcgtgaggggctggatgcggcgctgctcgatcgcgccgatgcggcgaccgcggatctggcggcgaagcgcgccgccatgaccgacaatgccattgcggccggcgtgttcggcgcgcccacctatatcttcgacggcgaacccttctggggccaggaccgtctcgacttcctggccgagcgcctgggcgtcacgctggattgacgcccgccgccgccggaccatctctccccccgcatcgggggcaaacacaacaagacgtcctcccctgcgccgcccgcgcgccgacgcggcggaccctatccttccgcttccggagatgagccatgcctgaccagaccatcatcgacgtcaagggtgcccgggttccggcgctcggcttcggcacctggcagatcaccggccgggcctgcgtacgtgcggtgcgcaccgcgctcgacctcggctaccggcatatcgataccgcgcagatttatgacaacgaggccgaggtgggcgaggcgatcgccgagtccgcgatcgaccgctcggaagtcttcctgaccaccaaggtctggtatgaacgactggccgccggcacgcttgaggcatcggtggacgagtcgctgaagaagcttcaggtcgatcaggtcgacctgctgctgatccactggccgaacccgaagatcgatctggccgagaccatgcgcgcgctcgaaggcgtgaaggcggccggccgggcgaagctgatcggcctcagcaacttcccggtcgcgctgatgaagcgcgtggtcgaagagctgggcgtggacgtcgccgccgatcaggtggaataccacccctatctgaaccaggatccggtgctggcctatgcccgtgcccatggcatgatggtcaccgcctacagcccgctggcccgcggcaaggtcgccgacgacccggtgatccgcgagatcgccgaggcgcacgacgcttctccggcgcaggtggtgctgcgctggctgatcgatcagcccatggtcagcgccatcccgaaggccggcagcgaagcccatatccgcgccaatctggcagcactcgacatccggttgagcgatgccgagcgggcgaagatcgatgcgctgcgcggcaacggccggatgatcaatccgtccttcgcacccgaatgggatgccgcctgaccagcagtgacggccggcgcagggcggggactaccctcccagcgccggcctccgcgtctcagtctgcgaaaccctggaaggttgcgaagccttccaccggttcacgcggggtctggagccgggcggtcacgtcgtcgggatcgccatggcctatggcgatgccgcagaccacctgttcggtttcgggatagccgatctcgtcgcgcaggatgccgtcatacatggcgaaggcggcctgcgggcaggtctgcaggcccatcgcttcggctgccagcaggacctgaccgacgaagatcccgacatccacccaggatccctgttccatgtcgcggtcgatggtgacgatcagcccgaccggggcgtcgaagaaggtgaagttgcgccgctcctgcgcctgcatgcgatcctgatcgcccttgccgatgccgagcaggccgtagagcgaccagccgagcgcccgacggcgatcctgatagggcgcccgccacttcaccggatagtatgtatagccccaggcggcgcgcggggcgccggcggcgtggtcggcggtcagtgcagccaccacgcgcgcgcgggcggcaccggccaggacgtggactttccagggctggatgttcgatccgctgggggcgcgggccgccagggccaggatccgttccaccgtctcccgcgggaccggatcgggtcggaaggcgcgggtgctgcgccggccggccatggtttctcccacgcggcgcgatgcagccgccacggctgcggcgatacgggccggatcttctgaattcgtcatgggttccgtccatgtttcctttactctcgtcgggcagaatgccatgaaaattggtccgttgcgccctgcccgacgcgcttcggaaccatgtgtggtgcggcggcgacgttcgcgccgggtttccggtgacggccttcggaagggcggctgacatatgtttctggagttcgtccacggcgctggcgggcactatgccgaaagcggctacgatacgcggctggtcgtgctgtcggtcgcggtcgcactgttcgcgtcctacgcggcgctgcagaccgtcggccggattccaactgcagggccccggatgcgcgccgtgtggatcacggctggcagcgtggtgctgggcggcggcatctggtcgatgcatttcatcgggatgcttgcccatgaactgccctttccggtcgattacgacctgaacctgaccgtcggctccctgatcatcgccgtgctgatgacgtggctggggcttgcctgggtatcgcgggccgggaaccacccgggtgccctgctgggcgccgggatcaccaccggtgccggcgtggtgggcatgcactatatgggcatggaagccatgcgcatgcccgcccggctgctctacgagccctggaccttcgcgctgagtgtcgccatagccctggtcgcggcaaccgcagcactggccattgcccggcgggaggtttccatcccggccaagctgggcgcatcggtggtcatggcggtggcgatctgcggcatgcattacaccggcatggcggcagcccgtttcgaacccggccagaccatggcgctcggccggctgctctggctcgaggcgtccgcctatgccgtgcatccccaggtgatcgccgtgctggtggcggtcagcgccgcgctggtggtgaccatcatcatcgcctcggccaccatcgacaaacgcttcgccctgtcggccgcgcgcgaggcggagacgctgcgcttgggcagccggcggatgtcggcgctgctggccaccggatccgatctgatcgtggttgccgatgccgatcacgcgatcagggatgtggtgggcccggccgatctggttgcgatcgcccgcgcccggcccctggcgcggatggtggtcaccgaggatcgggagcgcctgcgcgcgctgttcgagcgtgtgctgaccggtggcgaacgcacggcgaccgaggaattgcgtgtcgatatgggcgcccgaggggtgcgggcctgcgacgtgaaactccgcgacctgcgcgacgaagcggcggtggcggccctggtggtgaccttccacgatgtcgaggaacgcgccgcggtgcaggcggcgcttgccgaggcgcgggatctggccgatgcggccagccgggcgaagtcgcgcttcatctcgatgatgagccacgaactgcgcacacctctggcggcggtgctgggctatgccgatctgatgacggcgcgcctgcatgggcccctcggttccgaggtctatgacggctatgtcgacgagatttcccgcgccggccggcggctgatttcggtggtcgacgcgatcatcgggctcggtcggatcgacggcggcgaagagcgctgcgagctgcgcagcttcgatgcccagtccgccatccggtcggcgatgcggagtgccgcagatcgggcgcgtcgcggcggtgtccggctggaccatgtcgatgacgggccggtggaggttctgggcgatccgcggctggcggtgcgggtgctcgactatctgatcgacaatgccatcaagttcaccgaggccgatggcgaggtggtgctgctggtggagcggcgcgaggacggcaccggcgcgatcaccatcaccgacagcgggtcgggcattccggccgacagcctggaccgggtgacggacgccttcttccaggccgatgacggcctgtcgcggcgcttcgagggcgccggtcttggcctgaccgtcgccaaggccctggcggaattgcagggcgggcggatcgagatcgagagcacctacggcttcggcacggtcgcgcggctggtgctgccgctgtcggacgatgccgggcccgacggcccggccggtccggacgccgaggtggaggatgccctgggctgactgccgtggcgggcgggcttggcgagggcggcccagttgcttcatgatgcgtgacagatgcggccggcttgggccgcagccccttcacgccgggagtgacgaccgtgatccaatcgacgacggcccgaatgtcggcgcccgcgacgctgtgtcatcggctgcgccatggtctgctgagggcctgtgccgccctggccatcggccttttcgcagcccaggggctaccggccggagaggcgcgggcggccacgccacccgacacattggtgatggcgcattatattgatgacgtaacaagtttcgacccggcggagagtttcgagctggccaccggcgagattctgaacaacgtctatctgcgcctgaccgtgcccgatccggatgatttcacgaagatcctgggcggggcggccgagagctggacgatctcggatgacgggctcacctacaccttcaccatgcggccgggggtgaaatttcataccggacggccgttgaccgcccatgatgccgccttctcgttgcagcgggtggtgaagcttgccaaatcgccggtcttcatcctgaacgcgctgggctggacgcccgaaaacgtcgaccggatggtggtggcgaaggacgacaccaccctggtgctgaccatgtcggagcccttcgcgccgagctatgtgctgaacagcctgtcatccagcgtcggcgccgtggtcgaccgcaccgaggcgctggcgcatgagaccgatggcgatctgggcaatggctggctgaagaccaacaccgccggcagcggcgcctatcgcctggtgacctggcggccgaaagaggccgtggtgctggaggcgaacccggatttttacatgggcgcgccgaagatgaagcgggtgatcatccgccatgtgcccgagcccaccgcccagcgactgctgctggagaagggcgatgtggatatcgcccgccggctcggcaccgaacagctgaagggcatcgccggcaatcccgatctcaaggtcgaaaccgagcccaaggcgacgatctattatctggcgatgaaccagaaagtgccggcgctgaccgagcccaaggtgcgtgaggcgatccgccgggcgatcgactatcagggcatcgccgcgaacctgctggaagggctctaccggccgcatcagtcgatcctgggcgccggcagttttgcggccctagacgatctgccctatacccgcgatgtggaaaaggcgaaagcgctgatggtcgaagccggccatcccgacgggctggacctgaccatcgacgtctcgggcacggcgccctatcgtgacatcgcccaggcactgcaggccaatctggccgatatcggcatccggctgaagatcgtgaccgccgatacccggcaggtgctgaccaagtaccgggcgcgcggccacgagctgctgctgatgtactggtcgccggattatggcgaccccaattcgacggtcgactatttcgcccgcaaccccgacaacgccgataccggcaccgccaagaccattgcctggcgcaatgcctggaagaatgacgagttgggtgagatggcccgcgcggcggtgctggaacgtgacgatgccagacgtgtcgagctttatcacgacatccagcgccggctgcgcgaggaggggccggtggcggtgatgttccagcagaccgagccgaccgcgatgcgcaagccggttgaaggctggatctcgggcccggccttcgacacctatatctactggcggatcacgaagtgaaggcagcgcctgcggggctgcgcatggtgcgggtgacggccggcttcatggccggccttgccgtcaccctgctcggcctgatcgtcgtcacctttctgatcggccgggtggtgccgatcgatccggcgctggtcgtcgccggcgacagggccagccccgaggcctatgccgcagcccgcacggcgctggggctggacctgccgctgcatgaacagctggcggtctatgtctggaatgtgctgaacggcgacctgggtcgatcgaccatgaccgggctgacggtggccgaggatgtggcacgggtcttcccggccaccatcgaactcgcggttgcaggcaccctgatcggtgtcgggctgggggtgccgctgggggtgctggcggcggcacgcgccggccggctggccgatcatgcggtgcgggcggtggccctggtcggctattcggtgccggtgttctggctggggctggtcgggttgctggtcttctacgcccggctcggctgggtggcagggcccggccggctggatgtcgcctgggcctataccatccccgaggtgaccggcttcgtgctgatcgacacggcgctggcgggggagcccgaggcgatggtggacgccctgcgccacctgatcctgcccgcctcgattcttggttatttctccatggcttatgtggcacggatgacccggtcgctcatgatcggagagctgtcgcaggactatgtcgtcgccgcccgggccaagggcgtgcccgaagtccggatcctgtggggccatgccttccgcaatgtcgcggtcccgctggtgacggtgatcgcgctgaccttcgcccatctgctggaaggtgcggtgctgaccgaaaccgtcttcgcctggcccggcatcgggctctacatcacccaggcgctgttcgcggccgacatgaatgcggtgctgggtggtacgcttgccgtcgggctcggcttcgtgctgatcaaccgcacggccgacctgatccatcgccggctggatgcgcggatgcggcaggaggtgcgggcatgatcggggtcgcgtcccttgcccgcatcgctgcccgcacgccccgcagccgggccgaggcgcggcgctatgcggcggcgggtttcctggcccgggcgctggccaatccggcgaccgtgatcggcaccctgatcgtgctggccctgatcctggcggctgccctggcgccggtgctggcaccttatgatccgatcgatcaggtcctgaacgatcggctgcaagcccctggcgcagagcattttctggggaccgaccatctgggccgtgacatcctttcgcgcatcctgtacggggcgcggatcacgctggcggtggtgctgtcggtcgcggtgatcgtggggccggtggggcttgcgatcggcatcgccgccggctatttcggcggccgcgtcgatgcagtgctgatggggctgaccgatatcgtcatggccttcccgcggctggtgctggcactggcgctggcggcggtgctgggccccggcatcggcaatgcggtggtggcgatcgcggtcaccggctggccggcctatgcccggctggcccgggccgaggcgaagctggtgcgggagcgggaattcgtccaggccgcccggctggccggggcctcggatctcaggattctggtgctgcatgtggcgccgctctgcctgtcctcggtgatcgtgcggctgacgctcgacatggccggcgtgatcctgatctttgccgggctgggctttctgggcctgggcgcccaggcaccggcgccggaatggggggcgatggtcgcgaccggccgcgattacatcatcgatcaatggtgggtggcgaccctgccgggtgcggcgatcttcgtggtcagcatgggcttcaacctgctgggcgacgggctgcgcgacgtgctggacccgcgcgcccagaccgggggtgaggcatgagtggcggcgcagctctgctcgacatcggcaatctcgcggtgtcgttcccgggacccgaggggccggtccgggcggtacgcgaggtctcactgtcgctggcccccggggaacggctggcgatcgtgggcgaaagcggttccggcaagtcgatctcgatgcgggcggtgatggggctgctgccgcgccaggcccgcatgaccgccgaccggctggccttcgacggcatcgatctgatcgagggcggcgagcggtccatccggcgcctgcgtggccggcgcatcgccatggtgatgcaggatccgaaggccgcactcgatccggtgatgaccgcgggtgcgcagatcgccgagggtctgcggctgcatcgtggcctcggtcgccgcgcggcccgggctgcggcgctggaactgctggccgcggtgcgcatcgaccggccggaacgggtgctggacctgcatccgcaccagatgtcgggcggcatggcccagcgggtgatgatcgcgatgatgctggcgggggaacccgacctgctgatcgccgacgagccgacctcggcactcgacgtctcggtgcgcggcgagattctggagctgatcgacgggctggtcaccgagcggggcatggggctggtactgatttcccatgatctggatctggtggcggcctttgccgatcgggttgcggtgatgtatgccggccgggtgatggaaacgctggccgccggcgcactcgatcatgccggacatccctatacccgcgggctgatcggctgccggccgcggctggatgcccatgtggcgccgctgccggtgctggtccgcgacccggcgtggaaggacggatgatgatcgaggtccaggggctgaccgtgcgctttcagggcctggccgcggtcgaccaggtgtcgctgagcgtcgcccggggcgaggcggtgggcgtggtcggggaaagcgggtcgggcaagtcgaccctgctgcgcgcgatcgcgggcctgctgtcgccggatggcggtcgcgtgatgttcgatggccggccggtggtcacggccggacgccagagcctggccgaccggcgggcgcgggcgcggctgatgcagatggtgtttcaggacccgtccacggccctgcatccgcggcacacggtcgaccggatcctggccgagccgctggtgatccacggggtgggggaggtggagcggcggattgcggcggcgatggcggcggtggggctggatgcgtcgctgcgcttccgttttccgcaccagctgtcaggcggccagcgccagcgggtcgcgatcgcgcgggcgctgatcctggagcccagggttctgctgctcgacgagccgacctcggcgctggacgtgtcggtccaggccgaggtgctgaacctgctcgaccggctgcgcgccgatcatggcctgaccctgctgatggtcggccatgatctggcggtcgtcgcccatctctgcacccgggcgctggtgatgcatcgcggccgggcggtggaggaactcacccgggcggatattcatggggcgaaggcgcgggatccctatacgcaggcactgctggcggcggccagggatccgcgcgcggctcattcggcggcgatgtcggcgacgggcggatcgaaggccgtcacctcgggcagcgccccgcgataaggttcgacctcgaccagggtcgaatgggcggtgggggcctgggacacggccgaggtcgggcgatctgcggtcagtacattcgggttgccgtgcttgtccaggctgcccggagccaccggttccgccggatcgtaccaggcgccggtggcgaggcggatcacccccggcatgacatcggcggtgaccaccgcgccggcgagcgtggcgccgcggtcgttgaagacccgcaccaccatgccgtcgctgatgccgcgccgggcggcatcctccgggtggatatggaccggctcccggccatggatcttggcgctgcggctgagttcggccgaatcgagctggccgtgcagccgggttttgggctggtggctcagcatgtgcagcgggtagcgggcggccagcggcgcgcccagccattcatcgggctcgatccagaccggatggccggggcagtgcggatcgccgaacgaggcgacccgggccgagaacagctcgatcagccccgaaggcgtgttgagcgggtgggcggccgggtcctggcgcagatcgccgaacatggtgaagggttcgtcgaggggcggcacctcgatatggccggccgcccagaaactgtcgaactccgggaaaggcatgccgcgggcggcattggccccggcggcttcggcatagatccggcgcagccagcccatctcgtcgagcccttcggtgaaggcctcttccaggcccagccgtcgggcgagggcggtgaagatggcgaaatcgtcgcgggcctcgcccaccggctcgatcgccttgtgcatcgccaggatgaagcggtcgcggccgctggcgccgatgtcgttgcgctccagcgtcgtggtcgccggcagcacgatatcggcatggcgggcggtcgccgtccagtactgttcgtggacgaccacggtctcgggccggcggaacgcctggaccagccggttcagatcctggtgatggtggaaggggttgccgccgcaccagtagaccaggcggatatcgggataggtgaggtcttcgccgtcatagcgatagcggccgccgggggtcagcatcatgtcggagatgcgtgccacggggatgaagctgccggtcgggttcatgcccatcggcaggcgcggcgaggtcatgccccgccgcggcacgcccatattgcccagcgaggcgaggccgagggcgaagccgccacccggcagcccgacatggccggccatgcaggcgagcgcaatcgccgcccaataggcctgttcgccgcgatcggcacgctgcagggaccaggaggcattgatgaaggaacgctggcgcgtgaggccgcgggccagcgcccggatggtgtctgcgtcgaggccggtgatcgccgccgcccagtccggggtcttgggcacaccatcggcgcggccttcgacataggcgatcacccggtcggcgccgacggtgcagcgggccagaaactcatggtcgaccacgccgtcatcgagcaggacatggatcatggccagcatggcggcggtgtcggtattggggcggatggtcagccattcagcaccatccggcacgtcttccttcgacggcgtgatgcagaccacgcggatgccggcatccaggatcttctgcagccagtcgcggccttcatgggcgcccatgccgccggcttcgatctgcatgttgatccgcggcaggccgccgaaacagatcatcagccggcagtgctgcaggatcccgtcccaggacgagacggggccctggacggcatcgatcgatcccaggatatggggaaggatcgtgatcgcagcggcatagctgtaattctgcacctgggtggtgaagccgccgccgacgttcaggaagcgatggagctgcgatttggcgtggtggaaacgcccggccgaggaccagccataggatccgccgaagatcgactcatggccgtgctcgcgccgcacccgggcgacctcggccgcgaccatgtcgagcgcctcgtcccagggaacggcgacgaaatcctcggcgccgcggcgctcgcggccgcgatcgggggcattgccgagccagctgcggcgcaccgacgggcgggcgacccgcgcccggttgtgaaccgcgtccggcatggtccggaccatgtccgaggggtagggatcgccttcgcgcgggatcgcctccaccagacggccatcgcggacgacggcggtgaaggcaccccaatgggaggcagtcggaacacggcggatatcggacatggcggacacggttctcggttctgatggcccggacgcgggggcaggatgatcaggcgctctggagggtccgggactcccaggcggtggcgacgaagccgatgcggtcgccggtcgccaccaccggatcacggcgggcggcgatgaccaggaccggctcggcgaaggtcacggtgtcgacgatatcgccgaaaatgtccgtgatcacgcccaatggcgatccgggctgaagaatgtcaccgggtgtgcaggcggcccggaacagaccaccggtatcggccgtgacgtggcggcgcttcagaaccttgcgcagcatgccgccgggggccgggcgatcctcgaacatcccgatctcggcggcggtccggcgcagacccgccgagccctgttcgacatagggccattcgatccggctgccggcacccagctcgaccatgaaggcggctttgccaagcgcctggaactggtagtcgatggcgcctgagatgttgcccggcagctcgcccgcggccttcaccgtcggcatcaggcaggcgacgctggggtcatagaaggagaggtggcgcagcagcacatcctcggccaccggaccgtcgggatgcagcttgtagacgccatagggcttcgcctcgaaatgggcggtgagcgtgtgcaggctgaccagacagtcgcctgcgcgctcgatctcgcgccagagccggtcggcgacccgctgggtggtcaggccgccggcggcgccggggaattgctggtcgatgtcgagcccgtcctgcggcgccgtcttggcccgggcatcgaaggcgagcggattggcggccgggatcacgatgcaggcgccgcgcatggcggcgaggtcgagattgcggacgaaatcgagtgccgccagcgtgccgttgacctcgtcgccatggacggtggcggtcacccagagggtggggccgtcggccgcaccacgggcggcgatatacgggatggaaatctcggcgccggtcgccgtggaaccggcgaccaggcggccctggccgcggctcgcgggggcgagccgggcgagatgatcggtgatgattgtcacgaggcggggtctcttccgtggggggaggcggttccggccgtggcggccccggccttgcggcgaaggtccagggtgtagcacagccagaacagggcgaagctgccggccaggatggcgatctgatagatcaggccgacatgttcggagggcagcagaagcagcgcgaagagcagggccgccgcacgggtcgcgcgcgacagcggcaccttcagccagccgatcgaggcgaccgagatggcgaagatcgcgatcgccatcagcaggcagacataggcgatctcgccgatcgtgccctgggccaggaattcggggtggtagatgaagacataggggatcgcgaagaccggcaggcccaggcgtaccgcatgcatgctggtccgccagggatcggcattgccgaccgcggcggcggcgaaggaggcgacggccaagggcggtgtgatgttcgagatcacggcatagtagaagatgaacatatgcaccgcgatcggcgccacgccgaaatcgacgaaggccggggccaggatcacggccagcaccacatagacggcactggtcggcatgcccatgcccatgatcaccgcgaccatcatggtgagcgccagcgcgagcggcaggatgccgtgcgaggtttcgatgatgatcgtggccatgcgatagccgaggccggtcatcgacaccacgccgacgatgatgccgcccaccgcacaggcggcggtgatcggcgcgatcagcttgggcgcgttgatcagggcgtcggcgaagatccgggcgagaccgcgcacgcccttgcggcgatcgaagatcacgatcatcgccgccagcatgccgatggcccagacgccggcccgcgccggggtatagcccgagaccagggcccagaccatgaagatcaccgggaccagcagatagccgcgcgagcgcagcaccggccagaccttcggcatttcctcgtcttcagcgggccgcaggttcagccgccgggcttccagatcgaccatcacgaagacggtggcgaaatagaagatcgccggcaggatcgcggcgatcatgatgtcgccataggggacgcccagcgtctccatcatgatgaaggcggcagcgcccatgatcggcggcatgatctgcccgcccgtggacgccacggcttcaacgccgcccgcgaatgagcccgagaagccgccgcgtttcatggccgggatggtgaagctgcccgtggtcaccacattggcggtggagctgcccgaaagcatggagaaaaaggcggaagagacgacagcggtcttggccggcccgccgacgatccggccggtgagggcgcgcgccagatcggtgaagaactcgccggcgcccgaggcgaccagcagcgagccgaacagcacgaacaggaagatgtagctggcggtcaccgccagcggcaccgtccagatgccgtcgaccgtgaggtacatctgctcgatgacccggtcgatggaatagccccggtgccagaacggatagggcaggctgtcgccgacctgggtatagaccaggaagacgagggtgatcacgaccatcggccagccgatgctgcgccggacgacatccagcaccaccagcagcagcagggcgcccagcacgcgctcggcggtcagcagccgggtcatgtattccatgcgctcggaaatgcgggtctggtcgaagaccaggaacagggtcgaggccagcaccacgatcagcatcgccgtatcccaggcgaggccgatccagcgttttgccccggtctccggcgcccgcatcgaggcggcggtcagcagcagcaccgcgaaggccagcgccagatggatgggacgataggccagcgccggcgcttcgccgaagatgcccgcatggatgtggaagagcgacatgccgatcgcgacggcgtgggcggcatggcgcagcacggtgcgaaggcctgagccctcgcccgctgcggagacggtggtcatcctggatcttcttccggacgaggatgcgtcggacgggcgcgggcggggccggggtcaccgggcgcccgcgccctgcgcctcacttcgcgaggacgccggcttcctgataggcgcgcagcgcacccggatggatggtgataccgggcatggcggccatgtcggccggctccagccgggccagggcggcatgggcgccctgcagacgcttgaacttttcgatcagcgtcttcgtcagccaataggcctcgtcctcgggcatctcgtccgaggcgatcatcatcatcgaggtgccgacggtcgggatcgcggcatcctggcccggataggtgccggccgggatttcggcgcgggcataaccggggttcagctcctgaagctttgccgccagcgcgtcatcgatggtcagaaagcgaatgtcggaggtgctggcaagctcggtgaaaaagctggccggatagttcgcgaccgagaccataccgaccgaatgatggtccttgatctggtcggtctggaagctgagaccgccgcggacgatgtcgatcttcgacgcatcggtgccggtggcggcgagcaggtcgtcgaagatcagtgcggtggcctggcccaccggctgcgaggcgaagcgcttgccggcaaggtcgccgatcgactggacgcccgaatcgcccgcgaccgcgatatgggccagcatcgaggtgaacgaggcgatgccgcggacattggtgatcggctcctggaagggcggcttgccggcggcggcgacgctgggcacgatgctcatggtcaggcccagctctcccgtcccgcgtgagacgccgacgacgttggaggtgccgccgcccatttcggcattggcgcgcacgccctcgtcacccaggatggcggcgacgcctgcggcggtggcatagaacgagctgccggtcgggccggcgaggatggtgagcgatttcggcttgccctcgtcggcggcgaagccgggggctgcgtgcagcatcagggccgcgacggcggcggcgccgagcatgcggcgatcgatggtccggaacatgtagcctcacgtgtttcttgatgggctgcgtcttgcgcggtggcagtgcccgcgggggcgtggcaccggctttgcgcggcgggtctccatccggcggcggatctctggcggatccgtccggccgggatgtgtcgatgtcaggcggtgccgaagggataggtttcggcacccaggcggaaggacaggctgcgcgcggcagcctgcagatccgccacatgggcctcggccgcgtcgggctcgtagccttgaagcggcatgatgaagctgagggcggcacggatgtgttcgtgctcgccgaagaccggaaccgcgatcgccaccaggccgggcgcgctctcgcccgcggtgacggcggcgccggcggcgcgaacctcggccagatggtcggcaaggccggccggatcggtgatggtcttgggcgtgatctggggcaggccgtgggccgcgatcagccggtcgagcacctcgggtccatcgaaggcggtcaggatcttgccggccgcggtggcgtggaacggcaccgacatgcccacgcgccagcggctgtcgacgaagaacggcccttccaccgccagcagatggaagacggtgtcgccctcgcgcacgctcaacaccgcggaatggccgcagcgatcgaccagctcccgcatgatcggcagcgcctgacgggtgaggacatgcgtatgggcataggcgacgccgaccagaaagctcatcggcccgacccggtatttgcgggtgaccggatcctgatccaggaaaccctgctcgcggaaggtggccagcaccttcgagacctggcttttggcaagcccggtccgctcgcagatgtcggtgatgccgagcggctgacgtgtggtggagaaggcgccgtagatggcgagggccgaggtcaaagacttcatcaagaagtttcctattgggaaaccatgtttccaaataagcttaagcccctcgtttcctgcccgtcaatcatgttctgcatgcatgggtcggccgggttgcccctgggtggaattccgcgtatgaccagaagacacaatggtttaccggcaacgcaccggtggcccgaggaaccgcccgaggagatcccccgtaccgatggcgagcgtgagcgaggccggctgccggccggtgcagcccaaccggctggatgccggcgcggcgctgatgatggtggtgctgtgcgcctgttggggcctgcagcaggtggccgtgaagatggcggtcgccgatggtgccgcccccatggcccaggcggcgctgcgctcgatcggtgccaccatcatcgtgggcgtggtggtgctggcactcggccgccgccggggcgtgatccccatgggcacgatctggccggggatcggggcagggctgcttttcgcgctggaatttgcgctgctctataccgggctgtcgctgaccaccgcgtcgcgggcggtggtgtttctgtacaccgcccccttcgtggtcgcgatcggcggccatctgctgatcccgggcgaacgtctgggccgctggcaggtgatggggctgctggcggccttcggcggcatcgtcgcggccttcgccgacgggctggtcgaaggcggcggatcgatcgcgggcgacctgctgatggtcgcggccgccatcgcctgggggctgaccaccctgctgatcaagggcagcgtgctctcgcgcacggcgccactggtgacgctgctttatcagctgggcgtctcggccgtggcgctggtggtgctggcgctggtcatgggcgccgatctcgccattccgctgaccgatacggtgatcggtgccatggcatttcagatcgtcggcgtggccagcctgtcctatctgggctggttcgtgctgatctcgcgctatccggcctccaggctctcggccttcagctttctgaccccgctcttcggtgtcggggcggcggcggccgtgctgggtgacgcactgacgcccgccttcgcgatcgcactggtgctggtcgcgggcgggatctggatggtgaaccggccgtcctgaacggacggccggctttccggatgtcgaaacgtcaggcgctggcgcgttcggggacggcaagccccagccagtcgcggtagaaggtcgggatatccggctcgaaatcatgcagcaccggataccagggcgtcggtgcctcgacgtccagcagcacgccgcagtccgggcagcagtattcgcgatagacctgccaggccggatcgggcgccatcagcttcgggtagacctcgttcagcgccgcttcggtgtcacggacgcagaccagcgcttccagcttccagttccggtcatgatcgcagaagacatggccgcagctgcacttgatcttccagtgcttcgctgcatcctgaacgatgaacaggtgcggccccagcggcagcaggatccggtccggccaggcggcgcgcgactgcagcacctcgatatatttcacgaaccggtcggcatccttgggcatggagagcatgcgatggacgacatccggatccaggcggccgtcgaccagatcggcaacctgtttcggggtatagctcgacatctgcggacttccttacaagagattgtgatttcgggaaaatgagggggcatcgccggggcgggcgccgggggaggaagaccggcccggcgatgcccgcgcctcactcctccaccagacggatcgtggtcacgtcgggcagggccgagaggtccatgcggtgcttcgaaccgaaggaggggatgcccagttcgctctcctcgatcgtccagtcggccggcagatcccaaaagctgcggaactggtcgaggaacttgcccgaaagcccgaagctggtggcgtacatgtgccggaccggcagcgacgcctccttggccaggatccgctcccgctcctccgccatccacgcgcgggtcgggcggctgcgggcgatgcgctcgcggcggatctcggcgcggcgccgggcggtcgcctcgcggtcgacctgccagcggccgccggcgaccttcgtcgccacggcgccatggaccgaggcggcatagcggggcagcagggcgcgctcgttcagatcctgctcgatcgccgccgggtcgcggtccagcggatcgccgaagcccggcccgccgcggatgtagttcaggtagagatcgtggttctcgaataccgcctcggtggtcatcgcctgatggtcgcgtttgacccgggcgctgcgatcgatgcgggtttcgtattccggatgatcgggatcgagatctgcgccgaagggcaggggctcgcccgcggcgatccggcgggcgatgccggtgtcatgggcctcgaaacggtagccggtggcggagggatagccgcccatcagcccccagtcgctgaccatgtagccattgcccatgaaatacatggtccagtcttcggccttccagaccatgcgcagggtctcgaagccgcagccgccgcggtatttgccatagccgcccgaattggccttcacgttgcggcccagatagatcaggggctcggccagctcccagatctccatgtcgcccatatcgccttcggggttccagatcgcggcggcatggttcagcccgtcgcggatcgccgaggcgccggtgccggtggccgcggtctcgaaactgttgaccgcatgcacctcgccgtcctggttgatgccgccgccctgcagccagttggaggtgttgccgttgccggcattgacctcttccagatagccgcggccgtaataggcggtcgacacgccgcgccagagggcgctccagctcgacaccaggaaatgccaggcataggcatggccggtgcgccggtcgtcggggttcatccaggtgcccttgggcagccggaatttcgtgccgtaataggcgccgtcattgatccgctcggtcggcaccagggtctgggtcatcatcacccatatgccgctggtgaaggcgacctgattggcattgtaggtgtgccagccccagcggctcgcgccctcgaaatcgagccgccacgaggcatcggcattgatggtcatctcgaccggcgcatgcatgatgctgtcgatcttggcgaaggccgaggggcagccgatgtcttcatgcgcatagggcacgtcgacgaaggcgaccttgcgataggtaccggggatggtcatcgccttcacccggctctgcaggccgcggcggccttcctcgatcacctcgtaggcgaagctctcccagtggtcgacgccgtgttcttccagcacctcttccaccagatcgcggatcatgtggcagccggcgatgcgggtgcgctcgtccaggatccagtatttggtggtgcgcaccgagcgctggctttcatgcagccagtcgcgcaggggcacatcgttgatgccggtcttgcggcaggtgatctgatagccgtcgccgaagcgctggatctggccggtggacatggagccggggccgaccgatccggtgtcgatcacatgggtgacgccgccgacccagccgaccagcttgtcctgccagaagatcggcacgatggtcgcgatgtcgcaggggtggacattgccgatcgagcagtcgttgttggtgaacatgtcaccgggggaaatgccgggattggtctcccagccattctcgatcatgtatttgatcgcagcccccatggtgccgacatggatgatgatgccggtggaggtcagcacgcagtcgccggcggcgttataaagggtgaagcacagctcgccctcctgttcgacgatcggcgaggccgcgatcttcttggcggtctcgcgggcatgaaccaggccgccgcggagcttcgagaacatcttctcatagccgatcgggtcggactgcttgagcgccagggtctcgagcccggcatagtggccggtctttgccgtgagatcgagcacccgggcccggttctccttcagggtcaggccgccgcggaccaggccctcgcgtcgttcggacgacatcacgttcatctgatgcaggtccttcgtctgatgaggtttttcagggaagcgggtgtcggtcagccgcggccggtctcgatcaggtggaacagccggtggccgtcgagccgggtggcgaaaccgcggggcagcacgaaggtcgtggccgggctttcgatgatggcgggcccctcgatccggttgccggccttcaggtcttccatccgccagatggtcgcgtcttcccagcggccgctgcgatagaagcggcgggtgccgaggcgtgcgctttcgggcggcaccggcccggcctcgggctcttccggcaggaccggcttggtggtggtgaccacgccgcgcatgatcgcaccggtgacgctgaagccgagttcgggcgaacgggcggcatcggcatagacccgggcataggtctcatcgaatgcatcgaccagcgcatcccaatccgcgggcgtggcggcgctggtgatcggcgagatgatctccagatcgttgagctgccccagatactgcatgcgatagcccggccggagcatcacgtcttccggcttgaagccgttgatcgcgaactcttcgatcacccggtcggccagctccgcccaggcctgttgaagcgtggcgcaggcgcgggtcttggcctcgtcgtcggcgacggccgggatcgccacgtcgacgctcttgtcatagcggtattcgaaatcggcagtggcacagccgaaagccgagaaacccgccgcccaggccggaacgaccacatcccggaagcccagcccttcggtatagccataggtgtgcaccggaccggcgccgccataggagaagcacacgaaatcgcccgggctgtagcccttggcgctgatcgtcgcccggagatagtcgcggagcgacagatcgagcagttcgatcaccccggcggctgcggcttcgaccgtcagccccagcggttcggcaagctggtggcggatcgcctcatgcgcgcgggcgacatccagcttgaccgccccgcccaggaagttgtcggggttgagatagcccagcaccacatgacagtccgagacggtgaccgtgtcgatgccgctctcggcccagcacacgcccacccgatagccggcactgtcggggccgagcttgatcgcgccggtatgggggtcgagccgcacgaaactgccggcgccggcgcccaccgagtccatcgccaccagcggcagcgacagcaccagacgggccatgtcggggtcggaagcgatggcgaaattgcccttggtgatcagggccatatcgaagctggtgccaccgatgtcggaacaggcgatgttgtcatagcccagcatctggcccaggaagcgcgcgccgatcaccccgccgatcggccccgagaccagggtccgggccagttccttggccttccagctgatcgtgccgccatggctggccatgacccgcagatcgaaccggccgccgacctcgcgcatccggtcgctgatcttcgtcagtgtgcggcgcgagggctccgccgcataggcctccagaatggtggtgttggtgcggtggctttccttgcgcaccgggtagtagtcgaccgaggcgaagaccggcacatccgcgcccagctcgcgggtgacctcgatcgcgatgtcgcggacgcgccgctcgtgggtgccgttcttgtaggaatgcagcaggctgatcaccagcgccttcgcccccgccgagaccagctcgcggacggcggtgcggacctcgtcttcccgcagcgggatgaccacctggccctggctgtcgatccgctcggtcacaccgcgggtccgctcgggcggcaccaggggctggtcgtagcggtgggtgttcaggtgaatgcggtcttcgaaaccatagcccagatagctctggatcgcccggcccatgcggtgatggtcttcaagcccgcgattgacgatcagcccgacctccagccccttgcgctgaaccacgcggttcagcatcgcggtgccggaatagacgcaggtgacgagttcgtcatagacctcttccaccccgcgcgaccattgctccagcgcgtcggcggagctttccatcaccgcgcgggcctcgtcctcgggattgctctgcgccttgccgaccacgaaatggccgtcggcgcgcacgaagaaggtgtcggtcatcgtgccgccggcatcgatgcccatcacctgcaccggaaccggggtccgggcgtcctccgtcgtctgtgcgcgtgtcatgtgtcctcccaggatctgtcgttggcgggggcgatcggcgtcgccctcggaagacatgaatggcaagcggcgtgccagacgggcgaaatcttcgcaaagccttatggcatatcggattgcggattctgttgcggtgccgtttcgcggccgcaccggtcgcgtgcggccgtccggatgtcggtcgggcgtccggaaaccggacgcctctcgcgcggatgggggcgtcctgcggtatcgaggcgggtggacaggtcgtgggagagtggtgcaagctgctgtcccaacgataaaaatccgtgttggggaggacgccgtcatgcaaggggaaacccaacccccgggcgatccgccgtccgtgccgtcggttttcgacgcctgggagacgctggtcaccggtgatgcccgcgccgtcgccggcgtgcgggatctggtcgaaaacagctggcgccgctgcctgaagaccggcgtcgaccccgccggacgcgaggcgccgctggtctgttccgaagaccggctgggcctgcgccgggagcgtgccgaggatctgcgcggcgccgccgccccggtgatgggcgatgcccgcgccttcctggccgagaccggcaccatgatggtgctggccgatcccgacggggtggtgctggatgtcgaaggcgatggccgcacccgcgaccggggcgaggtgatccgcctgatgccgggcgccgactggaccgagaccgcaagcggcaccaatgcgatcggcacggcgctggccctgggggcgcccgtgcagatccatgcggtggagcatttctgcgccggcatcaagcaatggacctgttcggcggcggtgatccgcgatccggtggaccgcacggcgcttggcgtactggacatctcagggctttcgggcgcccataacgcccattgcctggcgctggcggtaacggcggcggggcggatcgaggggcggatcgccaagcgcgatctgaacctgcgcgcccggctgatcgaggcggtgttgagcgaggagcgctggccgatggaccggctggtggttttcgatcatcgcggccggccggtgcggatcggcgatcgcgcccggcggctgctgaaggagatggcgctggatccggcacggaccggcaccggcggcgcggcgctgcccgactggctgaagattgaagccgccgagccggttttcgatgctgcgcgccggatcggggcggtctgcgtggtgccgcagggccgaccgcatttgcccggcggggcgcgggcgcgcgatctgaccccgcccccgatctgcgagcggccggccgaccccttcgacgaggtgatcggcgacagcccgccgatgatcaaggccaaggccaccgcccggcgcttggccggggtggaggtgccggttctgctgaccggccctacgggcaccggcaaggaggtcttcgcccgggcgatccatcgggcgagtgcgatggggcagggcgcgttcgtcgcggtcaattgcggcgcgctggcccgcgatctgctggcgacggagctgttcggctatgccgagggcgccttcaccggcgcgcgcaagggcggcatggccggcaagttcgaggcggcccatgacggcacgctgttcctggacgagatcggcgagatgccggccgagctgcaggcccatctgctgcgcgtgctggagcagggggcggtggtgcgggtgggggaggcgcatgagcggccagtccgcgtgcggctgatcgccgccacccatcgcgacctgccggccgaggtcgcggccggacgcttccgcgccgatctctatttccggatcgcggtgacggccatcaccctgccgccgctggccgaacgcggccccgacatcgcccggctggcctgtcatttcgccgcgtcggccgcccggcgccacgggctggtccgccatccgcccgcggacgaggcgctggccaggctcgccacccatgactggcccggcaatgtccgcgagttgcgcaatgtgatcgaacaggcgaccatcctgaccctcgccgaccggatcgaggccgccgatctgccggccacgatcggggccggccatgtcctgcggccgcagccggcagagacggcggtcagcctggacgaggccgaggttcaggcgatcctggccgcggcgaccgaaaccggctggaaccttgccgcgaccgcccgccggctgggcatcgccaagagcacgctttacgagaagttgcgccgccacggcatccggcggccgggcggctgacgaggctcagggcaggtcggccggatcgtcgatgaccttgcggaaatgatgcacccagagcttgcgggcgatggcggcatccggatcggccgacgaaccgcggaccgcgaagctgagcagggtggggtgcagcccggcatcgaacagccggaagcccgcggccatcacgcaggtatccgcctggatgccggccaccagcacctgtgcgggtttcagcgccgccagatgccggatggcggcatcgggcggcagatagccatgtttcacgaacacccggtcgaccggaaccaggcagcggtcgctggtccgcggtgtccagccgacctgcgccgcgaacggcacctgtgtctcgtcgtggagttcgatggtggcgaccgacgggtagcggcgggcaagggcggcgatccggtcgaccagcgcggccgagggtgcaaaggtttcctggacgtcgacgacgagcagggcggcggacgggttggacatgttgacggccgttgatctttctgcactctgggcgggtgttcgaccgtgcgatgatcggctaatgagcgcggagctgtaaacccgggggacgtgccatttccgtgacgacgacatcatcggccgatcaggccccggacgcacccccggcatccgctacccctgtgacggtcgatcgcctggcactgcgggagcgggtggcccgggccgcgatcatctcggccctgccgatgctggcgctgaccgcggtggcggccttcggctcgtcctcggtggcgcttctggccgatttcctgctgtcgatgctcgataccgcctcgctggcggtggcctggacggtggcccggcttgcgcggcaggggcggccgatccgcctggaacacgggctggagcggctggaaagcctggcggcggccgggaccggcatcttcctggtgctgtcgatgatgctggtgatcacgctggcggtgatcgatctggtcgaaggggcatcggcgccgaccggcccggcggtggcgttggggcttgcggtcaacggcgtctatctggtggtcaacgccaccatcctcgcccggttgcgccgggcagtgacatccgacccgtcgcccttgctgaaggcgcaggcccgcctgttcgtcgacaaggtcacgtcgaacctgctgatggtggtggcactgggcctgggttgggcgatggccggccatccggccgggggctggatcgatcccgtcgccagcctgctgatcgtggcctccatggcctggtgggggttccagatcatgcgcaatgcgctgggcgagctgatcgacgccgcctgcggcgaagaggtccacatgccggtggtgacggcgctgggccggcatttcgacctgtatgacgatctgggccgcatccggacccggcgggccggcggtcaggcggtggtggagatcgagcttgggttcgccgcggatctctcgatcggcgagatcgccgcccgcagccgccggatcggcgcagagatcgaggcgatggttccggcgagccgtgtgaccattcatcccttcgccgtcgactgatcgggggctgttgcactttgacgcggtgcggtaatctttttcgcatttgcggtagatataccctcgcatattccgcggaaaatcaccggcataaaagatcattgcgcgtgcccggggtggcggtaacactgttttcagaagaacgaggtgacggccatacgcgatgccgtccccgcccgcgaggaaaccccagccgaagagggccgcatgacgcagtcgtcccgtcatcccgagaccaccggcgccaatgtcccggtcaccgacgagcctctgccctactgggcatcgagctatccgccgggcatcgactggcgcctgccctggcagccgcgggcggtgacgacggtgctggcctcggccgtggccgaattcggcccgaagccgatggtctccttcggtgagaccagcttcacctatgccgagatcgaccggctgtcagaccgcgctgcggcggggctcgcgcggctgggggtggggccggggcggcagctggggctttatctgcccaacacgcccgtctatccgatcatgttctttgccgcgatgaagctgggcgcgatcgtggtgaatatgagcccgctcgacgcgctgcgcgagctgcgccacaaggtggaggacggccaggtggccgtgctggtgaccctggccctgccgccctttgccgagaccgcgctgaagctggccgacgagaccgggctcggcacgctggtgatggcccggcggcccgacggtctgcccggcgatgggccggtcccgctgcccgacgacccgcgggtgcatgactatcaggacgtcatcgcctgtaccgacccggtgacgccggccgcgattgccgatccggccgaagaggtggcggtgctgcaatataccggcggaaccaccggcgtgcccaaggccgcgatgctgacccacgccaatctgatggtggcgacggagatgcagcatgcctggacgatgaccggagaggatgcgctgctgaagcgcggcgaagagaccatgctgctggtcctgccgctgttccatatctacgcgctgtccccctgcttcctgcgggcggtcgatgcgggctggcatgtgatcctgcatccgcgtttcgacgcggctacggtgctgcgcgatctgtctgcccgcaaggtgaccatcttccccggcgtgcccaccatgtataccgccatgctggcgctgcccgagttccgccagaccgatctctcggcgctgaagacctgtgcgtcgggtggggcgccgctgccggtcgaggtgcgcgatgccttcgaacgggcgaccggcattcccgtgctggaaggctgggggatgaccgagacgtcacccgccgggaccgccagccaggcgcgggacggttatcgtacgccgcgcggctcctgcggcctgccgctgcccgggctgattctggaaatcgtggatctgaacgatccggaccggctgctgccacccggccagaccggcgagctgtgcatccgcggcccgaatgtcatgaagggctactggaagcgcccggacgccacggccgaggcctttgccggcggccgcttccacaccggcgatgtcggctatatggacgagaagggctatctgtatctggtggaccgcaagaaggacatgatcctgtccggcggcttcaacgtctatccgcgggtgatcgaagaggcgatctacgagcatccctcggtgtcggaggtgatcgtgatcggcgtgcccgatgcctatcgcggccagtcggccaaggccttcgtcaagctgaagccgggggctgaggagatggatatcgagggctggcgcagctatctggccgacaagctgggccggcacgagatgccggcggcggtggaatatcgcgaggaactgccgaagacgcccgtgggcaagctgtcgaagaaggaattggtcgccgaagagaaggcgaaatgggacgcggccggcggcgatacccgggcacgcgcctgacgctgccgccgccgctggtcttcaggatctgacttcaggatctggccgcggccaggatccgcgccacggtagggcgtggccgctcgatcgcgaaaaagtgaccgccgggaagggtgacggcgctgaaaccggccgccgtgactgccgcccagccggccatggcggcagccggagctgccctgtcgtcggcgccggagagcgcaaggatcgggcagggcaggggcgtgccatccgctgccgccactgctccgctgccgatggcgaaatcggcgcgcatcagccgcagataatgcgcccggagcgacgggtcgtttcgtaccgcgaccggtgtgccgccatagagccggtcgagggcatcgaagaagcgatcgtcgtcgagatcgagaagtgccgtggcacggctcggctggtcgggcggaatccgtgcgccgaccgccagcaggcggggcgtgtgaccggccatgtgcaggcgatgtgccacctcgagcgcgaccagcgtgcccatgctgtgcccgtagagcaccagcggcaggccgtcatcatgggcgatgagcgccgcggtcaccgcatcggccgccgtggcgatcgaaccgaccggcgcttcggtcgcccgctgttcgcggccgggcagctggatggcggtgacggccgcatcgcggccggcaaccagggcccagggtctgaaggctgcgggaccgccaccggcatgggggaagcacaccaggcggatgacgggtggggggtcgctgtcggcggcaacgggccggaccagccagccggcgggatcgacgcggacccagcgggcgggcggcggacgcagagcaatcacgggtcaagtccccattcttgcaaggagatgccgatcatcatgccgcagttctgccgggaaatgcaaaaggcccggttccgaagaaccgggcctttcagtactggctgggggactaggattcgaacctaggctgacggagtcagagtccgtagtcctaccgctagacgatcccccatcaggattgcggtgtcgctttcgcgtccgccgggcagtgttttgtgccgccctcgtcgtgttggggaacctaataagacggcttcgtgatgtcaagcgggcttcgcgcatttttttgcccgggcctgaaaccacgccgtggccggcgccggccccatggcggcgctttcaaagcggatggaaaggcggtagaacggcagggacggccggttcatgacggatcggcgagatatttctttcaagtcaacgacgcggagccgggatccggtttccgcggacgggaagagcagtgaccgagacacctgacgaccgtgccgcgcgacagtcgcggcggcggaggcgggcgcgtcgcggccggcggaaggcagcagcagccggcaccccggcgtctgtgcctccgcctcccccgccggctgcgccgccgcctgccgtgtccctgccgtctgccgccccggcggcgcagccggcacggccgcgcccgaaacctgccatgccatcctcgcaaaaggcagcgcggcccgacggccagaaggcatcgtctcaggcagcgccgtctcgggcagcgccgtctcgggcactcgatccccgggacgaccgcggacatccggcggcgcgaccgacggtgccgccctttgcggccctggatcttggcaccaacaactgccgcctgctgatcgcgcggccgtccggcgaggatttcgtcgtgctggacagcttctcgcgcattacccggctgggcgagggcgtcgaggcgggcggggtgctgctggaggcagcgatggaccggacgcttcgtgcgctcaaggtctgtgccgccaagctgcgccgctggccgctggccggcgtgcggctggtcgccaccgaggcctgccgccgggccggcaatgccacggaattccgggcgcgggtgcgcgacgaggcggggctcgacctcgagatcattcccgccgacgaggaagcccggctggcggtgatcggctgcgcaccgctgatcgatcgcggtgcccggcgggtgatcgtggtcgatatcggcggcggctctaccgaactgacggtgatcgcccccgatcccgaggcccccggcgggctgcgtcgggtggactgggtgtcgctggcgctgggtgtggtgaccatggccgatcgtttcggcggcggtgacgtaccgcccgacacctatcgggcgatgcgcgccgaggtgtcgggccggctggccgagctggtggcgcgggtcgaactggaccgtcatatcgccgatggcgccgtgcagctggtgggcaccagcggcacgttgaccacacttgccggcgtgcatttcgatctggcgagctatgatcgcgaccaggtggacggtcgcgaggtggcggtggcggcgatgcgggagacggccgagcggttgagggccatggacctgagtgatcgcgggcggcatccttgcgtcgggcgctcgcgcgccgatctggtggtgcccggggcggcgatcctggaaggcgtctgtgatgccttcccggtggcgtcgctcaccgtcgccgatcggggcctgcgcgaaggcatgctctacgagatgatcgcggcccatcgggccagccgccgccggccggggcggcgtggcgggcggcatggccgctgaaccggatatcggcggccccctggcaaggcataacgggagatccatccccatgacgacgggcaatggcggccgcggcggccgtaacggatcgggacgcggtggtaccggccgggccggacgcagtggcggcggcggcgatccgatcgccggccagcgcatggtcaagcagcgggtccgcacggccggtcggcggtcggcctcgtccacccgctggctggagcggcagctgaacgacccctatgtcgtggcggcgaagcgcgagggataccgctcgcgcgcggccttcaagatcctgcagctggacgagaaatacgggctgctgaagccggggcagcgggtcgtggatctgggcgccgcccccggcggctggacccagatcgccgtggatcggacgaaggcgggccgcgcgggcggtggccgggttgtgggcatcgacctgctgccggtggagccgatcgagcatgcgacgctgatccagctcgacttcctggacgatgccgccccggaccttctgaaacaggcgctgggcgggccggccgatctggtgctgtcggacatggcgccccagaccagcggccatccgcaggtcgatcatctgcggatcatgcatctgctggagatcgcgctggatttcgccgccgaggtgctggcggaagacggcgccttcgtcgccaaggtcttccgtggcggtgccgagggggagctggtgaagcgcatgcagcggctgttccgcacggtgaagcacatgaagccggcggccagccggccggaaagttccgagatgtatgtgatcgctcagggtttccggcccgaggtcgccgcggccgagcgggcgcgccagggcggaggtgccgccgaggactgaaacgttcgttccgggcgcatgcgccgcacgaagggcggccctgcgtccggcggaacagaaaccggcttcaagcgcggccgcatcggtgtatattgcgcgcccatacacggtacgcgctgttcaccccgccacactcggcccgatcacggtctgcccggcctgatcgatccgggttttccgcgtacccgccgggtcggcgcgcgtatgccggccgggcgcccacggccgagaacgcgaggctggaaaccgatgaccattcgtgaagccctcacctttgacgacgtcctgctcgttccgggcgaatcggacgtgctgcccgctcaggtgcagacggcgacccgcctgacccgcaacattgaactgggcatcccgctggtttcggcggccatggacaccgtcaccgagagcggccttgcgatcgccatggcgcagctgggcggcctgggggtcatccacaagaacctcgacgtcgatgcccaggcgggcgaggtggccaaggtcaagaagttcgaggccggcatcgtcgtcaacccggtgaccatccgcccggatgcgcgcctggccgatgcccacgagctgatgacccgccacaagatcagcggcatcccggtcaccgaggcttcgggcaagctggtcggcattctgaccaaccgcgatgtacgttttgcgaccgatccgcgccagccggtgcacgagctgatgacccgcgagaacctggtcacggtcaccgagaacgtgacccgcgacgaggccaagcgcctgctgcaccgttaccggatcgagaagctgatcgtcgtcgacgaccagtatcgctgcgtcggcctgatgacggtgaaggacatcgagaaggcccaggctttcccgaatgcctgcaaggatgatcagggccggctgcgcgtcggtgcggcggtgggtgtgggccccgacggcgtcggccgcgccgaggcgctgattgccgccggcgtcgacctgctggtggtcgataccgcccatggccacagccgtggcgtggtcgaggcggtgaagcgcatccgtcagatgaagggcgatttcgacgtcgtcgccggcaatatcgccactgccgcggccgccgaggcgctgattgccgccggtgccgatgcggtgaaggtcggcatcggccccgggtcgatctgcaccacccgtgtggtggcgggcgtgggcgtgccgcagctgaccgcgatcatggattgcgccgaggtggcgaagaagcgcgacgtgccggtgatcgccgatggcggcatcaagttctcgggcgatctggccaaggcgctggccgccggtgccaatgcggccatgatgggctcgctgctggccggtaccgacgaggcgccgggcgaggtggtgctctatcagggccggtcgtacaaatcctatcgcggcatgggctcggttggtgccatggcccgcggctcggccgaccgctatttccagcaggaaatcaaggacacgctgaagctggtgccggaaggcgtggaaggcatggtcccctataagggcccggtcgccggcgtcgttcaccagttggtcggcggtctgcgcgcggcgctgggctataccggcagcccgaccatcaccgatctgcaggagcgggcgaatttcgtccggatcagcggcgctggcctgcgcgaaagccatgtccatgacgtgaccgtcacccgcgaggcgccgaactatcgccagggctgacgttatccggtcacccgactgacgacttttccaatcggggcgggcggccgatggtcgcgcgccccgatcggtcattcattccctgcctgtcatcgtcccgccgtcatccgttcaggagccagagccccatgacccccgccgcccgtgtcgatgccgcgatcgagcttctggacaccgttttgcgcgaaacccgtcctgccgatcaggtcatcgcccactggctgcgcggccggcgttatgtcggctccaaggatcgcggctggatcgtcgaggcggtttatgcctcgctgcgcgaaaagcagcggctggaatggtgggcggcgcgcgtcggcctgccggcgcgggcgcgcagcctggtgatcgtggcgctgatgctgatcgaccaccgcaccggcaacgagatgccgaccctgttcgacggctcgacccacggcccctcgaaactgtcggacatcgaacagatggctgtgcagatgctccatggccaggatctggcggtggaaggccagccccgcgccgtgcgcctgaacctgccgggcatcgctgccgaccggctgatggcccggttcggcgaccggctggaagcgttgggcgaggcgatgaacacgcctgcaccggtcgatctgcgcgccaacggcatcaaggccgatcgtgacgaagtggcgaagcagctggcacgtgaaggcgtcgagtccgagccgaccccgttctcgcccatgggcctcaggctcgcccggcgcatgccgatcttccacacccgcgcgttcagcaacggcctggccgaagttcaggacgagggctcgcagctggtggccctgctggtcgatgcgaagccgggcgatcaggtcgccgatttctgcgccggtgccggcggcaagacgctggccatggccgccaccatggccaataagggccggatcatggcgctcgacatctcggaagcgcggctggagcggatgtccgagcgcatgcgccgtgccggcgtgcacaatatcgagcgccgcgccctgaagcacgagcgcgacccgtgggtccgtcgccataagctgaagttcgaccgggtgctggtcgatgccccctgcaccggctccggcacctggcgccgcgcgcccgatgccaagtggaagctgaccgaggaaaccatcgccgagctgaccgagctgcagggccgcatcctggaaagtgccgcccggctggtgaagaccggcgggcggatcgtctatgccacctgctcgctgctgcccgaagagaacgaggcgcgcgccgaggccttcctcgccagccatggcagcgaattccgccggctcgacgcccgcgagatcctgccaggcgatctggccgccgcgctgaagctcgacggccccgatctcgcgctcgaccccgccacccacggcaccgacggcttctatgccgtcgccttcgaacgcatcgccgacccggcgccgaccgaggcggtgcagggggatacggcgggcggctgagcgcctggtcagcccatttttgccatgataaggtgaccccggggagagccgcgcctctgagaaactataggtagtcgtggcttgagaggcagtgctggagatggcccggatcgtctccgtctccatccggcagcttgcggccggagatggccactggctgcaatggcagattgatccaccgccgccggatgccggtcttccggcgatcgtggccggggtgtttgcggaagggctggttcgccgtgcgcgggtgacgttgatcggatggcaggatccgtcaccatcggggcacggctgggtgcaactgccgggtggtgatcttgcggctgcaattccggaaggccggtttcagcgactggtcgatcggctgcgtggtctgccaaggccagtgtgccggtcgaccaccgatgccgatgtcgttgccgagatcatcacccgcgatgcatcctggagcgacggtgcccagatctgctttctgtcggcgcggactgatcctccgccatccccgcgcatctttcgcgtcctgcggccgcgggaagggctgacgcctgatcggcagcaggtgttggtgtcggaaggcgtcaccgcggttgtccgtcccgaagacgaaggccgggcatgccggatcgtctcgatcaggccgggcgccggcgcagccgtgctcgatgatgtgggaacaagtgcgcgggtggcgggttttgtggtggagacagggtcggattctgctgccacatgatccgcaggtgacggcggccggcccggacattccaggatctgtgaagcggtccgctatccggccgcctgccaacgccgtcgtcatggacacctcagaaatcatcctccgcctcggcatcgccactgccgccggtctgctgctgggcctcgaccgcgaattgcgcgggatttcggccggcatccgtacccatgcgctggtggcgatgagttcggcgctgattacggtgtcggcgctgattctctacgatgatctgcgggcctcggggcagcccgatctggatccgctgcgcgtggtccagggcctggcccaggcgatcggctttgtcgccgccggggcgatttttgtctcgaagtccgccgtccataacctgacatcggctgccaacatctggcttgctgcagccatcggcatagcttcgggcgcggggcagatgcgtctggtggcggtgggcgtggggctcggggtgatcatcgtcaccctggtcaggatcgtctcgaagctcattccggggagcgacaaggaggaggactgaccgccggtccttgtcgacatccattgctccgcatgcagggcgcgcttgccaatcgccatcgcacccggtttgctgatccgacatgatgatgggggatcaggcagtgtggatgggcagatcgggccggagcagccgatggcaggcggctgcaattgagaggcaggcgcagaaatggcaggccggcgcggcggagggctgtccccatggtctatgaccggctgtcccatccgcccctgccggtggttctggcggccgctgcccagcatatggggctgatggcggtcacgctggttttcccgctgctgatcgcccgcgcggcaggggccgatgcctcgatgcagggccactacatgcagctgtccatgctggcgatgggggtgggcacgctgatccaggcctggggcggacggcttttcgggcgcgtcaggatcggcagcggtttccttctgccggcggtgtttgccgccgcctatctgccgcccgcgcttcaggtggcccggaccggcggacttgaggcggtggccgggctcaccatcgcggccggcctctcgcagatcgtgctcagccgactgatcggccgcttgcggccctatctctcgatcgagatcgtgggcctggtcgttttcatgatcggcatcattctggggatcgtggccttcaggctgatcacggggatcgggcagccgcagccgctcgaaacgcgcggtacggggacggcgatcctggcgcttgcggtcatgctgggcctgtcggtctggggcggggcgcgtatccgcaatctggcggtgctgatcggcatggggctggggacgatcgcctatttcggcgccagcctgactatggggctgccctttgcagacggggcggcgccgctggaagtgatcgaatggccgctgatcgtgcccaccttcgaggccacggccctgcctggcttcctggtcggggcgctcgcctgcacgctcagggccttcggcgacgtcgtggccagtcagaaggccggagatcgggactggaggcgcccggactatccgaacatcgaggcgggcgtgctcgccgacggcatcggcagcgtcttcgccggggtgatcggcaccatgggcatcaacacctattcggccagtgtcggcctttctgtcgtgaccggcatccgggcacgacgggttgcgctggtcgcgggggccgggtgggtcgtgctcgccttcctgcccggctcggcgaccttcgtcctggccattccgcagggcgtgcttggcgcagcgctgctctttgcatcctgtttcgtggtgctggccggaatctccattctcggccagcgcatgctggatgcccgccggacgatcgtcatcgggctcgggctgctgctctgggtctcgttcgaccagatgcccgccttttatgcggacaacctgcccgacctgctgcggccggtggtgacctcgtccctggttctggggctgctgacggccctgctgctgaacgcggccttccggatcggcagccggacgacccggcaattcgcctggcggcccgccgacggcttcgcgccgctgcgtgattttctgcgcgaaagcggcgaggccggcggcgtgcgcgccgatgccatgctgcggctcgtccagctggccgacgaattcagccatgcagccccggcgctcgccggcgcaagcccggtcgcggtaaccacgcgcatggatgaataccgcctggaagtgtcgctgagctggacgggaacggcgctcgaacccggaccacagccgagcctcgaggatcatgtcgacgaagacggggtgatgaacggcgtcgtgctggcgctgatgacacgcctcgccgaccgcctgatccgccggcgcctgcctgatgggcggcatgaaatcctgtgcgtcgtggaacagtgagggtcgcgctcgtacaatcggacatgccctgatgacaaccaggcccactcaacgggccgcagggaggcgggaggaaatgtccatgcacaaatccatgctcacatccgatggcgccaccatccgctatgtcgacgagggggccggcgaggtgctgatcctgctgcatggctgggcgcagtcggcggcgatgttccggcatcagattgcggagttcgccgggatccggcgggtgatcgcacccgatttccgtgggcatggcacatcccccgactgcgcccacggtcatcgcatctaccgttttgcggccgatctggccgagctgatcgagcgggaagacatccggcgggcaactgttctgggctggtcgatgggggcgtcggtgctctgggcctatgtcgatcttttcggcagcgggcggatcgaccgctgcgtcttcgtcgacgagcccgcctcggtgatgcgtcaggccggcatgaccgacgacgaggcggccgatgccggcgccctgttcgatgccgcgaccatgatcggcatcgcgagccagctggcggggcccgacagtgcggcggcgcgggaggcttttctcgacggcatgatcactccgggcatcccgtcggagctgcggcgcttcctgctggacgagaaccttcgccccgaggcccggaccatcgccgcgctgttcgcggatcattgttcgatcgactggcgcgatgtgttcgcgcggttcgacatgccggtgctggtgatcggcggccgggtcagccatgtcgacatccgctcgcagatctggatccgcgaccggttgccggaggccgaactggtgatcctcgacgaagccgatggcggcgcgcatttcccgttcatcgaggcgccggaggttttcaacgccgtgctcgcaggcttcctcggcaccccgaccgccgccgccggggcagcctgagcgggcacgaccgtagtcgatcgaccgcaaggaacactcggtttcgctgttcgttgctcccgacccgataccactcccggtatcggcaatcgaggaggtcttatgacggaggtaaccggccggaaggcggccgtgcgcgccgccgatcagcagggtgaccaggcatcgggcagcacgcggcgtgccctggcggaactcgccctggcgatggtcctgttcggctcggcgacgccggtcgcccggatcgtgaccgcggcgatgccggtcttcgtggccggcagcttgcgggcggtgatcggcgccctgctgctgttgccggtgatcatccggcggcgcaaggcgctggccgcgatcgaccggcggagctggtggctgatcgtcttcatttccgccttcggcatggtcggctttaccgtcttcatgctctacggcatgcagatggtctcgggcatcgaaggctcggtggtgatgagcaccacgcccgcggtgacggcgctcgcctcggttctggtgctgaaggatcgggtgagctggcggacggtggttgccgtggcgctggcggtggcgggtgtcctggtgctgcagctgggcgccggcggcgttgcgggcgagggggccggtggcggcggccagggcggcaatggcggtagtggcggtagcggcgggccgggctggatcggcatgctgctggtcttcgccgccgtgtgctgccaggtcgcctataccctgctcggcaagctggcggcgcagcgggtggatccggtgctcgtcgcggccctgtctgcctggatggcgctgatcgtcttcctgccgctggcgctctggcagctgcccgatttcaccccgcgcgcggtgggtggcgaggcctgggcggcggccgtctggtacggcgccggcaccctcgccatgggcaactggctctggtatgccgggctcgcccgggtgcagggggccgtggcggcggggttcatggcgttgatgccgatgtcggcactggtgctgtcttacattctgctgggggagccgttccgcatggtgcatctggccggctttgtggtggtgctcgccagcgtgctcatgatctcgtgggagcatgcgcgcatggcccgccgggcggttacccgggcagagcggacggatcgcgcgggcgacgaggagagcgagatggtccgcggctgatcgcatgggccgcccgcgccgtctgcgcccttgccaaacccgcccggtcgtggttctctccgctccaccgggcggtggccggcgcgatggtccggcggcaccgccccgaccctcaggaggcgcgatgaccgaccgcatcctgatcctcgacttcggcagccaggtgacgcagctgatcgcgcgccgtgtgcgcgaggcgggggtctattccgaaatcaagccgttcagcgtcgattccgcgtggatcgaggctttcgcacccgcaggcgtgatcctgtcgggcggccccgcatcggtgaccgaggcggcgacgccgcgtgcgccggacgtggtcttccgcctgggcgtgccggtgctcggcatctgctatggtcagcagaccatggtcgatcagctgggcggccgggtggaagccgatgatcaccgcgagttcggccgcgcctatgtcgatgtccgcgatgcctgcccgctgttcgacagcgtctgggcgccgggcgagcgccaccaggtgtggatgagccatggcgaccgcgtgaccgcgctgcccgagggcttccgcgtggtcggcacctcggacggcgcgcccttcgccgccatcgccgacgatacccgccgcttcttcggcgtgcagttccaccccgaggtggtgcacaccccggacggggcgaagctgatcggtcatttcgtccgcgacatctgcggctgccccggcgactggaccatggccgccttccgcgagagcgcgatcgcgcgcatccgcgagcaggtgggccgcgagcgggtgatctgcggcctgtcgggcggcgtcgacagcgcggttgcggccaagctgatccacgaggcgatcggcgaccagctgacctgcgtcttcgtcgacaccggcctgctgcgctcgggcgaggccgaacaggtggtcgacctgttccgcggcgccttcaacatcccgctggtccatgtcgatgccggcccgctcttcctcgaaaagctggcgggcgtggacgatcctgagcgcaagcgcaagatcatcggcgcgaccttcatcgacgtgttcgaggctgaagcgaagaagatcggcggcgcctcgttcctggcccagggcacgctctatcccgacgtgatcgaatcggtctcgttcaccggcggcccgagcgtgaccatcaagtcgcatcacaatgtcggcggcctgcccgagcgcatgaacatgaagctcgtcgagccgctgcgtgaactgttcaaggacgaggtccgcgacctcggccgcgaactgggcctgcccgacggcttcgtcggccgccatcccttcccgggaccgggcctcgccatccgcgtgctgggcgccgtggccgaagaccgcctcgccatcctgcgcaaggccgaccggatctatctggaagagatccgcaatgctggcctttacgacgcgatctggcaggccttcgcggtgctgctgccggtccgctcggtgggcgtgatgggcgacggccgcacctacgacaatgtctgcgcgctgcgcgccgtcacctccaccgacggcatgaccgccgacagctaccccttcgaccacgccttcctgagccatgtggcgcacaggatcatcaacgaggtcaagggcatcaaccgggtgacctatgacgtgacgtcgaagccgcctggaacgatcgagtgggagtgaggggccgcggcctctgacagatcgctggactgagggaaaccgccggggcgaaagcttcggcggttttcgtcttccaggactcacagccttaccggacaacttgctcctgagtttcgacctgttccaccggcttgggatcgtcggcttcatcgggcccatcggcgaaagaccgtcgtcgccgctttgtgccagtagagctgatcccaaggccgatatagcactgctatagactcgatcctatagcggtgctatagtctgaaaacggtcaggagggcggcacccgatatggatacgaagacggcactggtggcggcggccctgacgctgatcgagaaggagggcgcggcggctttctcgacccgggcggtctgcgacatcgcgaaggtgacggcgcccaccctttatcatcatttccggagcgccgacggtctgttgagcgcggcgatcgccgaagcgttcgaacagttcctgtcatcgaagagggcggccatccggtcgacggatccggtcgcggcgctgatcgaaggctgggacaactatgtcggattcgccgcggcgcgcccccgcctttacgcggcgatgatggcgcggttcctctcgggcgccgatctgccggcagcgcgggagggacaggccatgctgcgccagcgcattgcgcagatcgaggctgccggccggctggcgatcgcgcccgaggcggccgttcaggtcatctgggcctcggcgaattccgccgcgctgctgttcctcggcaccacgcttcagcccggcgtcgatatgggcactcccgatcccgtccccatcgcccggctgcgcgatggcgccgtgcaggcgatctgcaccccggctctaccggagtagacgcatgaaaatctttgtgaccggcgggtccggctttctcggcgcgcgccttatccccaggctgatggcggaaggccacgaggtgctggccatggcccgctcgccattggccgatggcaagctgcgggcgcttggggcggtgccggttcgcggcgacatgaacaatcccggcgacatggcaatgccgccggtcgacgcggtcatccatctggcggctcacttccgctttgccggtccgcgcgcgccatacttccgcgtcaatgtcgacggcacgaaagcgctgttgaaggccgcgcgggcagcgggggcgtcatccttcatctatctgacggcggcggccgtcatcatggacgatcatggctcgccgatccgcaatgccgacgagcgggcgccgaccttttcgaagagtttctcgccctacatcgccagcaaggcgaccagcgaggccggcgttctggcagccagcggctccggtctccgcaccatcgccattcgtcccccgggcatctgggggccgggcgacgccttcagccgaaacatcccgcacgcgatcaggtcgggccggttcgctttcatcgcgcgcggcgactatccctattccacctgccatgtcgacaatgtcgtcgaagcgctgatctgcgcgctcgaccggggcgagggcggccgggcctatttcatccgcgatcccgagaacacgaccttccgcgccttcatcgacgggttggcgaagctgcaggggctgtcgatcgacacgcttcgttcggttccctatggggcggccttcttcatggggcgcatgatggaactgggcgcccgcgtcaggcgctcggatcaggatcccccgctgagccgaacgatggtgcgcctgatcggcagcccgttcacgatcaacgacagcgccgcgcggcgggatctgggctatgtgggcaaggtttcgcgtctggaggggctggcctcttacggggcgggcctgccgtagatgccgacccggaaagccggctctgatggctgatcgatcccgacagatgccggtttctggtgtctcgccggcatctgccgctcaccgcaggcgtcgcgcggcgttggactgagcctcgcggatcaggcctgaatacatattctccttgccggggtaccaaggcatggagccgacagatccgaagcctgggatcgtctccatatgtgccaccatgcgggcgcgcatgcgttcgtcgggaagcgggccggtcatcgcctggacgttgtcgctcatgtggtcggggttggacgtaccgcacagcacgctcgtgacggcgggatgcgccatgacccatttgaggaagaactgcgcccaactcgtcgcgccaaactcctgcgcgaagcctggcagcggctgaccctcgaccaccttcatcagtcgcgccttttcaagcggtagatttataagcacgccgacgcccttgttggcggccgccggaagcaggcggcgttcggcgtcgcggttgaagattgagtagttcgtctggatgaagtcgacatcttcgcgttccacaatggccgtcaactggtcctgtgctgccgaatcgtgatgggttacgccgacatggcgtatgaggccctcctgcttccaggccttcatgagtgggatgatgactggcgcattgatgatgctgtggcattgcataagattgatcctgtcgcgccatgtccgcagacgcgactgccggaagctctcttccgcgtggctttcatcgccgagatactctccggtggcccagattttgttggcgaggaagatctcgtcagatcccggatgctcgcccatgaactggccgacgctgacttcggccgagccgtagagcggcgaagtgtcgaccacgcggccgcctgctgcaatgtagcgttcgaagacttgccggagaccatcgcggctggcgcccggcttcagatcgaaggtcaggaaggtgccgagcccgagggtcgtgacccgttcgccggtgcgcggcaaggtgcgggtcaatacatcgggaatcgatcctgacactggcgataccgtattcggacctgggacctgtgccgtggcgtgggtagccagggccagccctgttgccgccgcccccatggtgccgagaaaacgacgtctgttgatcttcggctgattcatgaaatctctcctctttcctgagattcggaactggcggggttggcaggctcgatgtgagtcccgtcgaagccgacagcggcccgggtttcagcgtcagcctcgatccgaccggtgaaaggaagcagtcagggcgcgccgaccgatttttctacaaccatgacacgagactattgatctgataatctgcacaaaattgacaagcttggtaagaagtgcttcgcaatggatccggttcgcctggacagcttcgatgtgttcgtggcgattgtccgctgcggcggcttccgcgcagcagcactcgagcgaggcgtgtcgtcctcggccttgagccaaacgatgaacgccctggaagaggcactcggcatccgtctcctcaatcggacgacccgaagcgtgtctccgacggaagcagggcaacgcctcctcgaacgtctgagccctgcactgagtgagatcaggctcgccatcgcagaggtcgatgagttgagggatagcccctccggaaccttgcggatcaacgcgccggcccccgccgtcgatcattttctctgtccgctggcattcgacttcatggatatccaccgtgaggtgaagattgaaatcatcagcgacgcagctgtcattgacattgtggagcacgggtttgatgccggcgtccggtttggcaagcagctcgcgcaggacatgatcgcgcttccgtttggccccccgcttcgatatgccatcgtcgcgtcaccggactacatcaaaaggcacggccagccgcagacaccgcaagacctcgtcagtcatgactgcatcaagcgcaggtttccaggcggtacgctcgtcacctggcggtttgccgagggggatgaagaggtgacgatctcacccagaggccgcctgacggtcagctcggcgcataatgagctgcaggcggcgctggccggcagaggattcgcacatgtcttcgacgattatgccaaacctcatatccggagcggtcggctggtggaggttctctccgattggagcctgactttgccgcactggtttctgtactatcccagccgccgcctcccgagcgctgccatgcgcgcatttctcgattacatgagaagttacgactggcgggggcaacagtaacggcacccatgccatgtcggctggggggcagcaatgctggtgatatccggggccatcgaggcatcagcacagctgttgcatgggcggcaactggttgaattgtccgatcatctgatccgagggcaggacgtcggcttttatcagagactcgagcccgtcggcatcgcgatccgatggatgaggtgagttggccgtctacgtaccggtcgccatcagacctgcaaaccgccccttccgctttaccagctcgtcatgcgtgccggcctcgacgatccgcccgccatccagcaccaggatcagcccggcctggcggatggtcgacaggcgatgggcgatgacgatgcgggtggcgggcagggcctggatggtctgcatcacccgcgcctgggtggggccgtcgagggcgctggtgggttcgtccagcaccaggaccggcggccgctggaccagggcacgcgccaatgccaggcgctgaagctgtccgcccgagagcatgcgggtcgcatcgggcagcagggtgtggagccccatgggcatggccgcgacatcctggtccagggcggcggcggccagggcggcccgcacctcgtcggggccggcatcgctgatgccgcggacgatgtcgaggatcgatcccggaggcagggcctcgtcctggagcaccgtgccgatctggcgcctgagggcggtgggatgcagggtgcggagatcgtggccgtcgacatagatcgcccccgccccgggggcctccagccccagcagcagccggaccagggtggatttgccgctgcccgaggggccgacgatcgcgaccatctgcccgggggtaacccggaacgagatgtcggacagcaccggcggcccgctttcataggcaaagccgacggcggcgaagctgatctcgcccgaaagcggccccggatcggtgaggcccgtcgagggcggcggcacccgttccagcagcgggcgggcgaactgccagccgggcagcatcatccaggcacccagcagcgcccgcaggaattgcgatagcccgcccgccatcaggccgaaggcggtggcgatggcggcaatggcggcgatggacagggccggtgcgccctcggtcgtctcggccagcccttgcatcactgcgaacaacgccgccgtggccaggatcgggaaggcggcctgccagctttcgaacagattgccgatccgccgcgcccggaccgagcggtcgcgcatggcggcaaaacgatcggcccagcgcagcacggcccggtcttctgccgcggcgctgcgcagcttgaccatggcgttgatcatctgcagcagctgggcgtccgcggtgccgatcagctcctcgccattgcgataggcacgcgcctgggcatggccggcgacaaggccgatcagaaggtgcacccccgccagaccggcggcgagcccggccagaagcgggctgtgccaggcgatgacggcgagcgacgagaccagcatgccgagcgtgctgccgctcagatagagcatctggcggaagcccgaaatgctgccgagccctgccccgagctgggccgcgaggaaggcggccgggcgcgatctcaggaatggcaggggcagggcgatgatccgcgcccaggcacgatcgaacaggccggcatcgccgcgcatggcgatccgttcccgcgccgcctcggtggcgacctggatgaggtagccggcgccggcgaccagcagcatcagcagcccgatctggaccagcgccccgcgcagcgccgccggcaccagcagcccgaagaccaggccggtgacgatcggcaggatctggccgatcaggctgccgatcagcgtcgcggccaggaagaccagactgtcgggcccggccctggtcaggccggcggccatcatggcggccagtccggtctgccggggcaggggccggaagatctggaaggccgcgggcgcgatgtcggcggcggatgcagccgtgacccgtcggcgggcgccgtggcggtcgatcatgtcgtaatgtccgccgcgccagacgagccccaccggccggccttgatggcgggccagcagcaggcccgcctcctgccgccaccacctgtcgggcagctctatctggcggagcagcaggcccgaggcgcgggcgatctcgtccagcccgggcagccggtccatctgcgcgcgccgggccgtggccggccgccggaccggcacgcccagttcgcggccgagcaggcgcagcacgtcgagcagaccatcgccaccatcggcttcggcgagcggcggtacccggttgccgagcagcccggcgaagcgcgccagggtctggtgatggtcctgggcacccgcatgatcgcgggcgcggatccggttcagttcgtcggcctcggccagaccgcgcaggaccggcagcaattccgccaccgccgccccccaggcggcgagcgcatccggccagtccggccgggccaggccctcggcaaagggcagcaggtcgatatgcgcggcatggtcgagcgtcagccagctgcctgcgggcagggggacgagccccgaaaccggctccaggccgcagaaccgggcccaggccccggccggcagctgcacccaggtgatgccggcggtggcgccgatcaccgatccggcaccgagccggacagccgtcgcccgctgaccggtggcgaccagatccggcaccggccggggctcgatcatccggcccagcccgccgcccagagcggtcagccagccggcgatgccggcggtgaagtcgggcaggccggcgctgttgcgccagagcgcgtcggggatctgccagatcagcgtgacggcgtcgccgaccgcgatcagatgctcggccccgagcagggacggtgccgcaccgaacagcaggccgccgctttcgatccggccgaccgccatgcgggccgtcgggcgttccgaggacagggcgaagaggtcgaccggcccgcccatgaccagatagcagctgcccggccggtccagcaccagggggcgttcggtcacggggcgcggcggcggcggtggttgcgtggcggtgggccgatccatccggctcacccctcggccatcagctgaaggaaggggccggggcgggagagcagggcctcgggcgtgccctcctgcacgatggcgccccggtccatcacgatcacgcggtcgcagtcacggatggcgctgaagcggtgggcgacgatgatcatggttgcacccagccggcgcagaccggcatgcagcttcgcctcggtttcgttgtcgaggaaggctgtggcctcgtcgaggatcagaatgcgcggctcgcggaccagggcacgggcgatctcgatccgggcacgctggccgccggacagatcggtgccgccctcggcgagatggccgccatagccgccggggcggcgcaggatgacgtcgtggatcagcgccatgcgggcagcctcgacgatccgctcgtcgggcagggacgggtcccagagcgcgatgttgtcgcggatgctgccctccaggatcgcggcgcgctgatcgacataggcgagcgactggcgcagccgcgcccgcgggatcgcgctcatcgccgtaccgtcgatcaggatgtcgcccgccgacggcggatgaatgccggcgatcagcgccgccagggtcgacttccccgagcccgaggccccgacgatacccagccgttcaccggccttaagcgagaggttgagatcccggatcagcggcgccgtggccgggccatagccggcgctgacatcccgaagctcgatggcaccgatcaggcgaccggaggtcgtctcgggggcggcgggcatcggggcgaattcgggcgccgtagggtggcgcaatgtgtcgtccagaacctggatataggcctgaccgtcctggatcctggcgccgagctggaccagctgggccatcggcgccaggaagcccgccatcagggcctgaaaggcgatcaacatgccgagggtcagttcgccgcggatcaccatgtcggccccgatcaccagcaccagcccgcccagtgcgagactggtgaggccgggcagggcggtcagccgcatgcgccgccgggccagcccctggcggaggttcagcacccgggcagacatggccgacagccgcgcgcggaacagatcctcgaggcccgcggccttgtaggcctcgatcatacccagcccctgcctggcgaagccggcctgcatggtgccggcgaccaccatccgccggttgtcgtcggcgagcgcgcgcgaggatcgggtgagcagggcgagattgaccacagcccccgccgcgaccagcaggccgagccggggggcatagaacatcatggcggccagataggcggtcgccgtcagcaggttcagcagcactgcgccgacatcgccggcgatcagctgggccagccggtcgttcagcatcacccggctcgccacctcgcccggatggcgctgggcgaaatagagcaggggcaggcggacgacatggccgacgaaaccggccgcaccctgaagcgccagccgggtttcgagccgcagcagggcttcgcgctgcagaaaggtgagcgcggccatcagcaccgccgccagccccatgcccaggatcagcggccagagccaggttgcgaaacggttgaccagaatctggtcgatgaagatctgggcgaagaccggcaccagcagccccggcaccaccagggcgagcgagaccatcaggatgaagccgaaggcatcgccggcaccgtggagccgccgggtgagcccgcggacaagcgaggggcggctgccccggcgtcggaagccggggccgggctgcatgaacagcacgatgcccgtgaacatgcggtcgaattcggcggcgcccacctcccgcgggccggtggcggggtcgttcagccggacgcggtcaccgctgaagccttccaccaccaggaagtggttcatgccccaatggatgatcgccggcagctcgcgggcgcggagatcggccggttccagccgttcggcctgggcctccaaccccatcgcgcgggcggcgcgcaggatggcgagcgcggaactgccgtcgcgggagacattacaggccaggcgcagttcttccagcgtcacccagcagccataatgccccagaatgatgccgagcgccgccgccccgcattctgcggcctccatctgcaacagggtgggggtacgcctccgccggccggacattcagcggccgtcgcgcggcacgtccgggccggcatactggagcgcagggatggcgagggcgagcagcggccccgaccggatggtgaagcgcagctcggccagcgttccgggctcgatccggggcggatgggcgcggggggacgaccagagcgggcgatccggccgcgccgggtcggggtcgatcgccaccgtcacctcgaagggcgcgcccatgccgtcctggaaggtctgcaccagccggtcgttctgcagggtcttgagcatgccggcactgctggcgggcacgtcgctgacatgcagcacatggccacgcagaaagccgtgttcctcgcgctgtgtcgtggcgggtgaaatctcgaccggctgccccgcacggatcttcttgccgtcggccgcggtgacataggcggtgacatagggcagggtgcttctgccatcggccggctccgcctgccgctccagggtcaccatggcggtgccgggctggaccatctggccgacattgaccttggcttccaccacccgcccggcgaagggggagcgcaccgtgctgctgcgggcaagctgtcggtccagggccgccagctcccgctcggcctcggcgagccgccgctcggcttccagccgcgccttttcgcgctcggtcgcctggagcgcggcttcggcctgcatggcgacccgctcgtcgcgggcatcggcgatgctgctttcgaccgccagcacttcctgatccacctgcaacagccggtcgcgggtgacattgccggttttgagcaggcggcgaagattggcctgttggtcgcggagggcggcaccgcgcagctccagcgcctggatccgctctgccagagaggcttcgcgggcggcgcgcagccgggcccgattggcatcgtcggccgcctggaagcggatcagatcgtcacggaatctgagcgcatcggcacgttcggcacgggcgatatcgcgtttcagctccagatccggctgggcgatacgggcgaccaccgctccctccgtcaccggcgtgcccggggcggcgtcgagtgccagcacctggccggccgcgtctgccaccacgtcgatcatgccgcccggggcgagcaggatgccctgtcccgtcaccgagaccggcacccggaagagggcgctccacaccagcgctcccaggatcaggacaaccagaaacaggccgcccgcccagaggcgcggtcgcatgacgccgagcgcgtcgcggtactgatttgaggtcgccgatgaactgacggcagccgggcggaagagcgcgctcacccgtcaaggcccccgcagctgatcggccggccggtcgcggcgtatcaacgcatattgccgatgatgttgttgaaattgttctgcatgctgttcatgaactgctgcatcagcgctattgcttcgttgcgcttgtcggtcatggcctgcagggccgccatctccatgtcctgggcggccgtgaccgtggtgatccggtcctgcagcaggccggtgatcgcatccatgtccgcagaatcgatgctgccgtcatcgatccgctcctgatccaggcccagatcggcggcgagggcaccgagcgtggtctcctggcccatatggtggacgagcgtgtcggtcgagagcgggccctggtcctccagcatgtcgcccaaaccgtccagttcctgcagggtgccgttcatctgggcgagctgggtgttgcgctcctggattccgtccatctgctgctgcaggctggtgtccagctgaccctgcctttcctgctgcaccatggccaggatctggttcatatccatattggacagatccatggagttgaagttcaggccgcctgacgagccacccgtcactttcgccagatcctcgtccgcgacgatggtcgacggcttgctctcttgcgtcatctctgcctcccggtcagcgcccgatctcgtgcggccactatgcgggacatgagatgtgccagtcaatccagggtaatggagctggtcaacggcgggtgaccgcgccgatgcgcagacaacgccggaagatacggcaagtattagtatatgattctgcaccagtgcacattcgggtatggtttgtgaccgccgtcacgtctctcgatgtggcggcggccgagccggggtctcagaccttcattgatctgagccggagtgcgttgccgatgacgctcaccgacgacagcgccatggcggcagcggcgatgaccggtgacagcagcaggccgaacaccggatagagcacgcccgctgccaccggaatgccggcggcgttatagatgaaggcgaagacgaggttctgacggatattcgtcatggtggcctgggacaggcggcgcgcctttacgatgccggtgagatcacccttgagcagggtgatgccggcactttcgatcgcaacatcggtgcccgaccccatggcgatgccgacatcggcggcggcgagtgccggggcgtcgttgacgccgtcgccggccatcgccaccacccggccctcggccttcagccgctggataatttcggccttgcggtccggcaggacatctgcctccacctcgtcgatgccgatacgccgggcgacggcctcggcggtggtgcggttgtcaccggtcagcatgacgatgcggatgccgtctgcatggagcgccgtcagcgcatcgggcgtggtctgcttgacgggatcggcgatggcgaagataccggcagcgcgaccgtccacgccgatataaatcgctgtcgcaccgtcctgccgcagggtgtcggcctggtcggagagaggcgacgcgtcgatgccctgttcctccaggaaggcggcattgccgagtacgatctgtcgcccttcgacgatcccgctggcgcccttgccggtgggggagtcgaagtcggtgacctggggtagccggatgtccctggcctccgccgcagcgacgatcgcatgcgcgagcggatgttccgaggcagcttcgacagcgcctgcaaggcgcaggatatctttctcctcatggctcggtccgacggcgatgtgcgtcaccgccggacggccttcggtcagtgtgccggtcttgtcgaccaccagcgtgtcgaccttctccatccgttccagcgcttcggcgttcttgatcagcacgccggcggcggcgcccttgccgacgcccaccatgatggacatgggcgtggccagaccgagggcacaggggcaggcgatgatcagaaccgagacagcggcgatcaacccgtgggccagacgcggtgacggaccccagagtccccaggcggcgaaggcgagcagcgccatcacgatgacgatggggacgaaccagcccgacacctgatcggccatgcgctggatgggggcccgggagcgctgggcatccgccaccatctgcacgatgcgtgcgagcatcgtatcccggccgactttttcggcgcggatgaccagagcgctcgtctggttgagcgttccgccgacgacccggtcgccggcgctgcggccgaccggcatcgattcgccggtcaccatggattcgtccagcgaggagcggccgtcctcgacgatgccgtccacaggtacggtttcacccggccgcacccgcagacggtcgccgatggcgacgtcctccaccgcaatatcggcctcggcaccatcggccccgatccgccgtgccgtctttggggtgaggttcagaagggcgcggagggcgcccgaggtgtgctcacgggcgcgcagttccagcacctggcccagcaggaccaggacggtgatcaccgctgccgcttcgaaatagaccgcgacggtgccgtcggcgccgcgaaacgcctcgggaaaaacgcccggtgccagggtggcgacgacgctgtaggtccaggcaacccccgttcccatggcgatcagggtgaacatgttgaggctgcgattgacgatcgaggaccagccacgacggaagaacggccagcccgcccacagcaccaccggggttgccaggatgaactggatccagaccgataccccggccgggatcaggcgatgcagggcgggcacgagatgagcccccatttccagcaggaagaccggaatcgccagcagcagaccgaaccggaaacgtcgggtcatatcggtgagttcggggctgggcccgctttcggcggtggccatcagcggttccagcgccatcccgcagatcgggcagctgccggggccgtccttgcggatctcgggatgcatggggcaggtccagacggtgccaggcggggcgtcgattgccccggcctttccggccgcgtgcatgtgcccgtgcccgtgcccgtgcatgtgcccgtccatgtgatggtgggaatggtcgtgatgcgattgatggtgatcggacatgatgacgatggccccctttcgtgttccgggcgcaaaaccggcggtatgacgggatggacgatgccctgaggggcgtcgtccttcggtcaggccagaggtcgcggcggaccggggggcggagacagtgcgatgccgtccggcaaggggtcgctgcgcgcgggcaggagaatggccgcaacggtgcggatcatgccgccgtcgaggcccgatggcgtcgggcagcccaggcgacagatgcccaggccacagatggatgtggggcagcgctgcgcgtgcagggaggtctggccgcccatgatcgacggtctgccggagatgtggtcgggacccccgatgatcggatgttcctccgcggacggggcggccgtgattgcagcacgcggccagcggtccggtgatcgaggccagcagaaacacgagcaccagaaggctctgaaccagcatgccagcccgggcgtgtcggcgagggtggtccgtcacgggtgcagtcccttcagattcagggcgccggcagatccgccagacattgcatatgcgttgaccatttcgccctgaggcggcggtgtcaagcaggtctggatgatttgttcttgatatgttcggatccggctgagaggatgagggcccccgatatgatgatggaggtcgccaatgaccctcccggcagctgatcccggccgcgtcttccgcaggctccacgaggcacccggcgccttcatcctgcccaatccctgggatgcgggcaccgcgcggatcctggcggcgatgggcttcccggcccttgcgaccaccagcgccggcatggccttttccgccggccagccggaaggcgtggccgggcgggcgcaggttctggcccattgccggtcgatcgtcgacgcgacggcgctgccggtctcggccgatctggagaaggggttcggcgatgatccggacagcgctgccgaaaccgtccgggctgcggcggcggccgggcttgccggctgttcgctggaagatcacaccggcgacaggtcgcagccgatttatgaccacgggctcgcggtcgagcgcattgcggctgcggcagaggccgcccgcgggctggatcgggacttcgtgctgacggcgcgggccgagaatttcatgtggggtcgcccggatctggacgacaccatccgccgccttcaggcctttgaagcggccggcgccgacgtcctctatgcgccgggcctgccggatctggaggcggtgcgcagtgtctgtgccgccgtgagccggccggtcaatgtggtgatcggcatcgcgggcatggcggcttcggccgatgaactggccgcggcaggcgtgaagcggatcagcctggggtcgaccctcgcccggctcgccttcggtgccttcgtccgggccgcgcgcgagatgcgccgcgacggcagtttcggctttgccggccaggccatgcctttcgcggagctggaaggcttcttccgcgatccgcccgaaggggcggcccggccggcatagagaccgccccgggtcagccgcggccgcgttcatacaccccgaccagcccggcttcggcgagcatatgcggccgggcggcggcccagatttcgccgacgcggcggcccgggtcgacatccagatggtcgatgtcgagtgcagccaggcggaagtaatagtgatgggggccgtggccttcgggtggctcgggaccgtcataggccgctgaaccgaaatcattggtgccgtggtggacgccgctgccgggacgaccggcgccttcctccagtccggtccgatcggcgtgcaggtcgaataccgcccagtgccggaaggtgccgccgggggcatcggggtcctcgacgatcagcaggaagcttcgggtgccctcgggcgcgtcctgccagtcgaggggtggcgacagattgtcccccgtccgggcgaaacggtcgggaatgcgttcgccatcggcgaaagcggggctccggagtgtgagcggcatggatccggtctcctgatcggcgggcgatgcgcccattgccgtccgaacccctgccggggcggcgtgttccgatctcggccggcggccccctcggacattgctgcgtcagacattgcccgccagggccgagggcggccggcccagcaggcgccggaccatggtcgagaaggcggccgggctgtcataacccagatccagcgccacggtggtgaccgcctgaccggcggcgagtctggagagggccgccatcaggcaggcctgacggcgccaggccccgaaggagaggccggtctggctgcggaagaagcgggtgaagctgcgcgggctcatcgccagccggcgagcgatgtcgtcggggcggatgcgaatatcgggggcgcgcaggatctcgcggcagagcgcgccgaggcgcggatccggcggcagcggcgcaaagaccggcagcaccggggcggcggcaagctcgtgcaggatcaacccgatcaacgccccctcgcggcccgcctgatcatagagggcgggtagttccgcagcagagagcagcagctggtggagcaggggcgagacggtcagcacctcgcagaccgccgccggacgcggcgctgccgccggttcgatgtacaggctgcgggtcgcgaccccgaccatccgcaccgcatggcgggcgccggcggggatccagaccccggcatgcggcggcaccacccaggcaccatcggcggtctccacctccatcagcccggtcatgccgtagagaaactgcgcgcgacgatgggtatggggcggcagctgcgccccgtaccgatagtcggtgccgatcgccagcaccggacgcggggtggcatcgaccgtgtcgagggcgatgttgcgcaagggagggcacccttccggaaatgtggcctgaacacgaagatagtcggctgatcttcgaaagccggcaaggcctgccgacgccatgatggcccggacgctgcctcatccggatccccgtgtcatgcatcttccgatcgatcttaatcttctgcttctggccttcggcgggctcgccgggctcaccaccgttctgttcggcttcggcggcggtttcgtcgccgtacccttgctctatgcgatgttcacggccgtcggcaccgcgcctgcgcaggccatgcatgtggcggtcgcgacctccacggccgtgatgatcgtcggcgccggcttcgccagcctgcgccatgcccgtgccggcactctggacatggggcagctgcggccgctgatcctgccggtcagcctgggggccgtgatcggcgcccgggcggcgatctcgttcgggggcgaaggcctcagggcggccttcatcgcctatctgggcctcaccatcctcgactgcctgttccggcccggtttcatgacccgtgcggcgaggccggcccggccgatgcggcggcgggccacggccctgatcgggctgggtatcggcgcggtcgcggcctttctgggcgtcggcggcagcgtgatgaccgtgccgctgctgcgccggcgcggcgccgacatgaccaccgccaccgcgatggcaagcccgctttccctgccgatggcggtggcggggacgatcggctatgtggggctggccgagggagcgacgggacaggtcgatgccggcgcctttctggccctcgcgatcggatcgacgatcggcgtcaggctgagcgcgccgctgatcggccgcctgcccgatcgtctgcatgccagagcatatcttgtgctgctcaccctggtgctggtggtgatggttctgctgtgaccgagggctcgctttttccgtgggaaatggtgtggaatttctcttgggctgaagggttccgatgcaatagggttcggtcaaaagccgaaccgggaggaacgaccccatgaccgacacgaccgatgcccccttcgtcgtcgtcaccggcacctgcgacaccaagagcgacgagctggtctatctgcgggatctgatccgtgcggccggcgtggccgtgaaactggtcgatgtggccccccgcggcagctccggggccgccgacgtcacgacgcgggacgtgctgtccgcgctaccgggggcggcggaagaactggccgcaacggcggatcgcggccaggcggtcgccattgtcgcgcgggccttcgcggcctgggtggatgcgcaggcgccccggattctgggtatgatcggggcgggcggttcgggcaataccgcactgatcaccccggggatggggcggcttccggtcggcacgcccaagatcatgatctcgaccgtcgcctcaggcgatgtggcgccctatgtggggcccaacgacatcgccatgctctattcggtggtcgatctggccgggctgaattcgatctcgcgcagggttctgggcaatgccgccaacatgatggccggcgccgtcacccggccgctgcccgacgccgtggtaccggagaagcccgcgctcggcctcaccatgttcggcgtcaccaccccctgcatcgaacaggtggtggcgcggctggaggccgattacgaatgcttcgttttccacgccaccggcaccggcggtcggacgatggagaaattggccgatagcggccgccttgccggcatgatcgacgtgaccaccaccgaggtcgccgatctgctgatgggcggggtgatgagtgcgggcgaggaccggctgggtgcggcgatccgcacgcggctgccctatgtcggttcgtgcggtgcgctcgacatggtgaatttcggcgggctggagaccgtgcccgcgcgctatcgcgaccggcagcttcatgtccacaatgcccaggtcacgctgatgcggaccacgcccgaggagaacgaccggatgggccgctggatcggcgagcggctgaaccgcatggagggcgaggtccgcttcctgctgccgctgggcggcgtgtcggtgatcgatgtgcccggcgcgcccttccacgaccccgaggccgatgccgccctgttcgctgcactgcgcgagacggtccgccagaccgatcgccggcggctgatcgacctgccccatgccgtcaacgaccccgcttttgccgaggcggtggtggcggccttcctcgacattgccgggagatgatgatgacccgtttcgatcgtggccagctgatggaccgtttccgccggatggtggccgaccggatcccgatcatcggcggcggggccgggaccggcctctcggccaaatgcgaggaagccggcgggatcgacctcatcgtgatctacaattccggccgctatcgcatggccgggcgcggctcgctgtcgggcctgctcgcctatggcaatgccaacgggatcgtgatggagatggcgcgcgaggtgctgccggtggtgaagcacaccccggtcctggccggcgtcaacggcaccgacccgttctgcatcttcgatcactatctggaccagctgaaggcgttgggtttcgcgggcgtgcagaacttcccgaccgtggggttgatcgacggcgtgttccgccagaacctggaagagaccggcatgggctatgcccatgaggtggagatgatccggcttgcggccgcgaaagacatgctgaccacgccctatgtcttcggcgaggcggatgcggtcgccatggccgaggccggcgccgacatcatcgtctgccatctggggctgaccaccggcggcagcatcggggccgacaccgccgtgaagctggaagactgcccggcgatggtcgaccgctgggcggcggctgcgcaatcggtcaatcccgatgtcatcgtgctggtccatggcgggccggtttcgatgcccgaggatgcgcgctatgtgctgaagaccgcgcgccactgccacggcttctatggggcgagttccatggagcgcctgccgaccgaggtggcgttgaccgagcagacccgggcgttcaagtcgatctcgttctgagcggggtgcaggatgcgggcgacctatgatccgctgttcacgctgaagccggtggcagaggatgtgtggatcgtcgacgggccggtgatccgctatggcatgccctggccgaaaattccgtttccgacgcggaccaccatcatccgcctgccggacgggcggctgttcgtgcactcccccaccgagctgacgccggagcttcgggccgcgatcgaccggatcggccggcctgcctggatcatcggccccaaccgcatccattactggtggatccccgactggtcggcggcctggcccgaggccgtggtgtatcttgcgccccgcatccccgaacaggcgggcgaccggatccgcggcccctttcagccgctggacgggccggggccctggccctgggacggggtgctggacaccatgccggttgccggcgatttcatgaccgagatcgtgttctttcaccgtcccagccggacactgatcctgaccgacctgatcgagaattttgagcgcgagcggctgggctcgccgctactgtgcatcgcctgccggctgggcggggtgctggcgccgcatggctccatgcccagggatatgcggctgaccttccgtcacaaccgcgccgggcttaaatcggcggtcgagaccatgatcggccaggctcccgagcgggtgatcctggcccatggccgctggttcgaaaccgacgggacggcgcggctcagacagtccttttcatggctgctgtcctgacgccgcgggattcagccgccccttcgaagggggcgggccccctccatgaacagccgtaccacgaccgcgaattcgtcgcggagggacaggccgggctcggtgagccagcgcatgatggcgccgaaatagagatggtgcagcccattggccagatggtcggcggagagggtgccggtcagctctccagcggcctggcccgcttcgaccagctcgcgccagacatgggtgatgtcgctctcggtgcagggggggcgtgcagcgccgtcctgagcaaaaatggtgaagcggtgtcggatataggtcgccatatagcccgggtgggcctcgcaccaggccgctgaactgtcgagcacccagaagaggcgcgcggccacgccatcgcgcccgtaaaagccggcccgaagcttcgcccgttcgcgcgcgaattcctggtccatccaatgcgccagcaccgcttccttggtggggaaatggttgtagagcgtgcgcttggcgacgccggcttcggcggcgatctgctccatcgtgacggcatcatagcccgccgcggcgaacaggcgctgcgcggtcagggccagatggtccagcatctgccggcgcttgcgctccctccgtcccattgtctcgtccgggtgcagcgtctcgtccggggccatcgtccggtctgaaaccgtgttgccggctgtcatctccgggtccgggtcatttccggctcctgctcggttccgatctttacaaaagtatacgacgtgcatttatatacggcgacgaagcccgggcgtcacccggattcgccacgcaccccgcgaaggcatcccccgatgaagttcaccatcgtcacctacggcaccgagggcgatacccgcccgttggccgtgctggcgcgtgggctgatggatgccggtcatcgggtgcggctgcttgccgatgcgtccacgctgagcagcgcctatgcgctgggcgtgccggcgaccgggctttcgggcgacatccgccaggatctgcagcctggggaagtgctgtctgacctggtcggcgatcccgacggtgtggatggcacggcgcgcgcagcggcaaaagtggtgaacccgctggtcgaaggctggatgcggcaggttctggcggctgcggccggcagcgacgccatcctgccctcggcccttgccgcctttgtcgggttttcggtggcggaatgcctgaaagtgccggccatcggcctcgggaccattccgctgtcgccgacctcggcctttccgtcgcccttcatccggcccgggcgcgtgttcaggccgttcaaccgcctgagccacaggctggtcaacgagcggttctggcgaggcctcgccgagagcaccaatgccgcccgtcgcagggtctgcggtctgccgccccggctccacgcctggcgggatcatccgatgctctacggcatttcgccgggcctggtgccccggccgggagactggccggtcacggcgcgggtctgcgggcaatgggtccggccggcagcggcctggacgccgccgccggcgctcgaggcgtttctgtcggcggggccgccacctgtctatatcggcttcggcagcatggcgggcatggatccgcggttgctgacccgcgaggtgtcacggctggccggacgccaccgcatcgtgttcagcccgggctggagcggtgtcgaccccggtgatctgcccgagagcgtgttcgtcatcggcgaggctccccacgaccgactgtttccgcggatgtcggtggtgatccatcatggcggcgccgggaccagccattcggcggcgcgggccggcgtgccgtctgtggtggtgccgtttgccgtcgacaatgccttctgggccgaccgtctgcgccgggccggcgtggcgccgccgccggtggaggtcgcccggctggacgcggacagcctggacaccgccatcgccgccgccggccggcccgagatgcgcgcgcgggcagaggtactggctgcagcgatgacggcagagaacggcgtcgccgatgcggtggccgcgatcgaggccctggtcgccgcctgatcgatccgacagcctacatccgttccttgatgccccgcgacagcagccaccagttgatcggataggcagttgtgaaacccgccagcattgcgatctgcatcatgaaccagaattccggtgtcgcgacttccagctttgtgcccagccactgccggaagatcaggaactgggcgagcgccatgaagccgtacatgccgacctgccaggcggtgagcgaggcggcatcggccttcaccgcctggatcagcccctgaaccacaccaagctgacgcatcggcttgatggtgaaatactggaaggccacgcccagaacgaaggcgaacaggaagtcgaggatccagaccgcgaacatcttctcggcgaaaagggtctgccagccgaaccaggtggcgaccaccggcgccgccaccgccagccattcggcggcgagatcgcccagggcgcagccgctgccgcaatgggccgcccccttgccgaccatggccggaaacggggtctcgcggcgatggggcgggtcttcgttccgcttcatcgcggccatggcgcggtctcgcgtggccagccggccatagcggcgataggcccagagcgacaggaaactgccgaacagcgccgtcaccggccagacgacattcatgatccacatgtgctgggggtggcgccactcgtcgacggcaatggcgatcgcgaccagcaggccggtggcgatcgacaggatggcgaggatatggagccaggtggggatcatcggacgcctcccgtgatgcggaccaggtacgggggcaacggaaggcgggcgtatgggttccgacgcgccccggccggaacagtcgccggacgcccccgttgcaggaattgaacctgccgcagaaagaggggatccccgatgaggctgcaatcgctcagaccgtcctggaccggcgtgaccggggtgctcgtcatcctgctgggccttgtgttcatcgggcttggcggctggctgatcctgctcggcggggtgtggtactatgccatcgccggcatcggcctggcggcgaccggggctctggtggtggtgcgttggcgacgggctctatttctgcacgccacaccgccaggtgattgcgctcgaccccgagacgggccaggagcgctggcgcttcgaccccgaggcggataccgctgccaatgaatatctggcctgccggggtgtcgcctattacgaagcacccgcgggcacgccctgtcgacagcgcatcgtctgctctgccggatcgatttccgccggctgcgctatgacgggcggttcaccctgccgaccctgggtggcgacatttcctatcccgccttcgacggcgtggtggactggcagggggcgacgatcgaccccacccgtcaggtgctgatcgccaatgccagctacatccccttcaccgtgcgtccgatgccgcaggatcaggccatcgccgaggggctgatggaaccctgggccggatgggacagcggccagccctatccgaagccggctgcattcgcggtcgggccgcaatacggcacgccctatgcggcggtggtgaagccctggctcggcctgttccaggcgccctgtcatgcgccgccctggggcaagctggtggcgatcgaccttcgcagccgtcagatcctgtggcagcggccgctggggaccacgcgcgataccggccccttcggcacgcatgtcaacctgccgctgccgaccggcgtgttcaatatcggcggcaatacggcagccgccagcgggctgatcttcatcggggccaccaccgatcagtatctgcgcgccttcgacgagcgaaccggcgaaaaactatgggaggcgcggctgccggccggcggtcaggcgacgccgatgacctatatgggcgatgatggccgccagtatgtggtgatcgcggccggtggccatggcgggctgcgaacccgcctcggcgactatctggtggcctatgccttgccggatgccggggggtcgggctgatccggccccggggccgtcgcgtcgtccggcaaggcggtgcggcggaccacccggtccaggctgagcccctggacgacgatggtgaacagcaccaccgcataggccgcgaccaggattaccggccggtcgggcgaggcggggagcgagagggcgagggcgaccgaaatcccgccccgcaccccgccccaggtcagcaccgggacggtgccgcgggcgaagcttttccaatgcgccagcaccgcgaccggcaggccgaccgaggcgaagcgggccagcagggccagcgggatcgcgaccagcccgatccaggcgaggtcggggtcgaagcccagcaccagcacttccagcccgatcagcaggaacagcaccgcgttgagggtgtcgtcgaccagcgtccagaagccgaagacatagcggcgggtctgggcgctcatggcatcggcggcgccgtgattgccgatcagcacgccggccaccaccaccgaaatcgggccgctcatctgcagcatgtcggcgagggcgtaggtgccggtgacgagcgccagcgagatcatcacctcgatcgaatagtcgtcgatggccctgagcgcccgaaaggccaggaaaccggtggcgagaccgagtactgccccgccgcccgcttccaccaccagcagccggaggatgtgggagagaccgaaatcctccgacgggccggtcgcggcttcgagtgtgatggtgaacagcaccacggcgatgccgtcgttgaacagggcctcgccggtcatgtcggtctcgagcgcttcgggcacgtcgacggccttgagggtggagagcaccgccaccgggtcggtcggggcgatcagcgcaccgaagaccagggcccaggcgaaggcgatgtcgatgccgagcgccgccgcaccggcccacaacccgcccgcgatgatcagcgtcgagataccgacaccgaccgtcgccagcacccccaccaccggtgcccgccggcgcagccggcccaggtcgacatgcagcgcacctgcgaacagcaggaaggccagcatgccgtgcatcaccgcttcgtagaaatcgatctgacggagcccctgcgtcagcgcgccatagagatgggtttgcgggaagagcagctcgatcgcgatcagcagcagcgaggcgcccagccccatcaccagcaggccgatgtttgcgggcaggcggaaaatgcggtggttcagccaggcgaagacggcggtgacggtcaacaggctggcgagaagctggaagagcgagagcacgtcggcggctccggtggtttggttggggcagacgcatcggcaaccggccgtccgctttcctgttccgggacagattgatacggaaccgatcggcagctcggggctttcgagactgcaaccacttgttcggcagcagggggcaaggctgccgccggacgaagagggcaggggcgcaatgccgcagattttcaccaaatcggccgatacacggctcagggccgcgctgcttctggtcgcccttgccgccgtcggcgccgttctgttcatcgggggatacatggagtcgagctatgcgacgctgatcggctgggtccgggaccagccggtaccgttcagccacgaacatcatgtcggtgggctggggatcgactgtcgctattgccacacggccgtggagaccagcgaacatgccgatctgccgccgacccatgtctgcatgacctgccattcccaactctggaccggtgcgccggtgctggcgcctgtgcgcgacagcctggccacgggccggccgatcgcctggcagcgcgtcgcacggctgcccgattacgtctatttcaaccacgccatccatatcgaccggggggtgccctgcgtcacctgccatggccggatcgaccggatgccgctgaccgcacgggccgagcccttccagatgcgctggtgcctggactgtcaccgcgatcccgccccgcggttgagaccgcccgatcaggtgacccggatggactggtccgaatgggacgcccaccccgaacgccatgccctgtatggcgagatgatgatcaaggtctatggcatcgagcctgcgaagctcgacgattgcgatgtctgccaccggtgacgccccgaaaacggaggcgacggatgcggcggcccggctgagggggcagctgcacggcaagaccggccgcgtgttctggcgcagcctggacgaactgaccgcggcccccggcttccgcgaggcggtggcgacggagtttcccggtttcgcccggctgatgcccgaggtggaccgccgatcggttctgaaggccatggccgcctcgctggcccttgccggcttcaccggctgcgagggtgagagcgacgaggcggcgctgccctatgtgaatgcgcccgaattcatggtgccgggtgagccgcgctggtacgcgacggcggtgacgctgtgcggttatgcccagccggtgctgggcaagacccatgtcggccggccggtgaagctggagggcaatcccgaccatccggcgacccgcggcggcaccgatccgtttctgcaggccgccctgctcgacctctacgatcccgaccggtcggctgcgccgttgcgggacgggcggccggtaacctgggcagaggtcgaccgcgcgctggcgcgcctcgtttcactgctggacgggaccggcgggcagggcttccgcctgctgaccgggaccgtcacgtccccgacactggcccggcagatcggggcgatgcaggcgcgctggcccggcgcgcgctggcatgtgttcgagccgctggccgaggatggcccgcgccgggcggcggcgcttgctttcggccggccgctcgaccgccagccggcactggaggcggcagaggtggtcgtggcgctggatgacgacctgctggggcccgggccgcaccagatcgtgacggcacggcgctgggcggagcggcggcgggactttcagaccggggccggcgacagccggctgatggtggcagaacccgtgccctcgctgaccggcacccgggccgatgcccggctggtgacgccggcgcggcggatcggccgtctggcggtgaccatcgccgcagaactgggtgtgggcgaggtgccggcgaccgggccggcgctgaccgcccgggaaaagggctgggcgatgcgtgcggcccgggcgcttgccgccgcgggcccgagcgggctgttcacagtggggccccgccacccggcggaggtgcaggccctggcctttctggtcaatgcccggacgggggccctggggcagacgttacgcttcaccgaaccgattgcggccctgccgcccgatgggcctgaatccttcgaccggctggtggcggacatggccgccgggcgagtgacggcgctggcggttctgggggccaatccggcctatgccgccccggccggcagcggcttcggcgaggcggcggcgcaggtgggcacgatcatccatgccgggctgcatgtcgacgagaccgccgccatcgccggctggcatctgccgctggcccacgagctggaaagctggagcgatgcccgggcggtggacggcaccgtcagcatcatccagccgctggtgcggcccttccacgatgtgcgtggccggcaccgggtgctggccgggttgaccggcatcctgcccggcggtgccgagccgccggagcgcgcctgggtgatggagacctggcggcagcgctggggcgtggccttcgaagatcgctggcgggcggccttgctcgccggtctggtcgagggcacggcggcaccggaggtgaggcccgatgccgtgatcgacccgccggtggtggcggatgaaccggtggtcgacgggctgagcgtggtcttcggccccgacccaccatctgggacggccgcttcgccgacaatgcctggctgcaggagacgccgaagcccgcgaacaaggtgacctggaccaatgtgatcgggatcagcccggcacttgccgcggcacgcgggctgaagggcggcgatgtggtgacgctgtccgccgcgggccgcagcctgcagggccccgtctggatcacgccagggcaggaggccgatacggtgtcggtcaccttcggctatggccggcgcaaggccggcagggtggggcagggcatcggctatgatgcctttgccatccgtccacatggcgaaatctggcatgtggaagaggcccggcttcaggcgacgggcgccggccggcggatcgcgaccacccaggcccatcaggcgatggacgggttcgatttcgtccgcaccgtgccgcccgatgcgcaggacatttcccaccatcgcgcaacaccgggaccgaaggcggccgaagcggaacgggcccgggcgccgactttctatcccgtgcgggagagcggcgacgggccgtcctgggcgatggcgatcgatctggacctgtgcatcggctgcaatgcctgcgtggtcgcctgtgtggccgaaaacaacgtcgccatggtgggcgaggatctcgtcgccgaaggccgggagatgcattggctgcgggtcgaccactactacgagggcgaccccgcggagccgcgcgcctatttccagcccgtcccctgcatgcattgcgaacaggcaccctgcgagatgggctgcccggtcaatgccacggtgcacagttccgaggggctgaacgtccaggtctacaaccgctgcatcggcacccgtacctgctcgtccttctgcccctacaaggtcaggcggttcaactggttcgactataccggcgacgatccggaagagctgagggcgatgcgcaatcccgacgtcacggtgcgcgaccgcggcgtgatggagaagtgcacctattgcgtccagcggatcagcgatgcccggatcaaggccaagatcgacggccggccgatcggcgatggcgaggtggtgaccgcctgccaacaggcctgccccacccgggcgatcaccttcggcaacatcgccgaccccgatgccgaggtgacccggcagaagaccggaccccgcaactacgccctgctggaagaggccaatacctggccccgcaccacctatctggcccggatagaggatcctggtgagacggggccgggtgagagcagggagggcagcgagggggagggtgcgggatgagcgacgtgaccggcggcgcccgcggcccctatgcggcggtgacagcggaggtcaccggcatcccgctgcactatccggcgccacgggcctggtggatctgcttcggcgtggcgctgctgctcttcgccaccttcctggcggcggcgggggtgctgtttctttacggggtcggggtctggggcaacaacatcccggtcaactggggcctcgccattgcgaactatgtctggttcctgggcatcggccatgccggcaccctgatctcggccctgctgctgttgctcaacgctcattggcgcaattcgctgaaccgcttcgccgaagcgatgaccctgttcgcggtgatctgcgccgggctttacccgatcctgcatctgggccggccctggcggttctactgggtctttccctatcccaacaccatggaggtctggccgcagttcaagagcccgttggcctgggatttcttcgcggtactgacctatctgacggtctcggtcgccttctggtatatcggcatcgtgcccgatctcgccgccacccgcgaccgggcgcgcaagcgccgccagcaggtgttctacggcctgctggcgctgggctggcggggctccgcccggcattgggcacgctggcggcaggcctatcggctgaccgccgccatcgcggtgccgctggtggtgtcggtccattccgaaatctcgctgctctttgccgcagggccgatccccggctgggcctccacggtcttcccgccctatttcgtgctgggcgcggccttttcgggctttgccgtggtctcgatgatcgccgtggtgctgcgccatgcgctcgggctcggcaatctggtccggccgcggcatctggacctgctgggcaagctgctgctcgcgaccggcatgatgaccgcctatggctactgtgccgaagtgttcgacgtgctctattccggccgcgaacacgaaatccgcaccctgaccgaccggctgaccggcgcctatgcctggagctattggggcgctgtgatcggcaatttcgtgccgctgcagctgctctggttccgccgcctgcgcagcagcccgaccgcgctgttcctgatcggcctgtcggtcgcgatcggcatgtggttcgagcgctacatgctgctggtcagctcgctctatcgcgactggctggtctcgtcctggggcgaataccacgcgagtttctgggaatgggccctgttcgccggcatgctcggcgtcttcctggtgcccttcctgctgttcgtccgcgccctgccggtgatttcggccttcgaggtgaacgaggctgcgctggaagaaaaggaggcgcgccgggatgcgtgaacccgcccccgccggcaatgtcttcggcatgatcgcacagttcgacgatcccgaccggctgaaggacggcatccgccgcctgcgcgaccagggctatcggcggatggaggcccataccccgttcccgatcgaggggctggccgagatgctggacttccgggacaaccgtatcgcctgggccacctttgccggcggcgtgctgggggccgctacgggctatggcatgcaggtctataccaatctcgactatgtgatcgatatcggcggccggccgctgatctcgaacccggccttcatgctgatcacgttcgagctgatggtgctgtttgcggtgctggcggggatcggcgccatgctgctgctcaaccgcctgccgcggctgcatcatccgctgttcgacgtgcccgccttccacatggccagcaccgaccggttctttctggtggtctatgccgatgacgaccgcttcgacccggcagccacccgggctgcgctggaggcgctgtcgccgatcggcatcgaggatgtgctgcagggggaggcgccggaatgaaacgtctggtcctgttggcggccgcgcttgcccttctgccctcgtgcgacgagatgagctaccagccgcgctatgattcctacgagccgagcgggttgttcgccgacggcaaatcccgccaggcgctgccggccggtaccatggcgcgaggcgacgaggtgccgcttgcggccctgaacacccggccggagatgagcatggagctgctcgcccgcggccgggagcggtacgaaatctactgcaccccctgccacgaccaggccggctatggccggggtatcgtgccggcgcgcggcttccccgagccgccgagctttcatatcgcccggctgtggggggcgcccgacagccatatcgtcgacgtcattacccggggccatggggtgatgttttcctatgccgaccgggttacccctgccgatcggtgggcgatcgcggcctatatccgggcgctgcaactcagccaggatgcgccggccggactgctggacgaccaggatatggcccgtctggcggagggggcgccatgacccctgctcccaacaccacccccgcccccaacacgacccgcgcggccggaggccggatccgcggcctctggatgctggccctggccctgatcctcgcctccctcggctggatgatcgcagagccggcggtgctggccggctggctcgcggcctcggccttctggtcggggctgccgctgggtgcgctggtgctggtcatgatgatccggatcatcccaggcagctggcgccaggaattgagcgggccgggagaggcgatgctgctgctgtcgccgctgatggtgcttgccgccctgccgctgctgatcatgcccggtgcggtctatccctgggtgtcggggcccgagcggaccggtttccgcaccctctatctcaccccctggttcttctccctgcggacggtgatctttctggcggtggtggccggctttgcggccctgctgctgcttgcccggcgccggccggtcgccataccggccggcgggctgatcctcgtcaccctgctgcacaccatgttcgcggtcgactggctgatgtcgctggagccgggattccattccgtcgggtttcgggctctatgtgctgtcgatccaggccgcctcggcactggcggtggcgatcctgatccggttgcgcaggggcggcggcgcggcgcggccgggcattctgggcgggctgctgctctcggccctgctgctctggatctatttcgccttcatgcagtacttcatcagctggtccgatgatctgcccgacagcgtgctctggtatgagcatcgcgcggacgggatctggacggtggccatctggctggtcgcggcgttgagcttcgtgcccgcccttctgcttctgttcccgccggtccgccaccatcggcgccggctgaccgggcttgcgatcgcagtgctggtcggccggatgctggaaatggcctggctggtgctgccggtcacggcgggacgggcgggggcgccggcgacgtcgatctttgtggttacgggactgagccttggaggtctgggcctgctggcggggctgtcgctgccggcgctgctggaacgggccgcgcggctccgtgcgcggcgcagccgggaggaccgaccatgaccgccacccaccgtaaccgccgggacgaccagggcttcgagccacaggacgtacccgcccgcggcgtggtgcgtgccgtgatcgggctcttcgccgggattgcactctcggcggcgctggtggccgggctggtggtgctgctgacccccggggtggggccggaacagccgcaggcgatcggcgatacccgaccgggccccgccggaccgcgtcttcaggtcgatccgcgccgcgaacgcgcggcggtggaagccgcggccgcggcaaagcttcagggctatcgctggatcgacggccccggccggcgggcgcatatcccgatcgaccgggcgatgcagattctggcggcccgcggctggcccgcccatcccacccatcccgctcaccccgcgccagaccaggggcagggggaaggggcgacgccatgatccgccttgccgccattctgctgaccctgatcctcgccgccctgccggccggcgcccaggcccccttcgaccccttcgaccgggcgggtatcgatccgaagcccggggcgagggtgccgctggatctggccttccgcgaccagaccggtgcgcgcgtcactctgggcgagctgggcggcggccggccgatcctgctggcgccggtgctgcacgactgcccgaacatctgcggcgtgaccatggccggcctggcccgcgccatgcaggcgcaggactacacggccggccgggacttcgcggtggtcgccttcggcatcgacccgcgtgaggggccggaaactgcccgcgccagcctggacgagctgacgcagggcttcccggatctcggccatggcgccatggcggccgtgaccggccaggccgcccagatccggaccgtgaccgatgcgctgggcttccgctatgcctgggacgagagtatcgggcaatacgcccatgtcgccgccgtggcggtgctgacggccgatggtcgtctggcccgctggctttatggtgtggcgccggaaccgaccgatctgtcgctggccctgaccgaggccggggaggggcggctcggcgactggggcgatcagctgctgctgctctgctatcactatgatccgaagaccggccgctatggctcgctggtctcgtgggcgctcaggatcggcggcagcgccacggttctggcgggggcggggctgatcggccttgcggtgctgcgcgaacggcgccggcggagcggggggccgcgctcatgaccgcctcccttgccccctggatcaccgaggcatcggcccatgcggccgaaatcgaccggctggccctggccttcagcctgttgatcgcggccctgtcggtgccggtcttcctgctgctggtggtgttcgccatccgctatcgccgcggccgcaaggtcgaccgccgccatgcccccgaccggaatgtctggctggagacctcttgggcgctgatccccttccttctgatcctgatcttctatgtctggtcgaccagcagctatatcgacctctacgagccccctgacgacgcgctggaaatcaacctggtggccaagcagtggatgtggaaggtccagcatccgggcggtcagcgagagatcgacgagctgcacgtgccggcggggacgccggtgcggctcaacatggcatcgcaggacgtgatccacagcctttatgtgccggcgctccgcctgaagcgcgatgtggtgccggggcgctataccagcctgtggttcaccgccgaccgccccggaacctatcggctgacctgcgccgaattctgcggcaccgatcattccaccatgggcggccggctggtggtgatgcgcccggccgattatgcccgctggctggcagagtcggatcttgacccctcccttgccgaacagggggcgcagctgttccgcacgctgggctgcagcggctgccacgggtcgggttcgacggttcatgcgccgccgctcgacgggctctatggcagccccgtaccgctggatgacggccgggtgatcaccgccgacgaccgctatatccgcgactcgatcctgctgccgcaatccgagatcgctgccggctatccgcgcatcatgccgaccttccgcaacctgctggacgaggagcaggtgatgaagctggtggcctatatcaagtcgctgcggcgccagggctggaaggacggaccatgaccgcgaccaccgcgaccgaacgggcaagctatctgggggcggggcatacgctgcgctcgtggctgttcaccactgatcacaagcggatcgcgatcctctacatgatctcggtcaccctgttctttttcgtgggcggggcggccgcggccctggtccgcgccgatctgctgacgcccgagggcgatctcctgagcaatgagggctataaccgggccttcacgctgcacggcgtgatcatggtctggttcttcctgatcccgtccattcccaacaccttcggcaatttcctgctgccgttgatgatcggcgcgcgcgacctggctttcccgcggctgaacctgatcagctggtacatctacatgctgggcgggctgttcacgctggtggtgctgatcaccggcggggtcgataccggctggaccttctacacgccgctgtcgtcgatgttcgccaacggcaatgtcgtgctggtggcggtggcggtgttcatcgtcggcttttcctcgattctgaccgggctcaatttcatcgtcaccgtccacaagctgcgggcgccgggcatgacctgggggcggctcaggctgttcgtctggtcgcattatgcgacgtcgatcatcctggtgctggcgacgccggtgctgtcgatcgccctggtgctgatcgcagccgaacggctgttcgggctgggggtgttcgatccggcgctggggggcgacccgctgctgttccagcacctgttctggttctacagccacccggcggtctacatcatggtgctgccggccatgggagtggtgagcgagctggtcgcggccaccgcgcgcaagccggtcttcggctactggttcgtggcgggatcgtccatggcgatcgcgatcatcggctttctggtctggggccatcacatgttcgtggccggacagtcgatgtatgcaagcgcggtgttttccttcctcagcatcgtggtcgcggtgccgtcggcgatcaaggtctacaactggacggcgacgctctacaaaggccatatcgcgctcgacccgcccttcttctttgcggccggcttcatcggcctgttcgttctgggcggattgaccgggttgatcctggccatgctggcgatcgacgtccatctccacgacacttatttcgtcgtggcgcatttccactacatcatggtcggcggcacggtctcggcctatttcggcgccctgcatttctggtggcccaagatcagcggccggatctatccccggctctggggcacgctgtcggccgtgttcatcttcctggggttcaacctcaccttcttcccgcaattcatcctgggctatctgggcatgccgcggcgctaccacagctatgacccggcctttcaggtgctgcacatcatgtcgaccaccggcgcctcgatcctggcggtcgcctatgtcatgcccttcgcctatctgttctggtcgctgcgctatggccggcccgcgggccccaacccctggggcgtgaccgggctggaatggacggtcgcctcgccgccgcccaagcacaatttctacccgccgcccgtggtctcggaaggcccctatgacggctatgaggtggagatgaaggggtcgaaacatggctgagaacgtccggctgcacgacccctatgcccggcccgtgcagcagcgcaccgccgatctgatgggcatgttcgtcttcctcggcaccgagatcatgctgttcggcgggctgttcgcggcgatctatgtggttcgcggcctgcacccgcacgaggtggtggaagcctcaaagcgcctgcatctgttcatcggggccgccaataccgccattctgctgacctccagtctggcggtcgccgtggccgtgcgggcggcgcgggccgggcgggtgcggctcggctggatgctgcttctgggcgcggctttgaccgggcttctgttcctgggcgtcaagggcatggaatggggaatggaggcagaggaagggctgctgccgttcaggggggtgtcgggcagcctgtcgggcccggtcgaccggctgttcatgaacctctacatgatcgcgaccggactgcacgcgatccatgtcagcatcggcgtggtgctgcttgcgggccttgccctcaggatcggcctcggccgcctgcagctgccggaacgggcggtggtggtggaggtcgcgggcctctactggcatctggtggatgtgatctgggtcttcctctatcccgcgctctatctgatacggtgagaatgatgaccggtatcggacggctgatcctgatctgggcggcactgctggtgctgctggcggccacggtggcggcaagtgccgttctccacggcgcggccagcctgaccgccagcctgctgatcgccgcgatcaaggcggggctgatcttctggttcttcatgcatctgggcgaagaggcggggctcgtcagggttatggcgctgggcgccattgcctggctcggcatcctcttcgcgctgtcgggcgccgactacgccacccgcggctggtggtgagcgatcattgcgccgatgcgggaagggcaggtttgggtttcgccagccattcgcggccacgcagcatcgctttccagtacatccagggcagcatccgttctttcagcagccaggcgaggtggctgggccggcggccgtcgatcagccagttcgggaagctcggcagcaatttgccgccatagccgaattcggcgagcacgatccggccgcgctccacggtcagcgggcaggatccgtagccgtcataaaccgcgtcgccccccgaaatcaggcccagatcgcgcagcagattgtgggccacgaccggcgcctgcttgcgggcggcggccgcggtcttggcattgggtgcgttgcagacgtcgcccaggccatagacgccgtcatactgccggtgccgcaggctcgacgggtcgacatcgacccagccgtccgcatcggcaagcggcgagaccttcacgaaatcgggcgcgcattgcggcggcacgacatggatcatgtcgaaaccgcgctccaccgtgctggtctgccccgcggcatcggtgcgggtgaaccaggcggtgcgggcgggcccgtcgatgcgggtcagcctttcctggaagcggagatgaatgccgtagcgctccacataggacatcagcgccggcacatagtctttcacgccgaacagcaccgccccggcggtgcagaaattgatgtcgatcccggagagcacagcctgccggcgccagtggtcggcggacagatacatcgccttctggggtgcgcccgcgcatttgatcggcatcggcggctgggtgaagatcgcccgaccgctcttcatgccctggaccagctcccaggtgtaaggggccaggtcatagcggtaattcgaggtgacgccgttgcgccccagcgtctcggccaggcccggaatggcggtccagtccagcttgaggccgggggcgacgaccagcgcccgccaggtgatcacccggcagccatcaaggatgacggccctggcatcgggctcgaaggccgccacagccgctttgatccaggtgacgcccggcgggatcagcgaggccatcgtccgggcggtggtgcgggcatcgaacacgccgccaccgaccatggtccagcccggctgatagtagtggatatcggccggatcgatgatcgcgatgtcgagatcgggcttgcgggccttcaggctggacgcggcggcgatacccgcggcgccaccgccgacgatgaccacgtcgtggtggaggctggtgccatccaccggcgtgcggccgccattggcgatccggcgggcgacgccggtcatgtcgtagccggccgcttttgcggcggcgatgatttcgggcagcggccggccgcgggcggcttcggccagcgaccagagcgtggccgagcgcgtacccgaacggcaataggcgagcaccggccgcggcaggcggtcgatcagcccggcaaaggcgccggcctggtcatccgtcaccttgcccgaggcgacgggcagaaaggcggcctcgatcccggcggcctgtgccgcctggcggatttcctcgaaaaccggctgatcggggccttcgccgtcgggccggttgcagatgaccgcgcgaaagccggcggcggccagatcggccatgtcttccggatggatctggggcgcgaccgagactgtcggcgacagggcgtgcgtgcggggcatgggatggttactcccgtcggggccggtccggtgtggtcgcgtgcgggcatgcgccctcgcgcgcggcgcaggatcgtcaggatcggccggtgatatataacctgtaattgagaagccggccggactaccgcgtggcgaggcctgcgcggatcggcccttgcgtggccggctcagccggtggccggggacgggaccatgggggtttcctcctgttcttgatatgtctgtgtctgcaggggccgtgcgttcagatggcgaggccgaaagcggcagcgttgcgatagagcatgtagagggcgaccacgaagacgaggcccgcgaagatgcggttcagcaccgccttgcgggtggccaggcggcaggcgagctgcataccgagatagccgccggccaggccgccgacgatgtattcggccgcgatcggccagtcgaccaggcccgaggctgcgtaactggcggcggtggtgaggccgagcgcacccaccgccaacagtgacgagcccaccgcatagagcatcggcatgccggtcgagaagatcaggccgggcacgatcagaaaaccgccgccgatcccgaagaagcccgacagcagcccgacacaggcggcggccaggatgaccagcggcaggcgccggggttcatgagcgccgcttgcgccaccgccgctgccgcggcgcagcatcagcacacctaccgccatcatcaacagggcgaaaaggaacagcagacgctggccgtcgacatccttgccgatccgcgacccgatggcggcaccgccgacaccgatggcggcaaacaacccggcatcgcgccagcggacattgccggcccgggcgtgaccggcaaaattggcgaaggcattgaacgagaccgcgagcgcgccggtgccgatcgccgcatggggcggcaggcccacgacatagagcagcagcggcgtcgccatgatcgagccgccgccgccgatcaggcccagcgtgaagccgacgagaccgccggaggcgacggcgaggatcgattgcagcaccatcatggtcgggttccctttcgcccgcgtggcgtaacccggatggtcgcgggggcgcgggtctgcccggcggccgttgtctatggctttgtcttcagcgccttaccgctcccccaccacggcgaaagtcgcagccggcgtcaggcgtcgcgtgggtgtggcaggtctggcaggggcggtggtcgccggaaccgcagccggtatgggggcagcttcggcgcccccgaagccctgccgcagcaggcccagaagctgctcggcatggccgggcgtgacccggtagaagatcgtccggccctcgcgccgcccggtgatcagcccggcctcgcgcagctcccccagatactgcgacaggctgggctggcggatgccgagggcctcctcgatcccgccgaccgcgcattcgccctccatcagaaagaaggcgacacgcagccgggccggatgggccagcacccgcagccgggcggcgccttcggtgacggcttcgggatccaggctcatctgcggtctccggtcgggctgtcgggcagggggccggtgcggaaataccagtcggttccgggggcctggcggtcgaaaagggtgtcgggcgagatgtcgaccggcaggatcacgtcgtcgccgggcatccagccctcgggggtggcgacatcatgggcgtcggcggcccggagggcggcgaccaggcgcagcagctccgcgacattgcggccggtggtcatcggataccagctgatggcgcggatgatgcccatcggatcgatcacaaaggccgcacgcaccatcgaggcatcgggtgcgttgggggcgatcatcccataggcgcgggcgatggccatcgacgggtcttcgacgatcgggaacgggatcttcaccccgaactggtcgtggatgctgcggatccaggcgacatgcgagaacaggctgtcgaccgacagcgccagcagatcgcagtccagggccgcaaagcggtcggctgcccgggcgaaggcgatgaattcgctggtgcagacgggggtgaagtcggcggggtgggagaacagcagcagccagcgcccccgataatcggcgatcgcccggtcgcccatggtcgtccgcgcccggaattcgggggcgggatcgtgaagcaggggcggcccctggcggatgatgggctggtcggtcatcccggctcctcgcagctcggcatttcatattctatgaaatggcatatcgatagaatatgaaaaggccaagtatgagtccaggcgggatttttccggccggggccgggtcaacgcaggggcagggcgacgctctgcttcaccgtctggctggggacatcggtcttgatgttgcgcacgcccttcacccggctgaggtggttggcctggaagcggcggtaatcgtccagatcggcggcgacaacccgcagcagggcgtcgcaatcgcccagcatgatgtagcattcgaccacctcgggaaattcgcgcaccgcggcgatgaagcggtcgatggtctcggcatcctgcgcctccagccagatccgggcgaagagcgacagcggcaggccgatcttcgccgggtcgaccacggcggcgtagcgacggatgatgccagcctcttccagcaagcgcacccggcgcagacagggggagggcgacagccccacctcgcgcgccagttccacattctgcatccggccgtcgcgctgcagggcacggaggatccgcttgtcgatctcgtccagttttatcggcatgtgaccggccttcggcgcaaaagattggcatctgatgccaagtatcgggcgctggctggcatcttcgcaacccgattgccgggccgtgcggctatcgtctgacgatgaacctccggtggtggaggcggggcaggcgggggtgcggatgggctgggaatggatggcctcggtggtggtcttcgcgatcgcgatgtcggcgacgcccggaccgaacaacaccatgctgaccgcatcgggggccaattggggcttcctgcgcagcctgccgcatatggccgggatcagcctgggggtgaccgtcatcctggcggccgtcggcgccttcggctcgccgctggttgccgcacccggggtgcatgacgtgctgaaatgggcgggcatctgctatctgctctggctggcctggaagatcgcgacggcccggcccgcgccggagggcacgcccgcaggcagcggcgggcgcagccgaccgctcaatagtctggaagctgccgccttccagctggtgaacccgaaattctgggtgatcgcggccagtgccatggtcacctatgtgggcgagggtgaaggggcgggcggcacgctgttgccggcgatcaccctggctctggtcttcggcatcgtcacctttccctgctcggtgctgtggacgctggtcggcgtgggggccggccggctgctgcgcacggccggggcacttcggaccttcaacatcgtcatggcggccctgctggtcgcctcgctgatcccgatcgttctggactagggcaggtccggtcgacggcggtttgcaggacagcagggcaggattgacgccggtcgcggatcgtggatgaaatctgcagtctgaaccaagccgtccgctctccggtgcccctttgctcaagctcgcctttctcctgattggtcccgatgcattcagggcgcgatggtatgcgctcgccggtgccggagccttcctgctcgccatcgctgccgcgttgatggcgggcctgtctcccacgctgaccattgcgacctatctggcgcttggtctcgcatttctgggctcgggcctgctgatggcggtggtggcagtcgcctcgtcggggccgcgccgctggctggcgcttgcccggccgatgatggccatcctggccggactgctgatcctgggtacggccttcgaaaccggctggctgttgtcgacggcctttgcgatcgccttcatcctggacggggcattccgcatcctgatgaccctgctcacccgctttaccggctgggtgacctcgatcgcctgcggcatcgccgaactgatcctggcggtgatgatgctggcgggctggccgttttccggcgcgtggaacgtggcgttctgcatcggcctgttcatcggtctgtcgggctggctgctgatccggctgggcctgctgctgcgcgggctggaggacgaggccgcgatcctgctgctcccggtcttctcggggcgcggctggtatgatcatgccccggtgctgatcggcgaggcgccgccacgcggccccgacgacccgccgatcgtggtgcggatctggatgccggcggggccggagcggacccgggcgggccggccggtgatcgatcgctatctgggggcgcaggatgacgagggggtgttctcgggcggccatgcctctctggagctggcgccggacctatatatcagccattggcctgcgtccgatttcgacctgaacgggcgggggctgatgaccgtgttcagttcgcgtgcggacaatgacatggccggaagttttcagcgcagctatgaggaagaggctgccgactggcgaccggccgatctcaggatcgaagtccaccgtttcaacccgcggcggctcaaggccttctgggccggctacaagcaggatgccacctacaatatcaccaaccgcaactgttcggttgtggtggcggccgggctggatgcggcgctggaaggcgtgctggccgggcgtcacccctggctgcgcttgctggggctgatgatcgaccccgatctctgggtggcggcgatgatccgcacccgggcctcttcgatgacctggacgccggggctggtgctggactatgtccgcatcctggtccggatcgtggagcggcgggatgtgtcctgggggcggcggttccgcggctttctggggcgggtcgatggtgagatcaccgacaggggagcgccggcggcatgaccggaaccgaggcgaccgcgaccgaagacggcgcaaccgaagatgagggcgctccgcgaggcaatcttctgtcgcgggcggcagtcatcgccaccgcgaccatgtttggcctgacctattcactcagcgcggcgctgatcgcgctcgacctcgaccggcgggatctggacccggccgcgatcggggcgaatgcggcgatgcatgcgttgggcgtgctggccatggccttcctgctgccgcgggtggtgccgcgtctcggcatccgtcgcatggttatcctgtcgctggtgctggcggcggtggtgctggtgctgtttccggcgacgccggtctgggtgtggttcgtgctccgcctgctgctcggagcctcgtccgaaaccctgttcgtgctctcggaaacctggaccaatgcgctcgccaccgaacgcagccgcgcgcaggccatggcgatctacacggcagcactctcggtcggttttgcggccggcccggccatcctggcggccatcggctcggaaggcgcgaccgcctatgtcgtcggtgcggcgatcgcggccggtgcggcgctgttcgtcgcggcccccaaagtgaccgcgccggccttcgagcacccggtgaagaaaagcccgctctacttcatgcggctcgccccggtcgcgatcgcggcgatcatgctgaatgcggcgctcgaaacctcgggcctgtcgttccttgccctctatgccggaaatctgggctggagcgagagcggcgccacggggcttatgtcggtgatgatggtgggcgccatcctgctgcagctgccgatcggctggatcggcgaccgcatggaccggatgctgctggtccggattctggcggtcgtcgcggggctgggcgccctggtctggccgctggcactgggccaccagatcgtgacctgggtgctgctgttcgtctggggcggcgccttcgtcggcgtctacaccatcatgctcgccgttgtcggcagccgcttcaagggcggcgacctggtcggcatctatgccgccatggggctgatgtggggcgtgggcgcgctgctcgggccggtgctcgccggggcggccatggatgccacccgccacggcctcgccttcttcgcggcggccgcctgcttcgccttcgtggcggcaagcctgatcaggccgcgggtggcctgatcaggaagggggctcacccgatccggtggccggcggcgctgagcgctgcaatcacccgctccctgtcggccgcctggaccagcagatagtcggtatcgaaggtcgagaccaggaagataccgatcccgtcggccgccagcggctgcagaaccgcgacggcgatgccggtctcgtcgaaggcgaaggggccctggaatttgaagcaggaccaggcccggtctgccctgacatcgccgggcacccgctcggccaggcacaccaccgacagctcgtcggcggtgcgcgagatcgagacgaaacccggcccgtcggcccagcctggaatgggggcaaggggatcgagccgggcgacggcgtaggttccggacagggggaggagggtgatccgtctcatgttccggaacctctgtggggtgggtgatggtcagcggccgagggtgtagaattcgtcgttcggccgcatgcgggtgacattggccatgcggttcgacaggccgaagaaagaggcgatgccggcgatgtcccaggcatcttcttcggtgaagccatgggcggcgagggtggcgaaatccgcttcttccaccgcataggcctcgaacgagaccttcatcgcgaaatcgagcatggcgcgctgacgctcggtgatgtcggccttgcgatagttgatcgccacctgatccgcgatcagcgggttcttggcccggatgcgcaggatggcgccatgggcgacgacgcaatactggcactgattgagattgctggtggcgaccacgatcatctcgcgctcggccttggtcaggttgccgggcttgtccatcagcgcgtcgtgataggcgaagaaggcgcggaattcatccggccggcgcgccagtaccacgaagacattggggatgaagcccgatttctcctgcaccttgagcaggcggtcgcggatgtcttcgggcatctcgtcgagcgagggcaccgggaagcggctgatcggcagggtggcgggtgcggtgtcggtcatggcggggcgtttccgttggggagggattcttaagcggcgggcggaggcgattgtcagccgagctccgggttcacaggcacgaccacgcggccgcggaccttgccttcaagaatgcgggcggcggtggggatcacctcgtcgaagccgatttcggtggtcagctcgtcgagaagcgccgggtcgaggtcgcggccgaggcgctgccaggcttccagccggtcgggcctggggcacatcacactgtcgacgccggcaagcgtgacgccgcgcaggatgaagggggcgacggtcgccggcagcgacatgccgccggccaggccgcaggcggcgaccgtgccgcgatacttcatctgggcgcagatattggcgagggtctggccgccgaccacgtcgaccgcaccggcccagcgctctttcgcaagcggcttgcccggctcggcaaagggcgcgcggtccatgatgtcggcggcgccgagccgcgtcagataatcggcctcttcgggccggccggtcagggccacgaccctgtagccgagcttcgccagcacggcgacggctacagagccgacaccgcccgccgcaccggtgaccagcacctcgcccttgtcgggggtgacgccgtgacgctccagcgccagcacgcagagcatggccgtgtagccggccgtgccgatggcggccgcctgacgcagggtgaaggggctggcgagcggcaccagccagtcgcccttcagccgggccttgccggcaagcccgccccaatgcacctcgcccacgccccagccgttcagcaccacccggtcgccgggcttccagtcggcatgttccgagctttcgaccacaccggccaggtcgatgccgggcaccatggggaagctgcgcaccaccgggctcttgccggtgatggcgaggccgtccttgtagttcagcgtcgaccagccgaccttgaccgtgacatcgccggcgggcagccggtcgtcgtcgagatcggtctgccgggcatggtagccgctgtcgtccttgtcgatcaggatcgccttgaacatcggggagaggctccgttcgggtgatgggtcagatggatgacgtggccggcaccggcggcggcgcatggccgagcagggcgaagaagccggcggcgaacagccggagcggcgccgggtcgcggtcgagcttggtgcgtagcaccgccccttcccagccgatccagaagaaggcggccaggcgatcgcagtcatgggccgggtcgatttcgccggcggcctgtgccgcccgcaggcaggcggcggtgcgggcctgccaatcctggaacaccgcggcgatctgcgcgcggaagccttcgggcaaggtgcccatctcctggcccagattgccgaccaggcagccgcgccgccagccatggcgggccatgcccgcttcggcatcggcgatgaagcggccaagccgggtcatcggcgtcaggctgccgtccaggaaccagcggtcgagcttgcgggcgaaataggcggcataggcgccgatcagcgcggcgccgaaggcctctttgccgtcgaagtaatggtagaaggatcccttcgggatgccggccgatttcaggatctcgtccagcccgacggccgagaagcccttctcggtcaggatggcgacgcccgagcgcaccagccggtcccgcgcatcgaccagcccggccttgggcgggcggccccggcggcgggcaggcatggcgggggcggcagagatggtggcatcggtcatgcggtgaatttagaccgatcgtctctaaaataacaagacctcatcctgcgccggctcggcggcgacctcgatcacctgctgccgcagccagcgctgtgccgggtgatcgtcggtgcgccgatgccagagcagatgaaaggggatcgccggcagggccagcgggggcgcagacacggccagatccggccgcgcgcccgcgaccacgccggccatcagcgtggccaccaggtcggtttcggcgatgatggctggggctgcatacatctgcggcagcatcaggccgacccggcggcggaggccctgcgcctgaagcgcctggtccaccactccgaagccgtcgccttcgggggagaccagcaggtggcgggcgtcgaggaaggaagggagatcggcaagggccgcctctgccggcccgcctttgcgggcgatgcagacgaaagcttcggtgaacagcggcgctgacaggatgcgcgcttccgggcccggcggcacgccgacggcaagatcggccaccgcctcgtccagcaggcggatcgcatcttcgcgcccctgaaagcccagcacctgcaggtcgatcccaggcgccgccgccgcgaggcgccgccccagtcccggcaacaggcgatgggccggatgctccgacagcgcgagcgtcactctggtggtggcggcgctcgggtcgaaagccggcctgtggttcagggcagcgtccaccgcttccaggatctgcccgaaggggcgggcaaggtccagtgcgcgcggggtgggggcgagccctttggggctgcgcacgaacagctcgtcgccggtggcgcggcgcagtcgggcgagcgccgcgctcatcgctggctgggtcagcccgatccgccgggcagcccgggtgacgttgcgttccgccatcagcgcctgaaaggcggcgatcagattgaggtcgaaaccgttgtgatccaccagatctatgtcctcatataatctgcatcgatttcaatgatgacacaggctgtcccaccttctccatcgtcacccgatgatggaggcatcatgcccacggatatcgcccgcattcccccgaccgaagcgccggatctttcccctggccggcgccttgcactggagcatctctatggtggattcggcacggacgacgtcgatctggtcgatcttgcgctgacggcggactggcaggacattccgtccatgcccggccaggccgccgggcccgccggcatcaagccgatcttccgcctgttccggcaggcctttcccgatctgacggtcgagattgtcgaggtgctgaccggccccgaccgggcggccgtgcgcctgatggcgaccggcacccatctgggaccgctgttcggcgtgccggccagcggccggcgggtcagtctggccatccatgaattccaccgtttcgagggcgagcgcatcgccgtcacccaccatatggaagatctgttcggcctgttccgtcagatcggcgcctggcccgccatggaaggagcagcggcatgacccggagcctgatcctcacccgcatgggtgccacgcctgagcctgctcttgcggagctgccgttgcgggagccggggccgggagagctccgtattgccatagatgcggcggcgttgaacccgctggatgccaagctcgcccggggccatctggccgactggtttccgatcgtgctgccctgggtgccgggcacggattttgccggccgggtggtggccgtcggcgccggcgtgacgggatttgtcccgggggacgaggttttcgggcgcagtgatcccgttgccggcggcgccttcgggcccgcgatcaccctgccggccggcttcgtggcgcggcgcccggcggggatcgatgccgcaaccgcggcggccctggtcacaccggcagccattgccctgcaggcgctggacgaggtggccggcgccgatggcccgctggtgatcctgggcagtggtgcggtgggtacggcgctggtgcagatcgcccgccgcgggcgtgccgtgacgctcagcggccgccatgccgcccggctcgcggtgcatggggtgcaggtgcttgcggcagagggggccgacctcgccgccgcgatcgccggagccggggtggtgatcgacaccgtcggcggaccgcgtcagcggcaggtgctggcctgtctgcgccccggtgcccgtttcctggccatcgccgagccgctgcccgaagatgcggcggtacctgcgggcgtcaaggccggtttcgcggctctggcaggtggcggcggtcagctcgatcggatcgccggactggcggccgatggcgtgctggttcccgagattgcaagccggttcgggatcggggatgcggtggccgtgttcggcgcctggactgctgggcgtcttccggcccgtcaggtgatggtgcgggagggctgatcggcaggtataaatcggaattggcggcaaaatttttctgtaaaacagaaaatttttgccgcaacatgcgggcatcgatggatggcacagccgagaggtgaaggatcatgcgcctgcccgccaccaatcagacgcccgatgacgatggcaagggccgggaggacggggccctctgccgccgcagccgtcgcctggcgcatctctgcgccgcctttgccgtggccctgccggttggtgtggtcgtgagctgtgcggcgggacaggtgccggatcttccaggcctgtcgaagacgatcgaccttgcggcgctggtctggtggcaggtcggcattgttctggccggcatgctggcgccggtgctgccggtcagcctggccctgctggtggcgcggcgctgctttctggcggtcggccggggagccatcttcaccttggagacggtggccgcccttcggcggatcgccggtctggtgacgcttggcgggattgcggggctgatcgcaccgacggtggtggtgctgggggcgaccgttctggccgcccccggccagcgccagctggcaatcagcatcagcagcgggccgctgctgaccctggtgctgggggccgtggtctatctgatcgccgacatcatgcatcgggcagcacgcatggcggaagaccatgcgcagatcgtctgatggcgatcgtcgtgcgtctggatgtgatgctggcccgccgcaagatgagttcccgggatctggcggcgcagatcggcatcaccgaggccaatctctcgctgttgaagcgcggccatgtgaagggcatccgcttcgagacgctggagaagatctgcgaggcgctcgcctgccagccgggggatcttcttgagtatgaagcaccctgatgacgggtcggtcaggccggccgcttcgggatgtcgagaccccgctgcaccgccgggcgagcaaggccgcgctccagccaggccggaacattgatcagcttttcgaaatgaaccagatcgcccgcgccgtagaagccgatcaggttgcgcacccagccgagcagcgagatgtcggcgatggtgtagtcgtcgcccatgatccagtcgcggccgtcgagccgggattcgagcacgccgagcaggcgctcgctttcggcgcggtagcgctccagcgggcgtttgtcctcgatctcgcggccggcgaatttgtggaagaaaccgagctggccgaacatcggcccgaccgccgccatctggaagaacacccactggatggtttcgatccgggcgaccgggtcggcgggcaggaagctgccggtcttttccgccagatagagcaggatggcgccggattcgaacaggccgaccggccggccgtcggggccggcgggatcgatgatcgccgggatcttgccgttcggattgagcgacaggaattcaggcgtccaggtctcgttcttcatgatgtcgatcagatgtgcctcgtaaggcaggccggtctcttccagcatgatcgacaccttcacgccattgggcgtggccagggaatagagctggatacggtccggatgggtggcgggccagctgcgggtgatcgggaagacggagagatcggccatcggggcgtccttcaacaggtcggaacggacaggtggttggaacggacaggtggttggaacgcacaggcaggggcagtcatcctaggcggagcatcggggactgtctgtcctgcctcatggaaacgcaccgttctttcagccgcccgccctgcctgtgcgggatgtcctttccgccggcgccggttcatcgccgaaaacgctccggccgccatagtcgtgggagcggcggcgttcgcgggcgatgaaggcatccagcgacgggccgccggcggtctgctccagccgccgtgcctgtgcgtccaggcggcggatggcgtcgagcttctcgtcattgccgagggatgcggcttcgaccgccgatttcatcacctgaatggtccggtcatagaccagcacgggcaccgggaaaggctgccggtccttgccgccatgggcgagcgagaaacgggccgggtcgtcgaagcggcagggcgcgccgtggaccaactcggcgaccatggcgagcgagcgcaccgtccgggcgccgacgcccgggaccatcagtagttcggcgaaatcccgggggcccgcctcggcggcagcggcaagcgcaccatgcaggcggcgcaggatcacgtctcctggccggacctcgtgacgatcgggcatcaccagatgcggcaggtccggctgggctgtggcgggtgggggcggggcgggcgcgggcgtgggagtaagggccgcggcttcccggacgatgccgtcgggccccagatcccgcagcagatccagctgtccgatgcgcgaggcggcggcgcggcggtcggtgagattgacgatccggccctgattgcggccgtcgatcgcggcatgcggggtttcgacgaaactcttcagatcttccgacagccagtgatagcggcgggcgaggcgggtgccgtcgttcatgccctgctgcaccaccacccagcgcccgtcatcggcgacgatgaagccgtgaagatagaggtcgaacccgtcctgcacggcggcgctgtcgaccttggcgatcatccggctggtccacgccagcgcattgccgtcgaggccggtgcggttgccgacggccaggagttcatccggtgtggcacgggaatggcggccgcggccgccgcagacatgcaggccaagctctgccgacagtggcgtcagcccgcgcttcagcgcccccagcaccgaggtggtgatgcccgaggaatgccagtccatgcccatgactgcgccgaaggactggaaccagaagggatgggccaggcggcggaggaactcgtcacggccgtaatgcaggatgatcgcctgcgtgatcaccgtgccgagcttcgtcatccgctggcccagccaggcgggtacccggccgccatgaagcggcaggtcggcactgccggcgcgtctggacatcagcggctgctccggaacgaaagggaaacactcctatcctaaccagccgaaacccgctctggcaagcaggtgagggcgcagggcaatcgggtgaaacagtgcgtgacaggacggaaaaagtctgaatctctcgttgtcgacgttgctggcttgggagggatggatggaaccgtgtggggccttgggcgaagcgattgggtttcttgagcattttgaggagcttccggacgggcggcaagctggcaagattgtgtatccgcttgatgaggtgctgctcctgagccttctggcggtgctggcgggagcggagaccttcacggacatcgcgcgctttggccaaaagaagctcgatctgctgcggcgcttccggccattcgcggatggcacgccgccgcacgacacgctgggtgacatcttcgcgtcgctggacgcggagagctttcagcggtgcttcgtgtcgtgggtggcgtcggttaccgggacgcctgagggcgtgatcgccattgatggcaagaccgtgcggcgttcgggcgggaagaaggacgcgaaggcgcccatccacatggtctcggccttcgccgcccggcagcgtctggtgctgggtcaggtcaaggtggacgagaagtcgaacgagatcgtggccattcccaagctattggacctgctggcgatcgaaggggccatcgtgaccatcgacgccatgggatgccagcgcgacattgcggccaggatcaccgacaagaaggccgattacgtgttggccctcaaaggcaatcaaggatcgctgcgcgaggacgtcgccctgttcgtcgccgaacagcaggccaagggcttccaggatacgaccatcagccagcacgagaccgtcgacggcgatcatggccggatcgaaacccgcaagaccaccgtcatccatgatgtcgcctggctccgggcgcgacatgactggcccggcctcaaaagcatcgtcgtcgtggaaagcacgcgacggatcggcgacaaaatcgacagcgaaacccggctctacatcacatcattggcgctcatcgccgctctcgtcgggccgatcatcagaagtcattgggccatcgagaatagtctccactgggtcatggatatggtcttccgtgatgacgaatgccgggtgcgtacccaaaacgccccagccaacttcacaaccctgaagcacatggcacataacctgctgcgacaagcaccgggaaaggactccctacgcctccgacgcaaggtcgccgcctgggacgacgacttcctcgcaagcctcatcgcagtttaaaaactttcacccgattcccctgggtgagggcgtgtcgctgatatgcgatcccggccacccccaccccggcggatggtgttagcatcattgcagatcgcacgacgtaaggtgacgggtgatggagaagaagacgcagtttcacctctggtactggttcgcggccctgttcgcgctgctggtgttccagtatgtcttcaccaccgcccagcaggtcgccgagatcccctacagccggttcgagacctatctgaccgaggggaagatcgccgaggtcgcggtctcggaccgcttcatccagggcacgctgaaggagccgctggaaggcggccagacccgcttcgttaccacccgtgtggagcccgacctcgcgcgccagcttcaggacaagggcgtggtggtgaaggggcaggtggagaatactttcttccgtgatctgctctcgtgggtgctgccggtcgctctgttcgccggcgtctggatcttcatcctgaggcggatgggggcagggctcggcggcggcatgatgcaggtcggcaagagcaaggcgaaggtctatgtcgaacgcgacaccggcgtcaccttcgacgacgtcgccggcgtcgacgaggcgaaggacgagttgaaagagatcgtcgccttcctgaaggatccgaagggctatggccggctgggcgcgcgcatgcccaagggtgttctgctggtcggtcctcccggcaccggcaagaccctgctcgcccgagccgtggcgggtgaggcgggggtgccgttctattcgatttcgggctctgaattcgtcgagatgttcgtgggcgtgggcgcggcacgggtgcgcgacctcttcgcccaggcacgggagaaggcgccggcgatcatcttcatcgacgagctcgatgcgctcggccgcgcgcgggcgatcgggccgatgtcgggcggtcaggacgagaaggagcagaccctcaaccagctgctggtggaactcgacggcttcgacccgtcatcggggctggttctgctggcggcgaccaaccggccggaaattctggatccggcattgatgcgcgccggccgcttcgaccgtcaggttctggtcgaccgccccgacaagcccgggcggatccagatcctgaacgtccacatgaagaaggtcgatctggccccggatgtcgatgcggccagggtggcggcgctgacgccgggcttcaccggggcggacctcgccaatctggtcaacgaggcggcgctgctcgccacccgccatggccgcgacgcggtgaccatggaggatttcaacgacgcggtggagcggatcgtcgcgggacttgagaagcgcaaccggttgctgaacccgcgtgagcgcgagatcgtggcccatcacgaaatgggccatgcgatcatggcgagcgtgctgcccggggtcgatccagtccacaaggtctcgatcatcccgcgcggcatcggcgcgctcggctacaccatccagcggccgaccgaggaccgcttcctgatgacccggaccgagcttgaaaacaagatggcggtgctgctgggtggccgggcggcggaatgggtggtctatcatcatctttcgaccggtgcggccgacgatctcgccaaggtgaccgacatcgcccgcgccatggtcacccgctatggcatgtcggagacgctgggccaggtggcgctggagcgcgaccggcgatccttcctcagcccggaagatctgaccggcatgccgcggccgcgcgatttttcggatgtgacggcggcggcgatcgatgccgaggtccgccagatcgtcgaccaggctttcgagcggacggtggccgcgctgaccgaacgccgtgcactgctcgaccgtgccgcccatcggctgctggaagaggagaccctggatggcgacgccttgaaggcgatgatcgccggcaccgcttgaccggatttgaccggggtcaaatcgccctcccgacccctgtgcgagagtgcctgacgaggtgacggcaccgcgggagatggcgagatgaaggcgatggttctgcagcggccgggaacggcgctggtcatggagacgcggcctgatcccgaaccgggccccgggcagatcctggtccgggtgctggcctgcgcggtctgccgcaccgatctgcacgtggtcgatggcgatctgccggacccgaagctgccggtggtgccggggcatgaagtggtgggtgtggtcgaggcgctgggcgccggcgtcgacccgtcgcttgccgggcggcgggtgggggtgccctggctggggcatgcctgtggtacctgccgctattgcggcatgcgggccgagaacctgtgcgatttccccgaattcaccggctacacccgcgatggcggcttcgcgacccacatgctggccgatgccggtttcgcctttccgctggccgatgatctggacccggtggcgacggcgccgctgatgtgtgccgggttgatcggctggcgctcgctcaaaatggcgggggaggcggaccggatcgggctctatggcttcggcgccgccgcccatatcatcgcccaggtctgccgctggcaggggcgggaggtctttgcctttaccagcccgggcgacagcgcggcgcaggctcatgcccgggccctgggcgcggcctgggccggcggctcggatcagacgccgccggcggagctggatgcggcgatcctgttcgcgccggtcggccatctggtgccgaaggcgctggcggcggtgcgcaagggcggcatcgtggtctgcggcggcatccatatgagcgacatcccgtccttcccctacagcctgctctggggcgaacgccggctggtgtcggtcgccaatctcacccgtgccgatggtcatgaattcctggagctggcgccgcgggccggcgtgaagacgtcgacgaccatctacccgctggccgatgccaaccgcgcgctcgacgatctgcgccacggccggtttcagggggcggccgtgctcgtgccctgacgggtccacgtcgcgtcggaacctgtttcttcctgccttcgatccatcgacaatgggcggatcgaagccgcagccccgaatgccgcggtacggaagcgggaggagacgagaagatggcgaacaaccggcggtccgccaacatcacccagggcgtggcgcggtcacccaaccgggcgatgtattacgccctgggctatcaggcggccgatttcgacaagccgatgatcggcatcgccaacggccattccacgatcacgccctgcaatgccgggctgcagcggctggtggatgccgcgacggttgccgtcaggacggcaggcgccaatccgcaggtcttcggcacgcccaccatctcggacggcatggcgatgggcaccgagggcatgaagtactcgctgatctctcgcgaggtcattgccgactgcatcgagacctgcgtccagggccagtggctggacggggtgctggtggtcggcggctgcgacaagaatatgccgggcgggatgatcgcgctcgcccgctgcaatgtgccgggcatctatgtctatggcgggacgatcaagccgggacgctggaaaggccaggacctgtcgatcgtctcggccttcgaagcggtcggcgccttcatggccggccggatgtcacaagaggatttcgagggcgtggagcgcaatgcctgcccgtcgaccggatcctgcggcggcatgtataccgccaacaccatgagttcgtccttcgaagcgctgggtatggcgctgctctattcctcgtcgatggccaatccggacgaggagatcgtggcgggcgcggcacgcgcggccgaggtgctggtgaaggcggtggaggccaacctctgcccgcgcgacatcatcacccgcaaatcgatcgagaatgccgtggcgctgatgatggcgaccggcggttcgaccaatggtgtgctgcattatctggcgatcgcccatgccgccggtgtggaatggtcgctggacgatttcgagcgggtgcgccgcaaggtgccggtgatctgcgacctgaagccctcgggccggttcatggcggtggatctgcacaaggccggcggcgtgccgcaggttctgaagatcctgctgaatgccgggctgatccatggcgactgcatgaccatcaccggccggacgctggccgaggagctggagcatgtgcccgacgagccgcgggccgatcaggaggtgatccgcccgatcagccggccgatctatgccgagggccatctcgccatcctgaagggcaacctggcgaccgaaggtgccgtcgccaagatcagcgggctgaagaacccggtgatcaccgggccggcacgggtgttcgacgacgaaccctcggcgatggatgcgatcctgagcgaccggatccgtccgggcgatgtggtggtgctgcgctatctggggccgaagggtggcccgggcatgcccgagatgctggcgccgacctcggcgatcatcggccgcgggctgggtgagagcgtcgggctgatcaccgatggccggttctcgggcgcgacctggggcatggtggtcggccatgtgacgcccgaggcgagcgagggcggcaccatcgcgctggtcaaggagggagacgagatcaccatcgacgcccatcgccagctgatccagctgaatgtgagcgatgccgagctggagacccgccgggcggcctggacgccgcctgcaccgcgctacaaccgcggtgtgctgtcgaagttcgccaggctggcccgtccggcgagcgagggggctgtgaccgactgagcccttcccggggcgaagctgccgtctcaggcggcagcttcgccttccggggcaccatagggggcgttgatgcgcgcctgatcggacagccgggcccagaccggggtatggtcggacgccttgtcgcggccgcgcggggtgcggtcgatatcggcggcttccagccggtcgcaggcttcgggcgagagcagaagatggtcgatgcgcaggccgtgatctttctgccacatgccggcgcggtagtcccaccagctgtagcggcctgcttcggcatgaagcgcgcggaaggcatcggtccagccctggtggagcacggcgcggaagcggcggcgctcttccggatggaacagcacgtcgccggcccagcccttggggtcgtagagatcgccggcctcgggcgcgatgttgaaatcgccgccgatcaccgccgggcggctggcatcgcccagcatcgaccgggcatggctgacgaaggcgtcgaggaaggcgagcttgtaggggaatttctccgacgtcaccgactggccgttcggcacatagacgctggccacccgcacgccctggtcgccgatcgccaccgtgccttcgatccagcgcgcctgctcgtcctcgaagcccggcaggccgcgggtgacgtcggtgatcggtgccttggccaggatcgcgacgccgttataggtcttctggccgtgggcggcgaaatgatagccggccgcctcgatctccgccgcggggaacctgtcggtctcgagcttcagttcctgaagcagcacgatgtccggcgtcgcttcggccagccagtcgagcacatgaccaagacgggccttgagcgaattgacgttccaggtggcgatgatcatcggggccgggctgcctcagaacacgctgaacgaggtgccgcagccgcaggaggccgtggcattgggattggtgaccgcaaagcgcgaaccggtcagatcctcgacgaaatcaagctccgagccgatgatgaacgggatcgaggcctcgtcgaccagtgcctcggcgccgtcgcgggcgatcaccacgtcttccggctgcacgccgcccttgtcgatcgagaattcgtactggaagcccgagcatccaccgcccgaaacggcgatgcgcagccggacggccacgccttccttctcggcaatgcgattgatgtggcgggcggcgcgggcgctcagcgtcagcggcggcaggccgggcgtgccggcggagccgttgcccgaggtgagggcggcgtcggaagcggccatctgctggacctcctcgcaggtcgataccggatcgcgggtttctcacccgttatttggatccaagatgtaggcaagtgcggccccgaggtcaacgacggcctgtcctcgggcggttgatgggcttccggcttcggcgtagcctggaagggcctgaccgggccgccccggcgccggcatcgccgagaggtcgacgaggagatcatggccgcagccgacccccgggacagctcgtcccgtctcgccccctatgcctgccgcccgacccgcggccggctgatcgacgagcccgagagcctgatccgctcgccctttcagcgggaccgcgaccgggtggttcacgcccgggccttccgccggctgatgtacaagacccaggtcttcgtcagccacgagggcgaccattaccgcacccgcctgacccacagcctggaggtggcgcagatcagccgcaccatcgcccgggtgctgggccttgatgaggatctggccgaggtggtggcgctggcccatgatctgggccatccgcccttcggccatgccggcgaggaagcgctggcccaggcggccgcggagttcggcggcttcgaccacaatgtccaggcgctgcgggtgatcaccatgttcgagcggcgctatgccgccttcgacgggctgaacctcagctgggaaaccatcgaggggatcgccaagcataacgggccgatgaccgggccgctggccgatcctcgccccaagccgccggtggtgaccgagaccctggcagcgatcagcagcatcaagccgctggatctggacggctggccgtcgatcgaggcgcaggtggcggccctggccgatgacgtcgcctacatcacccacgacatcgacgacgggctcagggccgggctgctgtcgattgcggatgtggcggaacagccgctggcggggccgctgctcaagcagctggttgccgcgtatccggggcttgaacagcgccggctgatcggcgaacttctgcgccgcctgatcgatcgcatggtcacggatctgatcacggaaacccggcgccggatcgccgcggcgggcatcgcccatgcggatgatgcacgggcgctgggcgcgccgacggttgcgttttccgccgagatggaccaagacaggcacgcgatcaaagcctatctgttcggcgcgctctatcgccatgtccgggtcaaccggatgacgtcgaaggcgcgccgggtggtgcgggatctggtggcgctgttcctggccgagccggaatgcctgcccgatggctggcgtgaacgggccgaagggccggggaatgccgtcaccgcccgcgtggtcgtggactatgtcgcgggcatgaccgacaggcatgcccgcgacgagtacgaaaagttgttcaacccattcgtcaggacgtgacgtgagcgtcttcgaagagtttcgcgccagaatcgccggcatcgtcggggcgctcgggaccgagggccgcctgccggccgatctggacaccgccaacatctccgtggaaccgccgcgtgatgccgcccatggcgatctcgcgaccaatgccgccctggtgctggccaaggcggcccgcatgaaaccgcgcgacattgcggaggcgctggccgagaggctgcgtgccgacggcgatgtcgagacggtggacgtggccggccccggcttcgtgaacctgcgcctgtcgcccgcctattggcagggcgtggtgcggagcgtgctggccgccgggaccgcctatggcgatctgactgccggcgccggaaggcgggtcaatatcgaatatgtctcggccaacccgaccgggccgatgcatgtcggccatgcccgtggcgccgtggtcggcgacgtgctggccagcctgctgatcaaggcgggctataccgtctgccgcgaatactacatcaatgatgcgggcagccagatcgaggtgctggcgcggtcggtccatatccgctatcgcgaggcgctgggcgagacggtgggcgagattccggccggcctctatccgggcgattatctggtgccgctgggccaggcgctggccgccgaattcggcgaccgctgggcggcggcccccgacagcgaatggctgccggtgttcaaggcccgtgccgtcgaggcgatgatggccctgatccgcgacgatcttgcagcgctgggcgtgcgccacgacgtgttttcgtcggaaaaggtgctgcacgacaatggtgcgatcgatgccgccctggcggcgctgacccaggccgggcacatctatgaaggcgtgctggagccgcccaagggcaagctgcccgacgactgggagccgcgcccgcagaccctgttccgcgccaccgattttggcgacgatgtcgaccgggcgctgaagaagtccgatggcgcctatacctatttcgctgccgacatcgcctatcacttcgacaaatatcgtcgcggctggcccgaacagatcgacgttctgggcgccgatcatggcggctacgtcaagcggatgaaggccgccgtgaaggcgatctcgggcggcgaggccgaactcgacgtcaagctctgccagctggtcaatctgatggccaatggcgagccggtgaagatgtccaagcgtgccggcaccttcgtcaccctgcgcgaggttgtggacgaggtcggccgcgatgtggtccgcttcatcatgctgacccgcaagaacgatgcgacgctcgatttcgacctcgcgaaggtcaccgagcagtcgcgcgacaacccggtctggtacgttcagtacgcccatgcccgtgcccgatcggtccagcgcaatgcgaaggaccagatgggcatcgaggcgccggccgccgatgccgcaccgcttcatcgcctgacccatgatgccgaactgggcctgatccgccgcctggccgaatggccgcgagtggtgcagggcgcggccgatgcacatgagccacaccgaatcgccttttatctccaggacttggccgcagaacttcatggactgtggacgaaaggccgagaggatgagagcctgcggatcatcgtggctgacgatcctgagatcgtcgccgcccgcctggcactgatcgaggccgcccgtctggtgatcgcctcggggctgggcgtgatgggtgtgcaaccggtcgaggagctgcactgatgccgcaaccgccgctcaacggcgacgacgagggcgggcttcgcgccgagccgcgccggcccgccgcagggccgcggccgccgcgcgacgacgatttcgagcccgccggccatgtcccgctgccgcggcgccatcgcctgcgtccggtcgccgtggcggcggcgctgatcctgttcggcggcctggtctggtacgccttcgatcagcgcgatgtgtcgatgcgcgacgcaccgccgccactgatcaccgccgatcagacgccgatgaagtcgctgcccaaggatcccggcggcatggaagtgccgcatcgcgacaagaccgtctacgacgcgctcggcggtggcaccgaaaccgggacggagcccgagcgggcgccggtggagcggctgatgccgccgccagaggaccccatcctgcccgaaccggatgaaggtgcgctggtggccgaggcgccggacgcggccgggcaggaggttgcgcaggcccagaaccagacgccggagcagccggccgtgcaggaggcgccggcccaggcggcgccggttcccgcccagccgcagcctcaagcgcctgccgagacgccgaaaccggtggaacaggcgaagcccgcccccgaggccccgaagccggtcgagccggccaaacccgtggagcccgccaaacccgtcgaacaggccaagcccgtcgagcagacgaagccggccgaagccccgaagcctgtggagccgccgaagtctcccgatctgcgcgacgtgcgcaccggcgccgacgcgactgcctcgctggccggctggaaggttcagctgggagccttcggcgacgaggccggcgcgcgcaagggctgggacacattgcgcacccgtaacaaggaactggtcgccggcctgcagccggtgatcgttccggtcaaggtgaaggacaagggtaccttgtatcgactccaggccggtccgctggccgacggtgccgccgccaaggcgctctgcggccgctttgcccaggcgaagctcgcctgttttccggtggcaccatgagcacgcccgcaaccccctcgtgtccggccgatctgcgcccgatcatcatcggctgtcaggggctgaagctgacggcagaggaacgggcgatcatcgccggcgagcgcccgctggggctgatcgtgttcgcccgaaatgtcgacgaacccgagcagctgtcggcgctggtcgctgaattccgcgaggcggccggcaatccctatgcccccgtcctgatcgaccaggagggcggacgtgtccgtcggctgaagccgccgcattggggtgtggtgccgccggcggggaccatcggccgcctgcatgccaaggatcccgcggccgggctgacggctgcccggctgaccggccggctgattggtcatgacctgatctcgctcggcatcgacgtcaattgtgcgccggtggccgatatccgcttcgcccatgctcatgaagtgatcggcgatcgtgcctattgcgccgatccggtcaaggtggcggcactggccggcgccatggcggcggggctgggcgaggccggcgtgcagccggtggtgaagcacatccccggccatggccgggccgagaccgacagccatgcggaactgccggtggtcgatgccgatctggaggcgcttcgggcagccgatttcgcccccttcctggcgctcaaccgcctgccctgggcgatgaccgcccatgtcgcctatccggcgatcgaccccgacctgccggcgaccctgtcggcaaaggtgatcgacgaggtgatccgccgcgaaatcggcttcgacggcgtgctgctgtccgacgacgtctgcatggcggcgctggagggcgacatgtcctggcgggcgaattcggcgctggcggccggttgtgatgcggtgctccactgcaacggcaacacggccgaaacccgtgcggtgctggaagcggcccccctggtgacggccgaagcccggcggcggctgacggcggcggcggcctgggcggcgaagcgccgttcggcccagctggatgtttcagccgatcgcaaggcgcttgccggcctgatcggcgactgaccgggttcgggggccggtgacatggccggcgacatcgggcatggccccatatcggacatgacggcatcggacgcggcggcggcgccgcgtccgatgcagcttgtcctggacctcgacggtttcgaagggccgatcgacctactgctgtcgctcgcccgcgaccagaaggtcgatctgcagaagatctccatcacccggctggccgatcagtatctgggcttcatcgccgaggcccgccgccgccatctggaactggcggccgattatctggtgatggccgcctggctcacctacctgaaatcgcgcctgctgctgccggacgaggcgccgtctgcggacgaagacgagccctcggccgaggagatggcggcggccctggccctgcggctgcgccggctggaggcgatgcggcgggcgggcgaggtgttgcgcgcccggccgcggctgctgctggaccggtttcccgcgggcggggcaggggcggcggtcaggatcgtggagcgccaggcgaccgacggctatggtgacctgatcgctgcctatgcccggatcgccgagcgacgctttcgcaatgtgctgacggtcaccccgtcgcggctgatgaccatcgatcaggcgatcgagcggctgggagcgatgctgcccgggctgccgcggcgctgggtgccgctgatcggcctgctgcccgatctgccggccccccggccgctgccggcgacgggcgacccgctggccatggcggcggccgaggtggcggctgcgcgcgccagacggctggagcgacgctccgccctggcggccagttttgtggcggtgctggaactggcccgtcagggccggcttgcggtggcacagaggcaaggcggcgggccgctgatggtacatccggacgcccgggcccctatggacgaggttccgacggatgacgaggagggcggagatgagcggtgacgacacggagcgtttcgcccatgcgcgccgcgtgatcgaggcggtgctcttcgccagcgccgagccgctcggccgtgaccggttggccgagtatctgccggcgggggctccgatcgatgccgtgctggacagtcttgccgccgattatgccgggcgcggggtggagctggtgcgccgcgacgacgcctgggccttccgtaccgcccccgatctggccccgcatctgcaggcgcgggtggtggagccgcgccggctggggcgggcggcgctggaggtgctggcgatcatcgcctatcaccagccggtgacccgggccgagatcgaggaaatccgcggcgtggccctggcgcgcgggacgctggacctgctgatcgaaaccggtttcgtgcgcccccgcggtcggcggcaggcggtggggcgaccgctcgaatgggcgacgacgcctcattttctggatcatttcgacctgtcgtcactggccgacctgccggggctggacgaattgaaggcggccggcctgctgggacaggggcgcggcatcgccgattatgccgccgatcaggaacagccggccctgccgctggaaccccgcccgaagccgagcggacggcttggcggcttcacagcggggctcgatggcggcgatagcgagccaggggagatgtgagccagggtgggcgacgggcgacgttaacgatgattgatccggtcaacgtcagcgcttgcaggcctgtgctcggcagggaaggttcggcggtcgatggacagcattcgcccggggagctagctttggggcgggatgcgggtacgggggtgatgtcggtccgacgatgaatgccagcggtattttccggaaggcggccctcgaccgtctgtcttcccccgaacagcttgatcagacactgaccgtcgcgagcccccggggctgggcagcggcgcttgtcgtggcggcggccatgaccggggtcgtggtctggtcggtggtggggacgatccccgtgcgcaaggccgggcaagggttgctgatcgccgaaggcggccgggttctggatgcctcggcgctgggggccgggacgctgtccgagcttctggtcgggctgggagacgaggtcacggccggtgagccggtggcgcggatctccaacccggatctcgccctgcagcttgccaatctgcgggcggtggtggcggaacgccgcgatgcccgcacccggctggagcaggatcttgccgaggaagcgcgcctgcgggaggcgagcctgaccgcccagcgcgaggcgctggacacccgcctcaatgccgcgcgcagccggctggcctatcagcaggggcgtctttcggatctggaggccctgttggcccagaaggtggtgacgcgcgatgcgctcgcccgggcccgcgacgaggtcgcccaggcccgccaggatctggccgagatcgaaagcggcaccgccgatctccgctcgcggaagatcgaggccgagatcgcagccgagcgccgccgccgcgaggccgacgaggcgatcgccgaggcggagcgccgtgttgccgagctggaggcccgggccgcccgcggcgcggtggtgacggcacccgagacggggcgggtgaccgagatcaagcagctgcccggcgcccagctgagcgccggccaggcggtgctggccctgcagaccggcggcgagacgctggaagtggtgatgttcgtgccgccggccgacggcaaggctatccggcccggcatgccggtgcagatcagcccgtcgacggcgccgcgcgagagcttcggtacgctgaccggcgaactggtctcggtgtcggacttcccggtctcgaccgacggcatccgggcgatcgtcgacaatcccggacttgtcgagagcttcgttcaggcgggcccgcccttcctggcccgggtccgcatcgatcgggatccgtcgagcacctcgggctatcgctggacctcgtccaagggcagcgatcttgcgctttcggccggtacgctggcctcggtcgaggtcgagaccgcgaccgagcggcccatcgacatggtgatcccgctgctcaaggagtggaccgggctgtgaccgcgcctgccgcggcgcccgccgcccctgaaagcctgatcaagcccaacgcgccgcagggcgggcgccgcttccgtgtgccgaccattctgcagatggaggcgaccgaatgcggtgccgcctcgcttgcgatgatcatggcccatcacgggctctggctgccgctcgaggtgctgcgccgggaatgtggcgtgtcgcgcgacggctccaaggccgccaatctgctcagggccgcgcgtcgctacggcttcgaggcccgcggctaccggcgcgagcccgacagcgtggtcaacctgcccttcccgatgatcgtgttctggaacttcaaccatttcgtggttctggaaggggtggatgcgaagcgcgaccgggtctggatcaatgatccggccatggggccgcgggcgatgacggtggaggaattcgaccagggcttcaccggcgtgtgtctggctttccggccgacgccggagttcaagcgcggcggtcgcccgccggggctgttcaaggcctttgccgaacggctgcgcggcagcggcccggcactcgccatggtgctgatgctgaccctgatgctggtgctgccggggctggcgctgccggtcttctccaagcttttcgtcgacggcgtgctgatcggcgacgagcaggactggctgaaaccgctgctgatcggcatcgggctgaccgcgatcatccgggccgggctcgactgggcgcagatgcgctatctggcccggctggaactgaagctggcgatttcgggctcggccaaactgctctggcatgttttccggctgccggtcgaattcttccttcagcgctatcacggcgacgtggcgatgcgggtcgaatccggtgaccggatcgcccagctgctgtcgggcgaattcgcgaccaatgcggtcgggctggtgaccatggtcttttatgccgtggtcatgatcggctattcgccgctgctgggggctgtggggatcggcctcgccctggtcaatgcggtggtactgaaactggcccagcgtgcgcgggaggatggcggccggcgtcttgcccgcgaacagggcgccctggcggcgacgtccatgagcggcatccagctgctggagaccctgaaggcgagcggtggtgaaagcgatttcttcgcccgctgggccggggtccatgcccgatatttgaacgccttgcagcaggtcggccggatcacgtcctgggtcaatgcggtgccggccttcatggcggcactcacctcggccgtgatcctgggcatcggcgggctggaggtgatgtcgggcgccatcacggtcggcggcctggtggcggtgcagagcctgctcgccagcttttcggcgccgattgccgggctgatgcagttcggcggcgagttgcatgcgatcaagggccaggtcgcccggatcgacgacgtgctgcgttatgacgtggaccccacgctcgataccaccgaaaaggtgatgcggatcgatgcaccctcgggccgcaggctgccgcagcgtctgcgcggcgaagtgcggatcgagaacctgaccttcgggtacaacaaggccgaagcgccgctgatcgacgatttctccctgaccatccgcccgggccagcgcgtggcgctggtcggcggatcgggcagcggcaagtcgacagtggcgcgtgtggtctgcgggctctaccggccgtggagcgggcgggtgctgttcgacggcattcccgccgaagacctgccccatgcctatttcgccggctccatcgcctcggtcgaccaggacatcttcctgttcgaaggcacggtgcgcgaaaacgtcaccatgtgggacgatacgatcggcgaggccgccgtcacccgggccctgcgggacgcggcgctgctggacctgatcgaggcgcgacccggccgctacgactcccccgtggccgagaacggcgccaatttcagtggcggccagcgtcagcggctggagatcgcccgtgcgctggtcggcgacccggcggtgctgatcctggacgaggcgaccagtgcgctcgacacccagatcgagaagatcatcgacgagcgcctgcgccatcgcggctgcacctgcctgatcgtcgcccaccggctgtcgaccatccgcgattgcgacgagatcatcgtactggaacgggggcgtatcgcccagcgcggccggcatgaggacatgatccgcgaggacggcccctatgcgcggctgatccggtccgaacaggccgatgcggccagggggcgcggatgaccgcggcatcctccgaaagcgccggtctgccggcgatcgatccggaactcgtcgaggccaaggccgaactgctggccaggatcgacggcgtgcggcgccaggtcggctatcacaatcccttcctgctcgaccgccccgatctcatctggctggtgctggaaggcgcggtcgatctttatgccgtgccggtgcgtgacggcgaggtgatcggcgtcggcattcatgtcggccgggtgccggccggcgaactggtgttctcgcccggcctggtgccgtcggcgggggcgctggtcgcggcggaagagggagccgatctggcgctccgtgccgtcgccgtgatgggcacagaactcttcgaggcgaagcgcgccgacgttgccgagggcgatttcgacctgatcgtggtcgactggctggaccgctggatcggccatatggccgggcttgcagtgccgggcgccggtgcccgcgcggccgagctgctggaagccgagccgggccaggaggtgccggccggccgggtgctggggccgcagcccgaagacgtgatctgggttcagtgcaacagcggtcgggtgcggctgatgggtctgccggagctggaatacggccgcaatgacccgccgataccggtcgcccgccatctctgggtcgagacggccgaggatgcgatcctctcgccggcctatacgccgacggtgctgttccgcgacatggcctgggaggcgctggacgctttccaccacatggtgctgacggccacagcccggcggctcgccgaggcggccgagcaggatggcggccggctggaaacccgtcgggatgccagccggcgccggttcgagacctcgctcggccgcatcgggcgcctgctcgaccggcacgggcagacggagacggccggtcttgccgagggcgccggcccgctcattgccgcggtcgaccgtgtggcccgcgagaccgggatcgacccggcctcgcgcggcgcgaagccacgcggcagacgggtgctcgacatcgcccagagcctgaggctgcgctgtcggcgggtgacgctgaccggcgactggtggcgccgcccgggcgcgcccctcgtcgccttcatcggtgagaccggggtgggcgagcgcggccggcccgtggccctgctgcccgctgccgatggccgctggcggctggtcgatcccgagaccgacgggccggccgggccgggccggccggtcacccgtgccgaggtcgacagcctgagcggcgagggctggatgctctaccggccgttcccggccaagccgatgtcggtgggagaggtctggcggttcggcctgtacggcctgaaaggcgacgtccgcacgatcatgacctgcgggctgctggcggcgctgaccggcctgctgaccccgatcgccagcggggcgctgttttccaacgttattccgcgggccgatctgcagacccatctctgggtggtgctggcgctgctggcgggcgcggtcggcatcctgaccttcgccgtggtgcgcggcattgcgctgctgcgcctgcaggcgaccatggacagctcggtacaatcggcggtctgggacaggctgcttgccctgccggcgccgttcttccgccggttcaccggcggtgatctggccgatcgcgccaacagcgtttcggcgatccgggaattgctgaccggctcggcgctacaggtggggttggacgccctgttttcgctggtcagcctggccctgctgttctggtacagcgcgaagctcgccctggtcgcactgggcgtgctgctggtccaggtgctggtcaccggcattctgctcaggatccagctgcccgatcagcgggcgctgctcagcctgggcgggcggatcgaggggctggtcttccagctgttgacgggactgtccaagctgcgagtgtctgcggccgaaccgcgcgccttcgcccgctgggccgaagaattctcggtgcgcaagcggctgacctatcgggtgcggctgaatgcggcggcgcaggcggcgctggcgcagctgttccccgtgctgggcacgctggcggtttatctctcggtcgcgaccctgctgaccgggccggacggccggccggaattcggtatcggcccgttcatggccttcaccgccgctttcggccagctgaccatggcgatgacctctctggtcgcgacggccggcaccgtgctcgccatcgtcccgctttacgaacgggtgacgccgatcctgaccgagatgcccgagatcacccccgaccgggcccatccgggcgagatcaccggccggatcgagttctctcacgtcactttcgcttacgcacccgatgcgccgccggtgctggatgatctgtcgctgacgatcgagtcgggcggctatatcgccttcgtcggcgaaagcggctcgggcaagtcgaccctgctgcgcctgctgctcggtttcgagctgccgcaatcgggcggtgtctatttcgacggcatggatcaggccggcctggacctgacggcactccgccggcagatcggcgtggtgctgcagaacggccggctgatgtcgggcagcattttcgacaacatcgtcggctcgtggccgctgacccaggatgatgcctgggcggcagcgcggcttgcaggcctggacgaggatatccgggccctgcccatgggcatgcacacggtgctgtcggaaggtggcggcacactctcgggcgggcagcgccagcggctgatgatcgcccgggccctggtccaccggccacgcatcctggtgctggacgaggcgacaagcgcgctcgacaaccgcacccaggcgatcgtcaatgacagcatttcgaagctgaacatgacccggatcgtggtcgcgcatcgcctgtcgaccattcaggacgcccatcagatctatgtcatgaaatccggccggctggtggagcagggcgactatcgcagcctgatggcgctcgatggcgaattcgcggccctggcccggcgccagctgctgtaggccatcagccaaggagcacggccgtcaatccgccgtcggcagaccggcatcggttgcggcggcgctctcgatcatgccgcgcaggctgccggtgttggcgaaatcccagcggccgtcatagacgacgtcatcgatccgccagccgtcatcgccgcgcaggatcgacaggcgatcggtccagctggtcatcagcgtgccggcctcgtaggcatagcgcagctcgaccgaggcggtgttgcgtgccagagtcacggcgccgacgcggcagctcgtggcaccctcgaacaggctggagaacagatcgccatcggcaaagggcggtttgtcgccaggggcgtggcggatggcggcatcgtgaagatgccgggcggcggtgagggcaccatccaggccgagggtgatcaaaggttcaagggcatgctgtgcagcggggggcggcaggccgccgccgcggaggtccggatagacggcacagaaggcctcggcgagctgtgagacctcgacgccgtcctcggcggctgccgcacgtgcggcgcttgcctgggcatcgagcgtggagccgtagacctcttcttcggcgagggcaacatgtggcaggacattgcagatcagcatcgccagaagccacgccgatgccgtctctattccccggtgaccgggtttacgaacacgcgccatttgaccgcctcatagtcgccagtcggatcatgatacggcacatcgagcgcgagtgcgcgcgcttccagcccaccggtcgccgccagcaccccgaaggctgccacgaccacgtcgcggcgcgctccggcaagcgcctcgctcgcatcgagcaggtcgcgttgggcatcgagcaggtcgatcagcggccgccggcccagatcgacttcgcgcgcgacgccgtcgagtgcggtggtcgccgcctcgacctgcgcctcgcgcgcggcgatggccgcacgggccgccagcatgtcgcgccagacccgctcggtccgctccacgatgctgcgttcggtggctaagcgggagagacgggcttcggcggcggtcttgcgggcctcgcgcagccggctctcggcaatgccggcactgtagatcggcaccgtcagctgcaggccgaccgccgcggcttcggtctcccgtggattgacatcaaggctggagcgattgcggctgaggcttccggtgacggagaccttgggcagcagggcgccgcggctgaccgcaatcccgtccgtcgccgcctcggtatcatagcctgcggccacgatctggggattggcttccctggcacggagcagggcggcgcccagagtgtcgggcagatgggcgggtaagggcgctggcgctggggccgtcggctcctggccggtcaccgcgagataggtggcctgcgatttggccagggcggcttcggcggcgaccacacgcgcctcggcatcggccacgcgcgcacgggcctgggcaagatccgcggccgtggcatcgcccagatcgtggagggcgcgggtctgatccagccgtcgcaccaacaggtcgcgggcctggcggttcaggttcagaacgtccaggtcccgcgcgacatccacatgggcggtgaccgcggcgagcagcacctcgctctcggtggtcctgaggcgggcccgctcggccctgatggtattctcggcccggtcgagcccggcggaggcggcgccgccgctatagaccggctggttcagggtcagcgcctgctggtcctggcgattggtgcggttgaccacgccgtcataggtcaggtcctgtacgtcgcggctggccgaggccgacaggctgggcaggaaaccgccgagcgcctgcgggcgctgctcgttgacgacgtcgagccgtgcccgcccgaccgccagatccggattggcgagataggcggcggccagggtctctgacagggtttgtgcgccggccggtgcgatcaccgccgtggtcgccgcgatgatggcggcgagacgccaggcatagggtggccggactggccggtgccggaccggggacccggcactcatcggctgccgtcggtcctcgggaaaaggcccgcggcaaaggccgcatcgccgacggtgaccacatcgccgccgacatcggcggcctggtcgacgtcgtcataggccatcagcggcgaggggagaaccagatgcatccggtcacgccggtcttccagcaccacgacctcgcagccgtctggaacgtccagcccggcttcggcgaggacagcggccggatcggccttcagccggtcgcgaagggcggcatccctggcggcacggcgcagcagatcggccagcatccgggtcacttcactcatgacctgtcaccttccgcccagagtgaatgtcacgccgccggagccgaaaaccaacagcatgtcatctccaccaggtggaacaaccggaccaccgacgccgccggcgacggcatcgagggcatcatccgccagatcgccgccatcggtatcctgggcgaccggcggaatgaccagatgcacgcgatctggcgtgttttcgaccacgacgaggctgacatcggccggcaggtcgatgccatgggccgccagggcctgacgcggatccgtcctgcacagggcgcggaactccgcatcccgccaggcatggtcgatgatatcgccaatgcgcttgcgcaattcgtccgtcacctgatcgtgagaggctgtgcccttgtccatgttcccgccgcgatgggccctttgttgcggggcccgcacgcgcccgctttcgcattcaacgctatgatcgacctgtttggtaaatcccaccactgcctgggtcaatggccgtttatgcgacatgcaagatatcatgcgcattgaggtacgatgccacgtcgtctgtggccgtaaggtcgcgcctgtcgcgtgaagcgtgtcgtccttcaggtcgttcatggtgatccgatccgcctgacgtccttttcaggatgcaagcttcggcgccccggtatataaggcgagataacaagcagtccaagggtagaggctggcggaggactatccgccgtgcgggatggatcgggggcagaggcgtgactctgcggcataacggggcggcacttccgtctgaacctagagatcgcgttgccgtgctgtcggaagacatcggcgaagcgcgtcgaattgccgactatcttaaaactgcaggattaatatctgtagctttgatcgccaatcgcgcaagttgcgatcagcttgccgaacggccggtggatcttgtcgtgctggactgcgatggtcgcaccgttgacggtctggcactcggccggcgcattctagcgcagggtcagcccggtctggtgttcgtcagcaagcgtgacgacgaggtggaacgggtgatcggcctcgatatgggtgccgacgatttcctggtccgccctttcagcctgcgggaactgaccgcccgggttcgctcggtcctgaggcgtcggcgcatgatgcccgagacgatcggcgcagacatccgccatgtccgtggctggaccatcgacctcacccgccgtgagatcgccgatccggatggcgaggtcgtgcggctgacccgcggcgaattcgacctgctggccgccatcgtccaggcgggcggtcggccggtgacccgggaatatctgttggaagtggtgtcgaagcgggcggatgcggtctccgaccgcacggtcgtgaccctgatcagccgcctgcgccgcaagctggaccgtggcgccggggatctggacctgatccgcaccgagccgggtgtcggctaccggatcaccgccgactgatcctgtcggcccatccgccataaagttccctgcatactgaatatgacacagaccccgcctcgccacgtggtgtaaagcacaccgcctctccggtgtgtcatgaaaagggcgtgccgtgtcgctgagtattgtggtgtagaggaagatgcggctgttcaaggccctatctttgtttcatgcaatcgaaggcggtcggccctacattctcctcatagccgaggcgcacacgacccgctgatgtcaagacatcgaccgtggcgctacagatcgtcgaaccggcccgcgcgtcccccgatgcgcaccgctcttgcaaccagatcatgcaatggctggcccattcccggcgacggtcccctgaaggaggagcaccgaaaccatgtccgccatgaagcatagccccaaagcccttgccgccgctgccgtgtgtgttgcggcccttgccctggctgcctgcggtaactcgcctgaacgtcgcggtctgaccggtgccggcctgggtgccggtgcgggtgccgcgatcggcgccgccacgggcggcagcgtgctgggtggtgcgctggtcggcggtgcggccggtggcctgaccggcgcgctgaccgacaaggacgacatcgacatcggcgactgatcgccatcccgacggttcccgtcgcaaaaacatcacggggcggtgcggtcgacgtgaccggccgccctccttacataccggtcagctttcgcaccctgcgcgagccgcctttcccgaaagacggaggtccatccatggagggacgcaacgacagctttctgggcgacctgttccgcatcatcgtcgcggtgatcctgccgccgctgggcgtgttgctggaggtcggcctgaccaagcacttctggatcaatatcctgctgacgctgcttggctggctgcccggcatcatccatgcggtctgggtcatcagccgtcgctgagaccgcccgtcatacggaaaggccccgatccctggccggatcggggccttttcatgcggcgtccctgaagggtgcggtcaccactccggatcgggaagatccagataggccgcgcgcaaggcctcggaccagcgctggcggatggagaggaaatagggatcggtctcgtcgatccgccgctcgaggtcgtattcgaaggtgtcggtgcggatcacggtcagatcgatcggcatgcccaccgacagattgctgcgcaaggtgctgtccatcgaaatcatggccagcttgatcgcgtcgtgaatgcgggtctccggccccatcacccggtcgaggatcggcttgccgtatttgtgctcgccgatctggaggtagtgggtatcgctcatcgcttcgatgaagttgcccgccgaatagatctggaaaaggcggagttcgtcgccccggatctgaccgccgagcaggaaggtgacgttgaatgcggtgtcatgggcttccagcgccgggccgtcggcacggtggacggcccggatcgactcgcccacaatttcggctgccgaaaccatgtcgggggcatcgtccagatggcggccgtcttccaggccgcgccgcaggcgattgaccactgcctgggtgatggcgaggttgccagcagccgtcaggcagagcaccgacttgccggggcgtccccagagcgtggtcttgcgataggtcgaaatgttgtcgacgccggcattggtccgggtgtcggagagcatcaccagtccggcgcgcatcttcaatccgacgcagtatgtcatgagggtgggaatccgtctgaggggcgcggtgtcgaaggggcgggctggcggaacccggcttcgtcccgccttcactgttgggcctgttccgtgacgtggacgcggacggcgaggtgttcctcgtcgccggcgatacggatgccgcgcacgggtgctgcatccagatagtcgagaccgtgggcgaggcggatataggatccggtcgggctgatgccgttggacggatcgaagccgacccagcccagcccgtccagccaggcttccgcccaggcatggctggcttcgctgcccgggttctcggcatggtcgtcgtcattgggcgagagatagccgctgacatagcgggcgggaatgcccagttcccgcaccagggtgataaagacgtgcgcatggtcctggcacacgccgcgcccgtgggccagcgcctcggcggcggtggtgcgggcatcggtggcccctttgacatatgccacgcgccccgcggtcaggcgcaggacggcatgcatggccgccaccgccccttcggcctccagcacagggcggacctcgtcagcgatggccttcagcgcgtcatcggccgtggtcagcggggtttcgcgcaggaacacctcgggcgacagcgtgtcgggcaggtcactgccgacgaccccggcggtatcggtcgtctcgacgatcccgcgtaccgtcaccgccagccggtcgtggtcgcgatcgagggtcaattgatgaacgcggttgccgaaaccgtcggtgagcggcaccagatgggcagtgggctcaacctcgatccgccacgagatcacacgctgggccgccaggtcgggcggggtaaggcgcagcgcctggatcgcatatcgggcaggccgcccataggtgtaaatggtctggtgctcgacggtcaggcgcatgaatccctcgacgatacggacgggagcgacggggtatacccgccgcagatcccggtcaagacagatagcagcgctgaatctcgtcgctgagccgcgcattgcgcatgatgaagtctgtcaggaactcgtgcaagccggcctgaaagatgtcctcggtccggccataggtcagctgggcgtgaagctggccggcctggcggtggcattcggccctgcggccgtagagcttggccagatagtccagctgggtgtcgacctctcccacacaggcgaccagcgatcgcggcatctcgggccgcaggatcaggaactcggctaccagccagggccggacattggtccggtacagccagtggaacgagcgatgcgccgagaccgcccgcaggatcgacatccactggtattcgtcgaccgcgccgccgacggtctcttccggcggcagcaggatgttatatttcacatccagaatccgggcggtattgtcaccccgttcgacataggtgccaagccgcacgaaggcataggcgtcgtcacggatcatggtgccgtaggcgctgccccggaacagggtgacgcgttccttgatccagtccaggaagttgcgcagctccgtgccggtgatggcggccgggtcgagccggttcatctccatccaggtgctgttgatgctctcccacatttcagaggtgagggcggtgcgcaccgagcgggcattgcggcgagcgttttcgatacagctgcggatgctcgacgggttgtcgcgatcgaaggcgatgtagtccaccacccggcgctgatcgacggcatcctcgccatgacgtgccatgaagcccccggcgacaccggcactgatgagcgccgagcgccattcgtcatagccgccttcggcagacgaaggcagcagggccatgcgatgggcggcttcgatgatgcgggcgagattttccgcccgctccatattgcgggagagccagtagatattgtcggcggtacggctgagcatcgagggggttccccgggaagatcggtcgagagggccgccggaacggcccctgcggcagggctgacgacgggcgccgggcggcgcctcagcgggcgagcacccaggtgtccttggtgccgccgccctggctggaattcaccaccagagagcccttcttcagcgccacgcgggtcagcccgcccggcaccagcgagacgccgttggcgccgaccagcaggaacggcctgaggtcgacatggcgcggggccaccccttcctcgaccagggtcgggcaggtcgacagggccagtgtcggctgggcgatgaagtcttccgggttcgccttgatccgctcggcataggccgcctgctcggcgcgggtcgacttcgggccgaccagcatgccgtagccgcccgatccgcggacctccttcaccaccagctcgtccagatgttccagtacatagcggcagtcgtcgttccggccgcaccagcgggtcggcacgttgttgagcagcggctcctcgcccagatagaagcggatcatatccggcacgaaagtgtagatcatcttgtcgtcggcgatgccggtgcccactgcattggcaagtgtcacattgcctgcgcgataggcgtcgatcagcccgggtacgcccagctggctgtcgggtcggaagaccagcgggtccaggaaggcgtcgtcgatgcgccggtagatgatgtcgacccgcttcggcccctcggtcgtccgcatgaagaccttgttttccgagacgaagaggtcggggccctcgaccagttcgacacccatctggtcggccaggaaggtgtgctcgtaataggcgctgttgtagatgccgggcgtcaggagaaccaccgtcggctggccggcggacatgttcggcggcgccaccgagcagagcgtgtcgcgcaggctggacgggtagtggtcgaccgggcggacctgatgcgccgacagcagatcggggaagagccgcatcatcacgtcgcggttctccagcatgtacgacacgcccgagggcgtgcggacattgtcttccagcacgaagaaatcgttctcgtcggtccgcaccagatcgatgccggcgatgtgggtatagacattgccggggaccttgagcccctgcatctggggcagatagcccacattgcgcagcaccagatccggtggaacgatgccggccttcaggatgtcctggccgtgatagatgtcggtcaggaaggcgttgagcgcccgaacgcgctgggccagaccgcgggacagggtggaccattcctcgccggtcacgatccgcggcaccaggtcgaagggcaggatgcgctccgggtcgccaccttcgccgtagacggcgaaggtgatgccgatccgccggaacagcacctcggcctcgcggcgcttcagttgcaggcggtcatgcggtgtctgtgtcaaccaggctctgatttccgcataggcagctctgacgtcctccggtgacctgacttcgtccggtgtgcgggcttcttcgggcgcatcggtccccgccgtcgcccagccgttcatctcgtcgaagatccggatgtcagtcgtattgctcaagagagcatcctccgccgtgttgacgttcgacggcatgaccagcaaatgccgtgccatcgatctgcggccggatcttccccggaaaccggccgctccccacttgaatcctgcccatcttttcggcagagaacaacagtgctgcgcagcgcagtggcgtcgaaagggggccggcctgcagaaaccggggcgggagcgggcggaaaacgagggcggaaagcaaaacgggcccggcgatgccgggcccgacaggcgatgatccgtccgggggatcaatcgtcggcgatgccggccgggatctgcttgcggagcgtcactacattgcggccgtcgatgcgggcatagtccacctgatccatcatgctgcggaccagatgcacacccagaccgccgatcggccggtcttcgatatcgccctcgagcaccggcggcggggcctcggcgaaggggtcgaaggcggggccgtcatcgacgatcacgacggtgaccgaggcggcgtcgccctctccggcggcaagccgcaccgtgatcggcaggccggtggcgccatcgggaaagccgtagctgatcacattggtgatcagttcgtcagccgcgagcgagatctggtacgagaccgccggcggcagagcatgcgcgtcgcagaaagtctcgatcgcatccgcaagccgggtcagttcgctcaggtcggccgcaagggccagttcggtcactgcggtcatggcgcggttccctgatccggggcgcgtgtggcgcagccgggcctgccggccgcgcgaggggtgagcgatcaggcgaaagccgcgatcgcctcgtcccggcccggcaggatctggaagatcgcgctgaagccgctgatgtcgaagacctcgcggatctcgggccgcatgcccgacaacacgaccttgccgccgctggccttggaccgcttggcggcgatcagcagcaccctgaggccggcactgctgatatagtccagcccggcaagatccaccgccagccggcccgcggaggagtccagcgccgccagaacctcggcttcgaaagccggacaactggtgccgtccagccggcccttcgggctgaggacgacgaccgttccgatggactgacgctcgatctgcatcttcgctcccgtcaacttgagcccggggccgccggtagccgtcaagaacactgacgcgcggcccctggaaccgttccggattccatatcaggtggcagcattttgcccaaggaattttgtccgggcacgacagtatatgacagttgaatgacgttgctgggtgacgattgcggcgcgtggggtggtgcggcacactccgcactctgcgggaccgacggtccggtcccgatcttctccggctcaggtggaatgctgctcgacgttaccacggccctggccgggctgggcctgttcttcctcggcgcacgcacgctgggcgatgccctgaaacgtctggctggccgccgggtccgggtggcggttgcccgcagcaccgacggcccgctgaaggcggccggcatggggctggtgatggcggccgtcacccagtccacccaggttgccaccttcatcctggcgggcatgatccgcgcggcgctgatccgggccgaacgggcgatgatggtcatgaccggcgtcaatgtcggggtctgcggcctgctgttcgtggcgactttcgatgtccggatcgtggtctatgccgttatcggtctgtcgggcatcgcgatgacccgcgcccgtttcgcgccctggcgggaccagttctctgccctgttcggcgccgggctgctgctgttcgggctgggcttgctgcgtcagggaacggtgccgatcgccgggctcgacatcgtaaccggcaccatggcggcgatcagcggccacgacatcctggtcttcctggcggccgccctgctgatcctggcggtacagtcgtcgtcagccgtgggcatgatcggcatctcgctggccggagccggcctgttcgggcccgaacaggcgatcgcgctcgccttcggtgccaatttcggcacggcgctcaacatggcgctgctgacccgcagcatgaccggccgcgcccgtcagctcgccatgttccaggtgctggtcaatctcgtcggcacggcggtgaccctgccgctgctgctggcggaaagcgccggccttaccggtttcggtccgatcggcgcgatcgcggcgctgaccggtgatgcggggcggagcgtcgcctgggcctttctgctgttcaatctgataggggccgggctgtcgggcctgctgctgccctggatcgcgccggttctggcgcggatctggccggtgacgcgggtggaggccgatgcccagccggccttcctggaagacggcatgctgcgtgacccggccggtgcgctcgatctggccattctggagcagcgccggctggttgcccatctggcgcatctgtcggcgattgcggccgatccgggggatccggcggccggcagggtggcgatggcccagcgggtcgacgggctgttgaccctgcatgggcggatcgccgaggtgctgcgggatctcggcgccgccgacatctcggctgccgcctatgagcggctggctcgcgcggtggccaatcatcagcgtctcgatggagtgatccacggctttgccgaactggccggcacgctcatcgaccggctgaccgatccgggggtgatggggcgggtctcgcgcggcatgctggatggtatcgatgccgtggtgatgacgctggccgaggtggcgcagagtgccgatgcggacgagcggatgctgctgcgggcgatgaccggcgatcgcgccgagaccatgggacgcatccgcagcagctatctggcggcggaagaggcgctgacgccggccgatcgcgggcgcctgctgctggcaaccaatctctgcgagcggttgttctggatgctgggcagcctggtggaagggctggaggccgagttcaaggccggcagtgaggatggcgtggtgctgccactgcccgaggcgtcctgaactggccgggggcctcgcggcagctgtgtcttcggtgccatgtcgtcgaaaatcgtcaccctccggtggattgtcggcatcgccggcagggctccgacggttatgctgaccgcaacggcatgttcttgtttcaggaaaggcgcacgggctccatgctcgatctgctcaccgatccgcaggtcattctcagcttcctcaccctcgcggtgctggagatcgtcctcggtatcgacaaccttctcttcgtccagatcatcgccggacgggtggcccctgaacggcgggacaccgcccggcgggtggggctggcgctcgccctcgtcacccggctgatcctgctggcggccatctcgtgggtggcgggcctgaccgcaccgctggtggacatccagggcttcgccctgtcctggcgggacgtgatcctgatcgccggcggcctgttcctgctcgccaaggccacgaccgagatccaccacacggtggatggcgatgaagagcacggggcaggggagccgaagatccatctcagcctcgccgctgccgtagtacagattgccctgctcgacatcgtgttttcgctcgacagcgtgatcacggcggtcggcatggcgcagcatctgccggtcatggtggcggcggtgatcgcggccatgatcgtgatgatcgtggcggccgccccggtcggccgtttcgtggagcggcatcagtcggtgaaaatgctttgcctgtccttcctgcttctggtgggcgtggccttgatcgcagatggactccatttccatataccgaagggctatctctacttcgccatcgccttctcggcgctggtcgaaggtctcaacatcctggccaagagccgccggcgtcgccgccgggccatgagcaacgtcgcaccgtcgtgatcttcgaaatactgatcgtcttcgcgctgatcctgctgaacgcggttttcgcgatgtcggaaatggctctggtctccgcccgccgccctcggctgatggagcgggcctcggccggtgaccggtcggcggccgccgcactgcggctcgccgacgacccgacccggttcctgtccaccgtccagatcggcatcaccctcgtgggcgtgctggccggtgcttattccggcgccaccctcgccgggccgctggccgatatgctggcgaccattccgggcttcgagccccatgcgcggccggtggccgtgggccttgtcgtcgccggcgtcacctatgtgtcgctggtggtgggagagctgatcccgaagcggctggcgcttgcccatgccaccacgatcgccatggcggtggcgcggccgatgtcggtgctggcggtgatcgccaccccggcgatctggctgctgcgtgtgtcgaccgaaggcgggttgaagctgctcagggtcgacaccgcctcggccgaagcggtcaccgaggacgagatccgggccatggttcgcgaaggggcggacagtggtgccatcgatcgtgccgaacagaacctgatcgacagcgtctttgccctcgacgaccggccggtccgcaccgtgatgaccccgcgccacgacgtcatctggctggatgccgatcggcctttcggcgaacagctggaccggatctcgggcagtgcgcgctcacgctatccggttgcccgcggcagcctggacgaaccggtgggcatcgtcgccacgcgcgacatcctggacgtcgtgctggccggtggcacccccgatatggcgacgctcgcccggccggtgctggtggtgcatgaagcggtgccgctgctgaaaatgatcgccatgctccgcgatgaacgtgagcccatggccctggtggtcgatgagtatggcggtgtcgagggcgtggtgaccgccaccgacatcctgtcggcgatcgcgggcgagaccgcgctcggctgggatgatgatcggcctgcggcggtcgcgcggcccgaaggcggctggcttgccgatggtcgcatggcgatcagcgaggtcgagcgcctgctcgaccgtcaggaccttcacggcgaaggcgactacgcgaccctcgccggtttcctgctctggcatatggagcgggtgccggtggcgggcgacgtcttcgactggcaggacatccgcttcgaagtcgtcgacatggacggccgccggatcgacaaggtgctgatccggctgcggcctgtggatgatgtgctgccgggcgaggggatctgagccgcaggtgccggcttagcgcagcacaccgccgcggagatcgggggccagacgccggatgccggcatcggcctccgccatcgcacgttctccctggttgccgtcgcaggcgcggttggcgcgatccagatgctgacgcgccgcgatgtagtcggcgacgcgacggtcccgccggggcggatcggccaccagtttcgccagggtctgcacggccgatcgacaagaagatcgtgtggcgtcctgggcgcgggcctcgcccgaagggagtgcggccgcaaacatgcctgccatgagaccggccagaaagatgctgtgcagacggatccgcccggggcgggcggtacgaaggcagcggatggtcatcgcgaaggcgcctcgtcgatcaggcgggagcacttgcgccgggcaggagcgtagatcgcgtcccgatcaggtggggaaaggacatctgcgttgcactgtgcgcccctgtgcaccagaaggccgtggaacgatcctttcgcgtcgcagtatctccatgcagggctgtgctgtaaacggcgaactccacgaaatccgacggccgatatcgcggggcggcgaatcgccgcgtatcgcaaatcagtctcacccgcgcttgaagcgacgcttccggaatgataggcaagagctgataggaattcgcaatcgcacgccgctggcgccttcggcccggcggcccggattccgcctgccccgcttatcgacgagactgccatgaccgacatgtttcgccgtcccgcccgtcatcgcctgttcggcagcatcggcggcgctgccgcggcccttgctctgctggtcgccggcccggcggcgtccgctgcagaggttaacctctactcggcgcgccaggaacagctgatccgcccgatcctcgacaccttcaccgccgaaaccggcatcaaggtgaacctgctctccgacagcggcgaaaagctgctggcgcgcatccaggccgagggggagaacagccctgccgacattctgctgaccgtcgacgtggcgcggctggagcaggcgaaggaagcaggcatcttccagcccgtctcgtccaaggtgctggaagaggcggtgccggcgcatctgcgtgacagcgacaatgcctggttcggcctgtcgaagcgcgcgcgtgtggtcgtctacgccaaggatcgggtgaagcccgaagagctgtcgacctacgaacagctcgccgatccgatgtggaaggggcgtatcgccatccgctcgtcgagcaacacctacaaccagtcgctgaccgcggccatgatcgtggccaacgggcccgagaagaccgaggactgggcgaaggggctggtggagaattttgcccgcaagccgcagggtggtgaccgcgatcagatccaggccgttgcctcgggcgaagccgatatcgcggtggtcaatacctactatctgggcggtatgctcgctggcaaggacgaggcccagaaggcggccgccgagaaggtggccgtgttcttccccaatcaggacggccgcggtacccatgtcaacgtttcgggcgccggtgtggtcaagaccgcgcccaatcgtgaggcggcggtcaagctgctggaattcctggtctcggaagaggctcagaagttctacgccgaagtgaaccaggaattcccggtgcggcccggcgtgccgtcctcggagatcatccagtcctgggggccgttcaaggaagacaccgtggcgatcacccgcctgggtgagctgaaccgtcaggccgtggagatcatggaccgcgccggctggcgctgagcggagcggctgcgacgttccggaaagggtgccgtgacggccacgtcacggcaccctttcgccgtttcaggccggcaatgcttgatccgccgtcagacgacgtgtacccatcttcgatcccgggactgcggatgtgtcgcagtcacgatcgcgacatgctccacaggcaggatgcctggcacccacggcagctgacggaggcgtatccgccccatggccaccatctatgcaggcaagccggaggacgagccgcccgcggcgggccgcgccgctgtagcaccggtcctgcaggcccgtcgtggcgggcggggcgggttggcctggccgcttgcggccatgctgctggcggcgctggtggcggtaccggtggtggtggtgctgagtgcggggctcacccccgatctcgccgtctggtcccatctgatcgacaccgtgcttggccggtatctggcaaatactctctggctgacgctcggggtcggcgccggcacgctgacgctgggtgtgggcacggcctggctggtgaccatgtgccgctttcccgggcgacggagtttcgaatgggcgctgctgctgccgatggcggtgccggcctatgtcatcgcctatacctattccggcctgctcgactattccgggccggtgcaggagacgttacgtcttctgatcggcgccaccagccgccgcgactactggtttccgcagatccgcagcctgggcggtgccatcgtggtgatgacgctggtgctctacccttacgtctatctgctcgcccgggcggcctttcttgaacagtcgatgtgcgtgctggagatcggccgcacgcttggcaatggcccctggtcctgcttccggcgcatcgccctgccgctggctcgtcccgcgatcgttaccggcgtcagcctggcgctgatggaggtgctggcggatttcggtacggtcgattatttcgccgtcgacaccttcaccaccggcatctaccgcacctggttcggcctgggggagcgggccgccgcggcgcagctggctgcggtgctgctttcggtggtgcttatcctggtgctgctggagcgggcgagccgcggcgagcggcgcttccaccacacctcgcgccgctatcggccgctgccgggctggcagctccgcggcctgcgcaaggcgggtgccgttgcggcctgcgccctgccgatcctgtgcggttttctgatcccggctgcagcactcggctggtgggcgctgacctcgcggctcgattccggcagcggctttccgcgccttgtggtcaccagcctgctgctggcggccgcagcggcggtgatggcagtggcggcggccctggtcgtcgcctatgcccgcaggctggcccccggtcgcgcctcggcgctggcggcgcgggtggcggccatgggctatgccgtgccgggggcggtgatcgcggtcgggatcgtggttcccctggcggcggccgacggggtgatcatcgacatcgcccgtgcccttggtctcggcaatccgggcctggtcctgaccggcacgctggtcggcctgctttacgcctatatggtccgcttcctggcggtgtcgctgaacacggtggaggcgagcctcggcaaggtgacggcctcgatggatgatgctgcgcgggtcttcggcctcgggcccggggcgacgctggtccgggttcatgcgccgctggtttcgggtggcctgctgaccgccgccctgctggtcttcgtcgatgtgctgaaagaattgccggcgaccctgatcctccggcccttcggcatcggcacgctggccatgcgcacctatgaactggctggcgatgaacgcctcgccgatgcctctctgcccgctctcaccatcgtcgccgccggcatcctgccggtgatcctgttgtcccgggcgatcgcccggtcccgtcccggtgcccggaattgatgaacccgtcctccaccacgccttcgcgactgatcctcgacgacatcgtccatgcctatgacgggcgggtggcggtcgaccatgtctcggtcggtattgcggcgggcgaaatcctgtgcctgctgggcccgtcgggctgcggcaagaccacctgtctgcggcttgcggcggggcttgaagacgtgcagcacggccgggtgatcatcgatggccggacagtggccgagccgggccgggcggtgaaacccgaggcccggggagtggggctggtcttccaggattatgccctgtttccacatctgaccgtgcgcgacaatgtcggcttcggcctgagacaggccggcgccgccgaacgccgccggcggagcgaggcgctgctcgatctggtcgggctcggcggtcggggaggggactacccgcatatgatgtccggcggcgagcagcagcgcgtggccctggcccgggcgctggcgcccgagccgcaggtgatgctgctggacgaaccgttctcggggctcgacatcgcgctgcgcgaccggttgtgcgccgataccctggcggtgttgcgcgaggtgggcgccgcggccctgatggtgacccatgatccggatgaagccctgcgcatgggggatcggatcgcggtgatgaatggcggccggatcgtgcaggcaggatatgccacggaactttatcaggcgccggcaaccccctttgttgccagacttttcggcgaactgaatgccatcagcctgcgggttgcgggcggccgggtctcaacgccgctcggcccgttgccggcaccgggctttgctgatggcgcggcggtgacggtgatgatccggcccgaggcgctgatcgaggatgcgtatggggttatcgaggccgaggtcgtcgaggtccgggcgctcgggccggtgacggcgctgggaatacgggttgcgggctggcccggccggctggggttgcggctcggcggtgtgccgcgccatgaccggggcgatcgtctcaggctgactctcgacctgggccagactttcgtattcgcggcggatgggcgctgacggctgcattgcacagcccccgtgcttctgccatcatgcgccgcacgattaggcagtccgggggactgcggaggaggggtacccgatgagcatcggtatttggcagatcgtcctgatcctggttctggtcctgatcctgttcggggcaggcaagctgccgcgggtgatgggcgacgtggccaagggcatcaagagcttcaaggccggcatgaaggacgaggagaccgagaacaacagctcgtcgtctcaggatccgaaagtgctgaacaagccgcaggatgcgcgcatggcggacgaggtccgtcgtgatgaggtcagcggcccgaaggcctgatccggtgacgcattcgaggagcggacgcaggctgctgcgtccgtctgcgtgactccatgttcgacatcggctgggcggaactcgccctggtgttcgtcgtcgccctgatcgtgatcggcccgaaggacctgcctgtcgctttgcgtgcggccggcgtctggatgggacggttgaggcggatggcgcgcgaattccagtcgagcgttgacgaggttctgcgcgaatccgaactcaaggagctgcgcgaccgggccgagaaggcgtcgcgcttcgacatgggcgaggcgacccgcagggcgatcgatcccgatggcgcgctggagcgggcgacatctccggttcgtctggatgatgacgccccggccgcgaagcccgcggatgcggatgcggcgacgcctgccgcggccccggctgctgcccatccggctcctgcatctcaggcgcccgcatctttggcccccgcacctgcggcaccgacggatgccacgcccgccgcaccggtcggaccgaaaccggccgcgccggatgcggtacccgacgatgccaccaccccgaaggcctgacgcttcatggcgacccatgacgatgacgacgaggtcgagaactccaaagcgccgctgctcgagcatctgatcgagcttcgcaaccggctgatctattcggtcgtggcgctgctgatcgccttcggcgtctgctacatgttcgccgaggacatcttcggcttcctggtcgagccgctcgccaaggtgctcggccacgacaagcgcctgatctacaccggcctgaccgaggccttcttcacctatgtgaaggtctcgttctatgccgcgctgttcatctcgttcccgatcatcgcctcccagctctacatgttcgtggcgccggggctctaccggaacgagcgcaaggcgttcatgcccttcctgatcgccacgccgttcctgttcgtactcggtgcggcgctcgcctattactttgtctttccgctcgcctggggcttcttcgccggcttccagaccaccggcagcgaaaccagtatggcgatcgaactcgaggcgaaggtcgatcagtatctgtcgctggtgctggcgctgatcttcgccttcggtctcgccttccagctgccggtggccttgagcctgctggtgcgtgccgggctggtgagcgccgaagccctggccaagaagcgccggtttgcgatcgtcatcgtcttcctggctgcggcggtgatgaccccgcctgatctgatcagccagtgctctctggccgtgccgctgctgatcctctatgaaatttcgatcttcatcgcgcggcggatcgagagggcacgggcagagcgggagaaggccgaggaggcggaactcgccgcgacgctcgccgacaaggacgacagcggcgcttgacccgaagggatcagggccgttagatgggcgcgcttcggccggatggccggcgcgcccttcgtcgtttccggaaccatcgttcattcagcgagcgaaccaatgcacgacatacgccttctgcgcgatgcgcccgacgccttcgacgccgcccttgctcgtcgtggcctcgatgcgtcgtcggagcgtctcgtggcgctcgatgaacggcgccgcgccctgatccgtgagctgcaggaattgcagacccggcgtaatgtcgcctcgaaggaaatcggccagatcaagcgcaccggcggcgatgccgcggccctggtcgccgaggttcaggcgatcaaggaacggatgcccgagctggaggccgaagagacggcgcttggccgcgaactcgacgatgcgctctccagcctgcccaaccagctggatgcggacgtgcccgacgggccggacgagaccgcgaatgtcgagctgcgccgctggggcacgccccgcgccttcgatttcgcgccgcgcgcccattatgaactgggcgagatgatggctgccggtccggtgctgaaggcgatggatttcgagcgggcggccaggctgtcgggcgcacgcttcgtggttctggccggccagatggcacggctggagagggcgctggcgcagttcatgctggacctgcacacaggcacgcatggcttcatcgaggttcagccaccgcttctggttggcaccgacgccgtctacggcaccggccagctgcctaaattcgccgaggatctgttccgcaccaccgatgaccgctggctgatccccacctccgaggtgccgctgaccaatcttgtggccggcgaaatcctggacgaggcggccctgccgctgcggctgaccgcgctgaccccatgcttccggtcggaagccggctccgccggtcgcgatacccgcggcatgctccgtcagcatcagttctcgaaggtggagatggtgtccatcaccaccgccgaagcctcgcgcgacgagcaggactacatgacggcctgcgccgaaaaggttcttcagctgctggaactgccctatcgggtggtggtgctgtgttcgggcgataccggtttcgccgcagcgcgcacccacgacatcgaagtctgggtgccggcgcagaacacctatcgcgaaatctccagcgtctcgaacacccgcgatttccaggcgcggcggatgaaggcccgctgccgcaaggccggcgagcgcgatacccgcttcgttcacacgctcaacggctcgggtgttgctgtcggtcgcgcattgattgcgctggtcgagaaccatcagcaggcggatggcagcatccgcatcccggaggcgctgcgcccctatctgggcggcgccgaggtcgtcggtgcctgatccgttcgcctgtcccctgcagacgacacgcatcacatcataccggaataccggaaacgagtgccgccgattgcatcggcggcacttcccatgaaagccaagaacgggtatccaagcccggctttcccgatcctcaaggagttcggcacgtgcgcatcctgatcagcaacgacgacggcatcaacgcccccgggatcgcgatcctggagcagattgcgcgcgagctgtccgacgacgtttgggtcgtcgcgcctgagaccgatcagagcggcgtgtcgcattcgctgaccatccataacccgctgcgtgtgcgcaagatcgccgacaagcgctatggcgtcagcggcacccccaccgattgcgtgctgatcgccacccgccggctgatgcacgaaaccgcgccggatctggtgctttcgggcgtcaatcggggcgccaatctgggtgaggatgtgcattattccggcaccatcgccgccgccaaggaagccacgctgctgggcctgcaggcgatcgcgatgagccaggttttcgtcgatccgcaggatgtgccctggcgcacggctcgtgctcatggccccgccctggtcgagaagctgatcgccacgaaatggcccaagggcgtgctggtcaacgtcaactatccgccggtcgagcccgaggcggtgaccggcgtgaaggtcgtctcccaggggcagcgcgttctgggagagatgatcgtcgaaggccgcgacccgcgtggcgtgccctattactggatcggcggactgcgccgcgacggtcacgagaccgaaggcaccgatctgtcggtgatccgcaagggcgccatctcggtcacgccgctgcatatcgacctgaccgcccgcgactatatgggcgcgctcgaggacgtgctgggggcctgacgatggagacgctcgccgaagcgaagatcaagctgttgatgcagctgcgttcggcgggcatcaccgacacgcgggtgctgaaggccatcgagacggtgccgcgcgagatcttcgtgccgacaccgctggtgcccaaggcctatgccaatcgcgccctgcccatcgggcagggccagaccatcagtcagcccgaggtggtggcgctgatgacccaggccctggagctgggcgaccggcacaaggtgctggagatcggtaccggctccggctaccagaccgcgatcctgtcgcggctggctcgccgggtctatacggtcgagcgtcatcgcagcctggcgcgggaagcccagagccgtttcggggaactggccatgcacaatgtggtcaaccggatcggcgatggtatgcgtggctggcccgaacaggcgcctttcgaccggatcatcgtgacagctgcttcggacgaagtgcccgaagaactgctcgatcagctggcgatcggcggactgatggtgatgccggtgggcgcccatggccgcgaacagcgcctgatgaagctgatccgcaacgaagatggcgtcgacgacgtcgagattgcccgcgtccgtttcgtgccgctgatgcccggcgtgccgcgcgaagatgatccgggctcgccggcgggttgatacgcgctggcggcttgtgccggatcacgcttccgttgccgcagtgcgacatgcggcttagactgggcgcgccatgaacggggccgccatgatcagacccagcctgtcctttcgccatgccgctgcagcggcgctcgtgcttctcgttgccgcctgtgccgggcgcgacgagccggcgccggtcgattttcgcggtgcccaacctggggggatcgcactccccgccggggcgagcgagatcgtcgtggagcggggcgatacgctgtatgccattgcccggcgtaacaatgtgccgctgcgggcgctgatcgaagcgaaccatctgcaaccgccctataccatctatcccggcaaccgcctggtgctgccggccaaccgcatccataccgtgcgccagaacgagacgctctacggcatttcgcgggcctatggcgtggagatgacggcgttggcccaggccaacggattgcagccgccctatcctgtgtcgcccggccagcgtctggtcgtgcccgaagggcaggggcccggcacccaggccgcggcggcggcggtggccgcggcggggccggagggccggccgccctcgacccggatcgaggatgcggagacgatttctgtatcgcctgcggtcggcggcacggccgtcgcatccgcgggaaccgctgccaccggcggcaccggcatctcggccgctcctctgccgccgcccggaaccgagaccacgtccgcggcatcgacgacggttgcgcccgtcacgacggcaccggcttcggccggcgagcccgcgaccggtggtgaaccggtgacgcttgctccgcgcgcggaagacgtcacgccgccgcccgcggcacctgcagaacccgcgccgcagccggccccggccccggtcgagccgccaaaggcggaaccggcgcccacgcccacgcctgcaccggcccagccggcagctgaaccggcgcctgcgccggtgaaggccaagcccgtggaaaccggtgatctggggccggcgccgaaacgcttcgtctggccggtcaacggccgggtcgtttcggcctatggcgacaaggccgggggtctgcacaatgacggggtgaacatccaggcgccgcgcggcacgccgatccgcgcggccgccgacggcgtggtggtctatgccggcagcgacctgaagggtttcggcaacatgctgctgatccgccatggcggcaactggctgaccgcctacgcccatgcccaggcggtgctggtggatcgcggccagcgggtgaagcagggcgaggtgatcgcccgggtcggctccagcggcaatgtcgatcagccacagctgcatttcgagttgcgccggggccgcgaagccgttgatcctgaacgctatctgccccggcgatgagccggggcaggctgcgtcgtcgctgatgggcccggctgtcagcggtagcggctgaagatcaccgatgcgttgacgccaccgaagccgaagccgttcgacagcacatgatcgacggagcggtgccgggcctcggggccgatcaggtccagcccggccgccgcggggtcgggatcggtgaggttcagcgtcggcggcagtatgccgtcgcgcagcgccagcaccgagaacatcgcctcgatcgcgccggcggcaccgagcagatggccggtggccgatttggtcgacgagatcgacacgcccgcgccctcgccgaacaccgcgcggatcgccgccagctcgccggcatcgccgaccggtgtcgaggtcgcatgcgcgttcagatagccgatctctttcggatcgagacgggcagaggcgagtgccgcccgcatcgcccgctgggcgccttcaccgtcttccggggccgcggtcatgtgatgggcatcggcgctggtgccatagccggtgagttcggcgatcggaaccgcgccccgggccagggcatgatcgagtgcctcgatgaccagcatggccgcaccttcgcccatgacgaagccgtcgcgcgccgtatcgaagggccgggaagcttcggccgggcggtcgttgaagccggtcgagagggcgcgcgctgccgcaaagccaccaaggctgacccggtcgatgcacccttcggcaccacccgccagtgcaatatcggcctcgccggaatggatcagccgggcggcatcgccgatcgcctggacactggcggcacaggcggtgaccggcgcgcccagcggcccgcgaagcccgaagcggatcgagacctgaccggccgccatattgggcaggaaggacggcacggtgaacggagaaagccgccgcgggcccttgccgtcggtggtgcgcacggcctctgccatggcgggcaggccgccgacgccggtaccgatgatggtggcggtgcggtcgcgttcggcctcggacgcctccagccagccggcctggcccagcgcctcttcggcggcggccagggcgagcaggataaagcggtccatcttcttgtggtccttgggcggcacggcgcgggcggcatcgaagccaccctcggcatcctcggccgcatcgggcaccacgccggcgattttcgccggcagatcctgcaccatggtctcgggcagggcgcgaatgcccgagcgtccctcgatcaggcgccgccagaccgtgggcgcgccctgaccgagcggcgagaccacgccgataccggtgacgacgatgcgtctcatgggggtgtccttcatcttgacccggaggacagcagcgtcctgaggtcgttgagggctgcggcgatcccgtcggtcatcggcgcgggatcgccagcgagaaaggcgagaacggcgctgccggcccagcgtgcggtgaaatcccgggcagcgatgtccgccctgtctgcgtcgacaccgcccgccttcagttcggccgctacgctggtgcgcaacagggttgctgcccggatgcatgtctcgcgggcgacgcgctccgcctcgccgccattggccaggtcgcgggccagccgctggatcgggcagccatggcgggcggcgagcggggcaccggcggccagcccggttgcgatgatcgtcagccgctcttccggagaccggccctcggccgcccgggccagaatctcctctgcccggtttagttgcgcatcggctgccaccgtcgcaagggctgccttggtcgggaaatgatagaacacggcaccggccggcacgccggcccgggcggcgatgtcccgcaggctgacggcatcatatccccgttcatggaagagatcagccgccgctcgcgccaggcgctcacgacggtctcgggcagggaggcgcataccggtggttcgttcgggtttagttagtcaactgacttaacaggagcatcaaaaatgggccgcgtcaagcgcggccctttgggtggttcagcccttgcgggtttccagctggcggcccagccggccggccagatcctgaatatactgccaggccacacggcccgaccggccgccgcgggtctgggcccaggcgagggcctcccgctccacatcgacgtccttcgagcccaggccataggcggtgacatagccgtgcaccatcgcgagataggtcttctgatcgcaggcatggaagccgagccagaggccgaaacggtcggagagcgagaccttttcttcgatcgcttccgacgggttgatcgccgtcgagcgctcgttgtcgatcatgtcgcgcggcatcagatggcggcggttggatgtggcgtagaacagcacctcgtcgggccggccttcgatgccgccgtcgagcacggccttcagcgacttgtaatcggtatcgtcgtgatcgaaagagagatcgtcgcagaacagcagcgcgcgggtatcgcccccgcgcagaactgccagcaggtcgggcagctgcgaaatgtcttcgcggtggatttcgatcagcttgatcggccggtggccggccggcgtctcggccacgatcttagcatgcaccgccttgaccagcgagcttttgcccatgccgcgcgcaccccagagcagggcattgttggccggcaggccggcggcgaaacgccgggtgttctcgagcagctgatcgcgggcgaggtttacgccttccagaaggccgatatcgacccgcgagacccgggggaccggctgcaggctgcgattggtcgagacccagacgaaggcgtcggcggcatcgagatcgatggtggcggccggcggcggcgccatgcgctccagtgccgaggcgatgcggtcgagcgccgacagaaggtcgggggaagcagaggcggtatcggtcatcggggcaggatcctgcaggcggatgtcggacagagggcagtgacgcggtgttatatcgcgttgatgatgcgggcccaagcggcgggccacgatggggacccccacaccgcaggaccggcccggtcccctgaccgccgggttcgctttgcaaagctgcggggcaccgctatagtccgctcacgactgcgccggagccggtttgcggctgcggcctcctcttgccaacgcaatatacacccacggggacgtatcgatgctcatctctccggcctatgcgcaggccgccggtgccgacggcggtgctggcatgctcatgcagctgctgccgctgctcctgatcttcgtcgtcttctatttcctgctgatccggccgcagcagaagaaggccaagcagcaccgcgagatgatctcggcgctgcgtcgcggcgaccgtgtggtgaccgcgggcggcatcgtcggcacgatcgccaaggtcgatgacgacacctacgccaccctcgagatcgcgcccgacgtgcgcgtgaaggtgatgcgccacaccatcaccgacaagatcgcggcgaccgagccggcccgctcgggccgcaagggcaaggaggccgacgaggctgccgacgccgacgccgacgccgagaagagcgggaagtgacgaccaggccgccgccggaggcatccggcggcggccttcccgataagacgtctccccgaggtccgcttcccggccgcctctccgcctttccgcccagacgacggtatccatgctgcaattcgccaagtggaagacggcgctgatcatcggcatctgcctgatcggcgttctcttcaccgctccgaacctgatcggccggcagacgctcgacgcgctgcccgactggttgcccaaacagcgcctcagcctggggctggatctgcgtggcggctcgcacctgctgctcgaagtcgagatgggggcggtgctgcgcgagcgcctggcctcggttgccgatgatgtgcgctcgaagctgcgcgaggacggaaccggttatgccgcgatcggcgtcgatggtgatgccatcgtggtccgggcgcgcgatgccgccgatgccggcaagatcgcggatgcgatgcgcggcctgaatgccggcctcgatgtgtcgaccgatggcggcgtgatccgcgctaccttcaccgaggccgagatcgcccatcgccgcgaccagacgcttgcgcagtcgatcgaggtcgtgcgccggcgcgtcgatgaactcggcacccgcgaaagctcgatccagcgccagggcgacgaccggatcatcgttcagctgccgggcgtcgagaatccgggcgagatcaaggccctgctcggtaccaccgccaagatgagcttccgcctgctcgaccccacggtcagcgcggccgaggtgctctcgggcgggcggctgccgccgggttcggaactgctggacggtaccggcccgggtggccagccgaccaaatatgtggtccagcgccgggttctggtgtcgggcgaacgcctgaccgacagccagcccagcttccagaacaacgagccggtggtgagcttccgcttcgacagcgtcggtgcccgccggttcggcgaggccacccagcagaatgtcggccgcaacctcgccatcgtcctcgacgacaaggtgatcagcgcgccggtgatccgcgagcccattctgggcggttcgggcgtcatttccgggaccttcacggttcaggaagccaacaatctggccgtcctgctgcgtgccggtgctctgcccgcaccgctgaccgtgatcgaagagcgcacggtcgggcccgatctgggggccgacgccattgcccgcggtgaattcgcgagcgtgctggccttcgttctggtcatcgccttcatggcgctctactaccgtcgtctcggcctttacgccgatatcgcgctgctcgccaatctggtgctgctgctgggggccctgtcggccctgcaggcgacactcaccctgccgggcatcgccggcatcgtgctgacgatgggcatggcggtcgacgccaatgtgctgatttatgagcggatccgcgaggaacgcgctgccgggcgatcggtgatcgccgcggtggaggcgggcttcaagggtgcgatgaccaccatcatcgacagcaacctcaccacgctgattgccgcggcattgctgttccagttcggctcggggcccgtcaagggtttcgcggtcacgctgtcgatcggcattctgaccacgctgttcagcgccgtgttcgtgacccgtctgcttgtggccagctggctgcatcgggcgcgtccgaagacccttgccctctgaccgcgccgggatcgatcacatgttcaagttctcgctccaccccggcaagaccaatatcgacttcctgcgctaccggatcgcggccctggtcttcaccgcccttctgacggtcgccaccatcggtctggtggtcggcaaggggctgaatttcggcatcgacttcaccggcggcgtgctggtcgaggtcgagacctccggccccgccgatctgggggcgatgcgcgacgcgctgggcgacggcagcttcggcgatgtgtcgctgcagaatttcggggccgacaacgccgtgctgatccgccttgggcaggatgccggcgaaggcgacgcccaggggcggatggtcgaggcactgcgccagaccctgtccgagaaggtcgacccgaatatccagatccagcgtgctgaattcgtcggcccgaaagtgggtcaggaactgatcgaaggggcggtgatcgccttcgtggtcgcgattgcggccatgatgatctatgtctggttccgcttcgaatggcagttcggcgtgggcgccgtcgcggccctgttccacgacgtgatcatgaccatcggcatgtatgcggtgaccggctatgagttcaatctcaccagtgttgccgcggtgctgacgatcatcggctattcgctgaacgacacggtggtcatcttcgaccgggtgcgcgaaaatctgcgcaagtaccgcgacatgacgatcctggagctgctgaaccgggcgctcaacgacacgctgtcgcggacgatcatgaccgggttcaccacgctgatcgcgctgttcgcgctctacttcgtggccggctccgcgcttgcgggcttcaccttcgcgatgatcgcgggcgtgttcatcggcacctattccacgatcttcatcgcggtaccgatcctggtctatctgaacctgcagaagcgccagcggggccgtgtgggcaccgatggcaacggtgacggggaggcggaggccgaggtgaaggcctgacgccgccaccgtccagccaatttcccctcagaccggagtattccaccgatgatggacctgacccccaagctcgccgacggcgccaaggtggtgcagggctatgcggaaggccgcttccgtatcggcggcgagatttttccgcattcggtgctggtgatgccgggtgtcgtcgaggcctggcaggtggcagatctcgccaccgcctcggtcgacagcctggagccggtgctggctgccggccgcgccggggcggtcgaagtgctgatcatcggctgtggcccgcgcacccagctggtaccgcggccgctgcgcgaggcgctgaaggccgccggcatcggtgtcgaaggcatggacaccggcgccgccgcccgcacctacaacgtcatgaccatggaagaccgcaaggccgcggccgccctgatcgttctctgaccacagaacggcgccaaacgaaaacccccgcccggagctgccgggcgggggttttcatatgcaggacaacctgcgccggccggatcaggccttggcgaggttctcggctgcgaagtcccagttcaccagattgtccaggaaggactggacgaaatccgggcgacggttctgatagtcgaggtagtaggcatgctcccagacgtcgatggtgagcagcggcgtggcgccggtgccgaccggggtctcggcattgccggtcttcacgacctcgagcttgccgtccttcaccaccagccaggcccagcccgagccgaactgggtggtggcggcgttcttgaacgcctccttgaacttgtcgaggccaccgaaatcggcatcgatgcgcttggcaaggtcgcccgagggggcgccgccgccattcggcttcatcgaattccagaagaaggtgtggttccacacctgcgcggcgttgttgaacacgccggccttcgccgcatcgccgcggctcttgacgatgatgtcctcgaggctggcgtcggcgagatcggtgccctcgaccagcttgttgaggttcacgacataggtgttgtggtgcttgccgtgatggaactcgaaggtctgggccgagatgtgcggctccagagcggtcttgtcgtagggcagggcgggaagttcgaacgccatgacgatcctcgtcctcaattgtcattatgcccaggcggcggacccctcttgtcgtgggctgccgccggatgacaggccccgccggccacatgccgcagaccggcatgccgtcgggaggagcccgatggggtgataccgcgaaatgccgccccctgccaaccgtcgctgtgccaaccatcggtgggccgggccaccctcggaccggaatggacccaggcggggcctttgcggcaaaaccccttcaacagccacccggttccgcctgctggcgggcccgggtcaccgttccgcccgaatatggggcgagtctcggcccgggccaagggctgccttcgacatgtcacgggttggtgtgtgcccatggtgcgccggatcagcgacggcgaagcacggccgctgccgcccgctgccccgagaccaccgcgccttcgatcgtggccggcaggccggtggcggtccagtcgccggcaagcacgacatccggccgggggcgggtgcgatcgacagggcccgggcgcagggcctcgccgcccggatcgtggcgcatggtcgcccgcttctctttcacaacccggaccggcggcatcgcggccggaagcccggccatggcgaggcaggtccggatttccgcccagccggttgccgccagcacctctgccggccggtccatcagcgcatcggcggcgctggtggtgatggacaggatgccgtcccgatgaaagatccagtcggccatcccgccggtcaccatcagcgcctctggcatgccggcgggcagctgatccggggcgtagtggatgttcaggatggcggagctggcgcggggcaccgtgatgttgggcagcaggcgatgggccgccgccggcggcagggcgagcacgatcatccggtcgggatcgggcggcggcagccggtcgagcggcgtggtcggatacagacggacgcccagtgcccgcaaccgcgcgactgccggggcgatcaaggcggcgtccagcccgccttcggccaggtgcagccggaagccgcgggggccggcgagcgcaagccggcgaagcatgcgggcgaccagccgggcatcggcggccgcgggatcgatgttgagcgcggcgcggacaagcggtgccagcaccgcctgaccgagcttacgcgagagcaggccggggcgggccgtcccgagtgggccgttcacgcggccgtcgagcagaagaccggcaagggccagcagatcgcccgcaccgagccccaggctgcgcatcagctgcaccggactgccgagccggatcgcgtgccggccggtgatctcgccgccggggccatcaagggcgaccgcgggatagatggccggcagctcgcgaaaccgcccgcccaccctgcggacgaaatcgagcgcggccggattggcgccgagcaggacatgggtgccgttgtccaaccgatggccggtgaccgggtcgtagaaggaccggcagcggccgccggcctggggcgccgtctccagcaactcgaccgtcagcccggcttcggccagatcgagtgccgcggcgaggccggcaatgccggcgccggcaaccagcacgcgggtcgggcgcgggggacgagcgggcaaggcggtcagccgccgatccgggcgagcacggcgtggcgcagggctgcgcggactgcccgccgtttcagctgccggcgcagatccgggggcagggctgtgaagcgtcgcgcctccagcaccgccagcaggccgcgataggcatcggccatggccatggccgggcgcagacggcggcgcagatgcggatcatcgggcagggcggcatctgcggcagcaaaggcatcgcgggcagcacggccaagggcgcgtgcggcgggcaggcgtgctggcccttcggcgatgaccacgggtgccgcgcgcggatcggcaccggcggccatcagggcctctgccggcaggtagatccgcccgtggatcgcatcctcgtcgatgtcgcgcagaatgttggtcagctggagcgcccggcccagatgacgggcataggcccggcctgcagcctgggggacaccgaaggccaccagggcggcctcgccgacggcgccggccacgcgatcggcgtagcgcaacagatccgcccaggcaggggcaccgccgggatgatcgctgcaatcgctcaggcagccggcgacgatctgtcgaagggcgtcgaccggcagatgatggtggcggacggcatcgtcgagcagcgccgcatcgggcccggtcggcgcatggtcggcaccgagggccagcagatccgcatcgatcgcgtccagaagctgtcgccgccgggcggcgggtgcatggccgtcggcaatgtcgtcgaccagccggctgacggcatagagggcctgcatggccggtcggccatccgatggcatcaggcggatggccatcccgaagctgctgccggcggtctggctttcgggctccggcacccgcagggccgccaggccggcatcggcaagggcacctgcccagtcccggcggcgcggtcggatgcgccgggccagggggtcggtaccggtgaagcggcgacgatggcggcgggcaatgccgagcgtgagggcggcttgaatgcgcagccggcgcaccggtgtggtgagcagcggccgcgcccggtcgagcaggtcgtccaccgcttcgagcatccgcccgattgcggcgagcaggcgcggcggtgccgcaggcgcacccagcaccgcggcgccgagccccgcatcggtcagccagctgcccggtagccagacccggccggccgcgcgataatccgcccccagatcgcgaatgtggttcagcaattgaagggcgacggccagatcgtcgccggcctggcgacgggcgggatcctggtcgccggacaccgccatcaccacgcgggcgaccggcgcggccgaaagccggcaatggccgtcgagcgccgcccagtccgccggaacgaacccgtcgacatcgcggcgcgaggcttcggccagatcacgcagcggggtgatgtcgatgccggctcgtgcgaaggcggcggctgcctcggccgcaagccgccacaggtcgtgtgcagcagccggcatcgccgtcagccggggctgcccgtccccttccagaccatccatgaaggcggcaatggcggcgtgacggtcagccttcgacaggttgcggtcgtcggcgatgtcgtcgagccgccgtgctgcccggtagaaggcctgaaccgccgcccggcccggcccgggaggggcggccatccccagcacgggaaaatcctcgcgcccggcggccagcgcgcgcaccggcaggattacccggtcaggggcggcggaggccacggtcagacgggtagcgacggcggatgggcgtggatcggcatcagccgtcatcggcggcgggtctccggcagggaagggatccgggatgaggaaggtcgcgcgccttcagaatagcatcacgcggtttgcggtggagcccccgaagcctatatggtcggccaaaacccgccggagcatgcttcggcccccacgcccggcccggagagacggatgaccacggtttccgataccgaacgcgcagcggcattgacggcgagtgcggaagagctgacccggctggatccggatcgcttcgcctgcctgatgctggccgatccggagcggcgtgccgatctggtcgccctgctcggttttgctttcgagaccgcgaagaccgccgaggtggtgagcgaaaccatgatcggcgccatccgcctgcaatggtggcgcgaggtcctggacggaatcgaggccggcacgccgcggcgccatcaggtgatcgaccttctggccccggcgatcgcggcccatgatctgccgcgggaccggctggagcggatgatcgatgcccgcgaggcggatttcgaaccgacaccctttgccgacgccgccgcggtcgaagcctacgcccgcgacacggcgggacagctggcgcggctgcaggccagggtgctgggggtaaccgatggcgcgcggcttgatgcggccgaggcggtcggcaccggcttcggtctggcgggtgtgctcagggctctgccgcaccaggcgcgccgccgccgggtgctgttgccccgggaccggatggcggcggccgggctgggaaccggccaggtgatcgagccgcatctgcgcgatcaggcggtgacggccgcaattgcggccatcgtcgccgatctcgccgggcgtgccgcggcgctgatcgtcgatgcccgcaaggccggccgcctgccgcggcctgtggcggggcaggcggcgctcgcccgggtgcatctggcacggttggcacgggcgggtcatgatccattcacggccccggccgtgctcagcccggcacgccgggctttcaccctgctgcttgcccggcgctgagaccggcggatcggtcctcaggcggccgcgggccgggcatcggcccaggctgcgatgtcttcgagcgcccggcgggccatcacctgcttgcgctcattcttgcggatcttgccttcgagcggcgcaaacaggccgaaattcacgttcatcggctggaaggtttcggggttcgcagcgccggtgatatgggcgagcaaggcacccatggcagtggtggcgggcggcggcacgatctcctggcccagcgcctcggccgcggcgaagcggccggccagtagccccatggccgcgctttcgacatagccttcgacgccggtcacctggcctgcaaaccgcagatgcggggccgccttcagccgcatcaccccgtccagcacccgcgggctgttgatgaaggtgttgcggtggatgccgcccagccgggcgaattcggcgttctgcaggcccgggatcatccggaagatccggctctgttcgccgtatttcagcttggtctggaaaccgaccatgttccagagcgtgcccgaggcattgtcctggcgcagctggaccacggcatggggcgaacggccggtgcgcgggtcggtgaggccgaccggcttcatcgggccgaagcgcagggtctcgggcccgcgttccgccatcacctcgatcggcaggcagccttcgaaatagggcgtcgacttttcccagtccttgaagtcggtcttctcgccaccgatgatcgcggcaatgaaggcttcataggtctcgcggtcgagcggacagttgacgtaatcggcaccggtgccacccggtcccggcttgtcgtagcgcgactgcatccaggcgatgtcgaaatcgatgctgtcgcgatggacgatcggtgcaatcgcgtcgaagaaggcgaggctgtcctcgcccgtcgccgcccgcaccgcttccgcaagggcgggggatgtcagcgggccggtggcgacgatcgtccgcccccaatcggccggcggcaggccggtgacctcttcccgacggatctccagcagcggatgggcgcgcagccgctcttcgaccgcggccgaaaagccgtggcggtcgacggccagcgctccgcccgccggcacctgatgggcatcggcggccgccatgatcacgctgtcagcccgtcgcatttcggcatgcagcacgcccaccgcattcgaggtggcgtcgtcggaccggaaagaattcgaacagaccagttccgccagaccgtcggtcgcgtgggcctcggtctttctgaccgggcgcatctcgtgcaggatcaccggcacgcctgactgcagcagctgccaggcggcctcggaaccggcaagaccgccgcccacgacatggacgggagcgatgtgaaccggggcagaggtcttcacgggcaccaacctttcctgtggccgacggcggagacgagccgtcgccccaggacatattacagtcgggcccgaccctcaagcgggagccgcagcttgcggccctgcggtcagacccggcgcggtgcgcggctggcggattcgagagcggcgggtgcgctggcggcatgaaagccggcaaggccaagggccgccacgattaccgccacgtcatcggggcgggcggcatcggaggtgacgccgtcgcgcccggtgagggcgaacagcgcgccccccaccagaagggcggtcaccagaccggcgcgacgtcgcgcctcggccggcgcgatcatcggctgggtcagctcccgacgctgggcaccgcgcgagatcaggtcggcgatggtgtcggcaatcatcgccatgtcggccggggccggtgcctgggccggatgggcggcgtcgcccccgttcgcaggacgggcggcatcggtgagcagacggcgaccgatgcgggcgatcccctgggcggcggcatcgggtgccagcccggcaaggcccggggcgcggggatcactggcggcgagtatggcgggcaatgtatggacggagtccccgtggcgtgtggagcccgcatgttgcgcgcatgagtcgttcttcgccgccgatgctccgagcatgtggcaaaccccccggtctgtcccgatcatcacgttccgttaccggccggacgcgcagttctggtcgcgacgcgttccgtcctgtgcccacgctatgacaggacgccggtgacggcaagtcaccggcgttccacagtcaacattttttgcggaatcggtccatttgcgcccgttgggagtaggtgacaggtgcaaaatcggaggaaatctcgcaaatccggcgaaatttatggtgaaggccgatttaattgatccggcatctatctttcattcagctgaaatgatctggttgccgccgcgttttgcgtcttccatggcgagatgccggcccagatagtgtccggtatggctggcgggattgtggatcacatcctcgggcgtgccttctgccacgatgcgcccaccgccggacccgccctccggacccatatcgatcagccagtccgcggtcttgatgacatccagattgtgctcgatgaccaccacggtgttgccctgatcgaccagggtatggaggacttcgagcagtttgcgcacgtcgtcgaagtgcagaccggtcgtcggctcgtccaggatgtagagtgtccgtccggtcgcccgacgcgacagctctttggcgagcttcacacgttgagcctcaccgcccgagagggtggtggcggattgtccgagacggatataaccgagaccgacctcggcgatggtgcgaagcttctcgcggatcgacggcatggcctggaagaagtccagcccctcgtcgacggtcatgtcgagcacgtcggcgatcgacttgcccttgaactgaacctcgagcgtctcgcggttgtagcgcttgcccttgcaggcgtcgcactggacatagacgtcgggcaggaagtgcatctcgatccggatcacgccatcgccttggcaggcctcgcagcgcccgcccttgacgttgaacgagaagcggcccggtttgtagccgcgcgcctttgcctcgggcaggccggcgaaccagtcgcggatctgggtgaacagaccgacataggtcgccgggttcgaccggggggtgcggccgatcggcgactggtcgatgttgatgatcttgtcgatatgctccagcccgtcgatgcggtcgtgctggcccggatgggtgcgggcgccgttcaggcggcgggcgatggcctggtagagcgtttcgatgaccagcgtcgacttgccgccgcccgaaacgccggtgacgcaggtgaaggtgccgagggggaagcttgcggtgacgtcgtggaggttgttggaacgggcgccgaccagggtgatgctctcgcccgtgcccttgcgccgctcctccggtaccgggatcagcttcgcgccagtgagatagcggccggtgagcgacgccggattggccatgatctcggccggggtgccttccgccaccaccttgccgccatgctcgcccgccccggggcccatatcgatgacatggtcggcggcgcggatcgcatcctcgtcatgctccaccaccagcaccgaattgcccagatcgcgcagatccttcagcgccgccaacagccggtcgttgtcgcgctgatgcaggccgatcgagggttcgtcgagcacatagagcacgccggtcaggcgcgagccgatctgcgaggccaggcggatgcgctggctttcaccacccgagagcgagccggagccgcgggcgagggtgagatagtccagccccacttcggtgaggaagcgaagccgctcgttgatctccttcaggatccgctgggcgatctcctggcgcttggcatccagacggccgtcgagggcgccgaaccaggatcgtgcttcgccgatcgacagggcggtgacctctgagatgttcttcatgtcgatcttgaccgcgagcgccgtatccttcaggcgctggccgccgcaggtctcgcagggacggttgccctggaagcgtgacagctcctcgcggatgaaggcactgtcggtctcgcgccagcgccgttccagattggggatcacgccttcgaacggccggtcgacggtgtagttgcgcgcaccgtcttcgtagcgaatcttgatagcctcttcgccgctgccgaacaggatggcctggcggacccggtcgggcagtttctcccaagactgggtcagcgtcaccttgtaatgcgcggcgatgccggcgagcgtctgattgtagaactgggttgtcgacttggcccagggcgcgatcgcgccgtctcgcagacccagtgacgggtccggcaccaccagttcgggatcgaaatggctcttcacccccagcccgtcacaatccgggcaggcaccataggggttgttgaagctgaacagccggggctcgatctcgtcgatggtgaagccggagaccgggcaggcgaagcgggccgagaaggtcgtgcgatcaccggtatcggcgttctcggcgatcatgatgccgtcggccaggtcgagcgcggtttcgacgctgtcggccagccggttgcccagcccctcgcggatgacgatgcggtcgaccaccacctcgatatcgtgcttgcgcttcttgtcgagcgcgggcgcgtcctcgatctcgtggatctcgccgtcgatcttcacccgggtgaagccgcgcttcatcagctcggccagttccttgcggtactcgcccttgcggccgcgcaccacgggggcgagcagcagcaggcggctgccgtcgcccatctccatcatccggtcgaccatctggctgaccgtctgactttcgatcggcaggccggtggccggagaataggggatgccgacccgcgcccagagcaggcgcatatagtcgtagatttcggtgaccgtgcccaccgtcgagcgcgggttgcgcgaagtggtcttctgctcgatcgaaatggcgggtgacaggccgtcgatgcgctcgacgtccggcttctgcatcagctcaaggaactgacgggcataggcggacaggctttcgacatagcgacgctgaccttcggcatagatggtgtcgaaggccagcgacgacttgccggagccgctgaggccggtgatgaccaccagccggtcgcgcggaatatcgacgtcgacgtccttgagattatgttcccgcgccccgcggacgctgatcagtctggtcgtgtcgcgcatctgatcccgcaccatgtgcctcgccggccggatgtcgttccagcgccccgcgctgcagggcagcacacgaacaaatagtgcacggatgcctgatcgtcacgtggcaaatcatgtcaggaggcccggtatattcgccgcagcgggggcggcagccatgcgctgacggcatggctgcgccgggatgtggcgtatcagggccgcggctcaggcctcgcggatatggcggatgaaggcgccgacgcgggcggtcagctgctggccttcctcgacgagcgccgtcgaggtgtcgagcacccgccgcgccatgaccccggtatcctcggcgctccgcgagacacggccgatctcggtgctgacccggtccgccccggccgccgcctggccgatcgaggcggcgatttcgctggtggcgctgcgctggcggtcgaccgcgcccgagataccctccaccacctgactgatccggtcgatggtcgcaccgaccgtgctgatcgtggtggcggcttcgcttgcgaccgtccggatctgggcgatgcgtgcatcgatatcggcggtggcgcggctggtctgggtggcgaggctcttcacttcggaggccacgaccgcgaagccttttccggcctcgccggcacgggcagcctcgatcgtcgcgttgagggcgagaagattggtctgttccgcgatgtcgctgatcaggcggacgacttcgccgatctggttggcggcctccaccagcccggtcacggtgtggttcgagcggcgggcttcacccaccgcctcggtggtgatggtcgaaccttccgccacctggcggaggatgtcgctgatcgcggcgctcagctgttcggtagaccctgccacggtctggacgctgcgggcggtttcaccggccgagccggcgacgccggaactggtctcgcgggcctgatcgacaccggcactcatggcgcgcgcggtctcgcgcatctgttccgaagattggcgcacggcggcgaccacttcgccgatagagcgctcgaaatcggcggcgaggcggtccattgcggcggctttctcggcctccgcctgaaggcgctgggtctcgttgacctcgcgcaggcgctcggtttcggccatgccgtcgcggaagaccagcagcgcgcgcgccatctcgcccaattcatcgcgccggtcgagcccgcccagctcgaccgaggtgcggcctccggccaggtcgcgcatggcgccgatcgcacgggcgagcgggcgggcaagcagggtgcgcaggcccagggtcagggcgatcatgagcgccagcatggccactgcggtcagaagggcgctctgccgcagggcggtcgcggtcgctgcctcgacctccgccagcgaccaggcggcggcaacggcaccgaccagtttctggtccttgccggcgaagaccgggcgcaccaccagcgtggccgccgatgtctcttcatcataggcctcgcctcgatcgagggccgcggcggcgcggccgtgaagggcggcgagatcggctgccgtcaggcgcggatcatccacggcgacgatctggctgccgtcgagcgagaaggcggcgaaggaggcgaggcggttgccgtcgcgctccatcagcgggccgacgatcgcctggataccggccgccttagcatattgcacaccgcccgacacctggcccgcaagcatgtcggtgagcgtacggtcggaccggccgaaggcatcagagagcgcgtcggcccggctgagggcttcacgaaggccgatcgcggtgagaaccatgccgaccatgatgacggtcatgatcgtgatgcgcagatgcagtttcaccgggcggcggcggagctttggggacatgtttcgggcctccgtctgggcaaaaaaggcgtctgggcaaggggcatccggccggccgcgatccggggaagatcgcggccgtcggcaggcgcgggagaatgggcagatgcggttccggagcggcgtcggccctcagagattgccgagcgcctcggcatcgaggccgagggtaagggccccgatcggcttgccgctgtcggggtcgatcaccggctcgctgagctggatgatgtaagtctggctgctgtcgtcgaaatcgacgtcagagacatggcgggcgcccggccccttgaggaaggtctcctgccatttcggctcgtcgccctgccagtagtccgaggtcgtgtcgctcataccgacattcaggcctcggttgtccatgacgaaggcctcggtgatcaatccctccgagccttccttggccttgtggagaatggccgaggccggattggcggcaacagccgagatggtgggcgtgctggcggtaccgacctctgcgcgccaggccttgtcccgggcgaggatatcggcctcggtcagcccggcattggccgtgttctgcgcccggatcgcggcgatgatcccgggatcggtcgtgagctggtgcatcaggccggcatcgaccttggcaagccccgcctccagttcgggcggcggcccttcggcacgcaccggcagggcaaggcagagtgctgcgagggcgatgccggcggcgagaccggccttcatcatcagcggcagcggggcacgcacggcggcggtgcgggcgggcacgcggcgatgggaacggggagggatgacggtacggggcatggggacaatcccttcttcgaccggcttaggtggggatcatcctgccctgaaaaccttatcaattcttttaagtgcgccagaaaatcgatcgatgttcgagaaaaacggcgacctgaaccgtataggattcgcgcaacggttcaggtgccttgcatatatcaggtcactggtcgatgggttccaggccgcaccattcggcgatgaaaagagcgatggcgccggtgacgcgttctatggaggcgatggagacccgctcgtcgaaaccgtgaatgcccgccgtgacggggccgtagacgaggcagggacaatcgccgtagagcacgaagacccggccgtccagatagctgggggtcacgaagctctccaacccgcggccgaaggcgcgggcatgcgcgcgccccagggtcttctcggcatcactgccttcttccagcacatagccttcgacgaagaacccgttgtagtcgatctcgggcgggttgttggccaggaaggcgtcgcccttggcggcttccgacaggcaggcctcgatttcggcggcggcatcgcggggatcgacgcccggatagatcgaaatccggcagtcgaatgtgcaccaggccgggactgaagatgcccaatctccgccttcgattttgccgaaattgaggttgatcgggtgatccagctcttcgaaatagcgatgcgcggccttgcgcgcgttccagtcggcttccagccggcgcagggcctgcatcagccggtaggcggcttcgatggcattggcgcccgatcccgcttcgcggacatggacgggaatgccgcgcacggtgaccttgaaccagatcacgccgacattggcgcgaaccagcatctcgtcttcgggttcggggatgatcgcggcatcggcgcgatagccgcgcaccaggcaggcgagggcgccattgccggtgcattcctcttccgtcaccgactggacatggacggtggcggccggctgatagcccagacgccggagggcatccatggcgaagacattggcggcgatgcccgccttcatgtcgcccgatccgcggccatagagccagtcgccctcgatcaccggctcgtagggcgggttggtccacatgtcgtgcggcccttcgggcacgacgtcgatatggccgttcaggatcagcgagcggccggtctcgtcgcgcggccggtgggtgccgacgacgttgagggcgttctgataatcgaccttcaccggcgagaagcccgggtgatggcagatctcgtcgacatcgattgcccagcggtcgacggcatagccgcggtcgcggagggtcttcgccatgaagtcctgggcggtgtgctcgcgaccgcgcagtgacggcaggcggatcagatcctgggtgaaggcgatctgctctgcaatgccctgtttcaccgaggcgaggatcgcctcggccagagcggggtcgagccgcgagccgtccgggcgggccccggcgggtgcggaggatgcaggtgtgatggtatcggtcatctgaggtccggcctcccttggtcttatgcctctgatgtcgagcgtaaaaggccggtttgcttcgataaatatcgatgtgataaatctcgtttcgatgaatatcaaaggaagcggatcatggccctgcccagcctctcgacggtggatctgaagctcctgggcgtcttcctggcggtggtgaaggcgggcggcttcgcgccggcccaggccgcgctcaacgttgccgcgtcgacgatcagcatccagatcggcacgctggaaaagcggctgggggtcgtgttgtgccggcgggggcgcggcggtttcgcgctcaccgaggacggccggcgtgtgcacgaggcggcgcaggcgctgtttgcccagatcgaggattttcaggcccggatcggcggcttgggcggaggcatgaccggcaggctgaaccttgcggtgatggagaatctgatcacccacccgagtttcagcctgagcgcgctgatcgcacgcttcagggacggcgccccgggtgtccgggtcagcatcgacacggcctcaccggcacggctggaggaaatggtactgggcggggctgcgcatctggcgatcggctatttcccgcgccggcttgcccagttcacctatgccccggcctgcgaggtggtgatggaactctgcgccggggcggggcatccgctgttcgatgtggcggaaccgacgcccgacatggtccgggccgccgaacatgcccatcgcggctatgtctcgaccgagcagacccctgacgcccatcgcggcttcgtgttcacggccgaggcacagagcgtcgaggccctggcgatccttgtgctgtcagggcgttatctggccttcctgcccacacacttcacccggcggcccggctatgccgggcgcatccggccgatcctgcccgaacgctatgcctatcggtcatcgatcgagatcgtgcgtaaccgcgcggcaccggtgacggcgccgacggcgcggttcatggagctggtggccgcctctcaatgaccgccgccgcggcggcgaatggccccttcggcccgacgttcgacgatcagcttggccaggatggtgaccagggcgagcacggtgagggtggaggcggccgcaaaggcgccgatggcattgtagtcgttatagagcagctcgacctggagcggcagcgtgttggtctgtccgcggatattgcccgagaccaccgagacggccccgaattcacccatcacccgcgcattgcagaggattgcgccgtagagcagcgcccatttcacattgggcagggtgacgcgcaggaaggtcttgagacccgaggcgccaagggtgatggcggcctcttcctcgtcggtgccctgggcctgcatcagtggcaccagttcgcgggcgacgaaggggctggtgacaaacaggctgaccaggaagatggccgggatggtgaacatcacctggatgccggcggcgtcgagcgtcggccccagcaggccctgggcgccgtagacgaagagataggcgacaccggcgacgatcggcgagatcgagaagggaagctcgatcacggtcatcagcagcttgcgtccggggaaggtgaatttggcgatcgcccaggcggcggcgaggccgaagccgatattgatcggaaccaccacgatcgccgtcaggatggtcagcccgatcgcatgcagcgtgtcgggggcgacgacattcgaggcccagccctcgatgccggcggcaaaggcctgggcgaagatcaccgccagcggcaccaccagaaacagggcggagatgccgagggcaagggtgatgagcaggatgcgcagccagccttcgcccgccactcccttccaggcttcgggggtgcggctgctctgatggcggttcgcggtcgaggggatatcggtcatcgtcctgtcctcatcctgtccttgtcatccccggcctgaatggcgggcggcccagaattgcaggatgttgatcagcagcagcatcacgaaggcgcagaccaggatcatggtcgcgatggcggctgccgccggatagtcgaactcttccagacggatgaaggtcagcagggcagtgatttcggtctggaaggggcggttgccggcaatgaagatcacgccgccgaactcgcccaggctgcgggcgaaggcgagtgcggcacctgccaggaaggcgggcaggatcgccggcatgatcacgcgcaggaagatcgcccgatcgggggcgcccagtgaatgggcggcctcttccgcttcgcgcgacaggtcttccagaaccggctgaaccgtgcgcaccacgaagggaatgctggtaaaggccatggcgacggcgatgccgagcggggtgtatgcgaccttgatgcccagatccttgagcggcgcgccgagccagccggtcggggcgagcagattggcaagcgcgatgccggccacggcggtgggcagggcgaagggcaaatcgaccagagcgtcgagcacccggcggccggggaagcggtagcgcaccagcacccaggcgagcagcaggccgaagatggcattgaagacggtggcgccggcggcggcgcccagcgtcacctgataggtggccaccgcccgccgcgaggtcacgatcgcccagaactccgccggtcccaggctcgcggatttgagcaccagggcgaagatcggcagcgcgatgatgattgcggtgtagaacagcgtgatgccgagcgtcaggccgaagcccggcagcacgccgcgggaacgcgagagagcggtggccatggccggatcagcggctctgtgccgcgaagagctggtcgagcttgccgccctcggcgaaatgctcggcctggatcttgtcccagccgccaaagacgtcttcgacgcgcaccagcttcagctcggggaactggccggcatagtttgcggcgatctcggggtcgacgacccggttgtagcgcttcgccgcgatctcctgaacctgcttgccgtagaggaagttcagatagccttcggccgccttgcggctgccccgctcgtcgacgaccttgtcgaccacggcaaccgggaattcggccaccaggctctgcgacggcgtcacgacctcgtaatcgtcctcgccatattccttgcggatcaggttggtctcggcttcgaaggtgatcagcacatcgccgataccgcgctcgacgaaggtggtggtggcaccgcgtccgccggtatcgaacaccgcaacatggccgaagatctgcgagacgaattcgtccgtcttcgcaacgtcgcccttgaaggcgtccagaccataggcataggcggccaggtaagtatagcgcgcattgcccgaggtcttggggttcgggaagacgatctccaccccgtcgcggaccagatcagaccagtccttgatgttcttggggttgcccttgcgcaccaggaaagacggcatcgaataccagggtgaggcgttgttcggcagttccgactgccagcccggctgaatcaggccgccatgcttcaccaggaaatcgatgtcggtgacctgattgaaggtcacgacatccgccttcagcccttcgaggatcgcccgggcctggcgcgaggtgccggcatgggactgattcacctcgatcgagcgaccggtttcggccttccaggccggcacgaagctctcgttgatctcggcgaacagctcgcgcgcgatgtcgtaagacgcattgaggagggtgtcgtcggcggcccgcgccggcgcgccggcggcgaggccgagcgcgagggcggcggcaaaagcgaggcgcttcatctggcaggctccaggaaggcggggatgggaagctcgcgggccggtgtgctgcgcaggccgtgcggcgtgccctcaggccggttgccttcggacatattttccccacgcacgcagcccatccgggatgtgtgacgagaatgtgcatccacagccgtggatgtcaacaattaaacacggacatgatgttttatgagttatttcacaaaatattttagtttattccatcagctctccggcaaggctgcgggcgagggcggcgacctggttgcggatgtcgggtacggcggtgctttcccagaacacgcccttggtgagcggccccagagcggcgagccggcgatttgccatgccgtcggccgagatgacccgcagatccgtatcgacatcaaggccgagcgccagcgcgtcggcccggatggcgccacgggcgaacaggcccgccagcaggggctcgggcgtgcaggcgagatcggaaccggggcccgtgcagtcgatggcgcgggcggccaggatgcgttccaccgccccgccgccccgcgggatcaggtcgaaggcgacccggtcgggcgtcacatgacgggcgcggatgcgcatggcccggatcagcagctggccccgggcgcgcgcatcggcgatgcggtccgcgacatccggcgccatgcgatggcgatgactgtcccaccaggggcggagatggcgcaggaagcggcgcttctcttcggcggccagcccctgccagagcggctgtgtcatgggccgcagcccgtcgatcaccgcccgccagccgcccccatggccgcgggtcgacagatcggcttctgccgcccgcacggcctgacgcacggtcctcaccagggcgctgagccggccgggggcggtgtccggcgtgagtgatgggatcggggccggcaccggtgcatgcgcacggggcagcagtccgcggcgagagatggcatggatggtaccgcgatggccgcgatccagcaggctgatcacgacgtcgaccgcagtgaggccggtgccgaccaggatgacatcggcctcgcgatccagcccgtcgagggcgttcggcgcccatggatccggcgcataggcggggccggcgggcacatcgcagccgggcggaaaattgccgagcgccagcacggcagcatcgacccgatagcttcgaccgccatcgacctgcatcgcgaaaccaccgccctccaccgcgtccagacgcacggcggcatcatggatcagctgcagattcatggccttgccctggcgccagatccggtcgccgatcagatcctgaatgtaggagccataaatccgccgcggcacgaagctgtcgcgcccggccgggccgtcgggcaggaaggcggtgagggtgctgcggttcgcctccagccactggacgaaatggcccggctggtcggggaaggcgctcatattgccggcccggacgttgagcaggtggtgcggattgccggtggcataggcgacgccgcggccgaactggctgttccgctcgaccagcaggatcctgtccgtccgccggcagcggtccagcaggtgtacggcaagcagggctccgctgaaaccggccccgatgatcgcaatggtggtgccgcgttcgctcatgcgcaggatccccggcagttgagatgcaggctcagcctagcgcgtggcggccggtcccgtcatccggcatggatttcctccttccctcggatgcccttcctgtcgcaggatgcggccaattcgcgggcgcccccttgtcggtgcggcgcctccaaccgttaggtcgagggaagacagagccatggctggcagcgtcaacaaggtgatcctgatcggcaatctgggccgggacccggaggtgcgcagcacccaggacggcatgaagatcgtgaaccttgcggtcgcgaccagcgagacctggcgggaccgccagagcggcgagcgccgcgagcggaccgagtggcaccgcgtggtgatcttcaacgagcgcctggccgaagtggcggaaaagttcctgcgcaagggctcgaaggtctatgtcgaaggggcgcttcagacccgcaaatggaccgatcagcagggccaggagaagtacaccaccgaggtggtgctgcagcggttccgcggtgaactgaccatgctcgacggccgcggcgaaggtggcggtggcgccgaattcggcggcggcgacgatttcggcggcggggcgggcggcggcttcggtggcggccagggcggcggcggtcgccggggtggcggtggcggctatggtggcggacgcggcggccagggtggcggcacgggcggtggccagggcggcggcttcggcggcggctatgacgattacggatcggattacggcggcggctcgtccggcggcggccgcggcggcgccggtggcggcggtggctcgaacgatctggatgacgaaattccgttctgagcggcgccagatcgacagaccgacatgaagagcccggctgatgcgacacgcatcagccgggctttttgcgttcaggtgcgggtatcagccaggtgcggggatcagcggtcgacataccccatctcgcgctcaccgtagcgcgggccggcggtgatgcccggcggcagggctgcgtcgaggcgggcggtctcttctgccgtgagcgccaggtccagggccgcccagttgtcttccagatggctgcggcggcgggtgccgggaatggggatcacgtcgtcgccccggccgagcagccaggcgagtgcgacacggcccggagtgacgccgcgttcggtcgcgatctcgcgcaccgtcgcggcggccgccatgttggcatcgtaattggcgccgatcagtcgcgggtcggtgcgacggcgatcgccttcgggatagtcttcggcccgggtgacgctaccggtcaggaagccgcggccgagcggcgcgaagggcaccagggcgatacccagccggcgcagggtcgggatgattccggcttcaaggtcacgctcccaaagcgagtattcgctctgcagggctgcaaccggcagcacggaatgggcccgggcgatggtcgtggccgaggcttccgagagaccgaaatgcagcaccttgccggccttcaccagatcggccacggtgccggccacctcctcgatcggcacggccggatcgacgcggtgctgatagagcaggtcgatgcggtcggtgccgaggcgcgagagcgagccttccaccgcctggacgatccgctccggccggctgtcgacgccgatgctgcggcccccctcgatcttccagccgaatttggtggcgatgacgaccctgtcccgcagcggaccggtggagtcgctgccggcgagggcgcgaccgatcaggctttcgttgaggaacggtccgtaaacttccgctgtgtcgaggaaactgcagccgatctcgatggcgcgatggatggtggcgatcgattctgcatcatcggtggcgccataggactggctcatccccatgcagccgaggccgagggcggagaccatcgggccagtgctgccgaggcgtcttgtctgggtcatctccggacgtcctgcatcttgtttggcggggagatcgggtccccgcggcggcgttcaggggcaacagcatgcgcctcgggccggggcttggccagcctccggcgttgtgcaatcccggacgcgcgaccatattccgcccaggaccagccgccaccggagggccgctcatggccgacgacaccaatgatccgctgcgcctcgacgcgcagctctgctttgcgctctatggcgcatcgctggccatgaccaaactctatcgtccggtgcttgaagggctggggctgacctatccgcaatatctggcgatgctggttctgtgggagagcgacgatatcacggtcggtgatctggggcgcaggctgggactcgattccggcacgctcacgccgctgttgaaacggctggaggccgcaggactggtgacacgacgtcgcgacccgcgcgacgagcgccaggtgcgggtggccctgaccgaggcgggcagggcgctgaaggcgcgggcgcgccacgtgccggagcagatgttctgcgccatgggactggaactcgacgagctgggcgatctccgccggcgcctgcacacccttcaggcgcggctgagcgatgccgccgccgaacccgacagcggcagctgaaggcagaccatggatgcgatgtcatgttttttaaattgcatacaattaaattgatgccaatatgaaactcgaaacgacgacatgaccggcaccggagagggccggccgagccaaggagacaggccatgcagatcctctacaccgccaatgccaccgccaccggcggccgtgacggccgcgccgccagtgacgacggccatatcgacctgccgctcgccatgccggccgccctcggcggcaacggcaagggcaccaacccggaacagctgttcgccgccggttacgccgcctgcttcctgtcggcgctgaagctcgtcgccggccagaagggcgtgaagctgggcaatgacgcccaggtcgcggccgcggtgtcgatcggcaaggacgagaccagcttcggcctggccgtgacgctgaccgccagcctgcccggtatcgatgccgctgcggcgcacgcgctggtcgaagccgcgcatcaggtgtgcccctattccaaggcaacccgcggcaatgtcgaggttgatctgaaggtcgcctgaggcttccggggcccctgcatccgcccggaatgcaggggccggccggcgtggttgttcggcggcgcaaaattgggtagcttcggggacgatttcacgaccggccggtgacgcacggatctccgagcggcccggccgatgcgtgtaagccttcgactgatcgcccgccgacgccgcgcccccgcgtttcgacggcaggcgtcgcccccttttccggcgccgtccatcgatgacggcaccggttcaagttccgggatcgtaccttgtccgacacgcccgttccgcccatcgcttccgacatcgctccggtcacgatcgaagacgagatgcggcgctcgtacctcgattacgcgatgagcgtgatcgtggcgcgtgcgctccccgacgtccgcgacggcctgaagcccgtgcaccggcggatcctgttctcgatgcacgagagcggctacgagtggaacaagccgttccgcaaatcggcacgcgtggtcggcgacgtcatgggtaagtatcacccgcatggcgacagcgcgatctatgacaccatggtccgcatggcgcaggacttttcgatgcgcctgaggctgatcgacggccagggcaatttcggctccatggacggcgaccccccggcggccatgcgttataccgaggcccgcctgaccaaggccgccagcaccctcctgtcggatctcgacaaggagacggtggacttccagaacaattacgacgacacgacccgtgagccgacggttctgcccgcccggttcccgaacctgctcgtcaacggtgcgggcggcatcgccgtcggcatggcgacgaacatcccgactcataatctgggcgaggtgatcgacgccgccatcgcgatggtcaaccggcccgagatcaccgatctggagctgctgcggatcgtgcccggcccggacttcccgaccggcggcatcatcgtcggccgcggcggcagccgcgaggccctgctgaccggccgcgggtcggtgctgctgcgcggcaaggtcgaggtggaggagatccgcaaggatcgcatggcgatcatcgttcgcgagatcccctatcaggtcaacaaggcccggatgatcgagcgcatcgccgaagcggtgcgggagcgcaagatcgagggcgtggcggatctgcgcgacgaaagcgatcgcgacggcgtccgcgtggtggtggaactgaagcgcgatgcgactcccgaggtggtggtcaaccagctctatcgcttcaccccgctgcagacatcgttcggcgtgaatatgctggcgctgaatgccggcaagccggaaatgatgacgctccgcgacatgctccaggcctttctggagttccgcgaagaggtcatcacccgccggacgatctatgagctgcgcaaggcgcgcgagcgggcccatgtgttgatgggcctgggcgtggcggtcgtgaacctggacccggtggtcgagctgatcaaggcctcgcccgacagtgcgtccgcgcgcgatgccctgatggaccggccctggccggccggcgacatcgccccctatatcgcgctggtgggcgagcccgaccggagcgtggtcgacggcatgtaccgcctgtcggaagcccaggcccgcgccatcctggatctgcgcctgcatcgcctgaccgggctggagcgcgagcgcatcggtgccgagctgcgcgagatctgcgacaagatcctggaatatctccgcatcctgaatgatcgcgcccgcatgctcgaggtgctgcgcgaggagctgatcgaggtccgcgacgaattcgcgacgccgcggcgcaccgtgatcgaggaatcggagttcgactacaatgtcgaggatctgatcgagcgcgaggagatggtcgtcacggtcacccatggcggctatatcaagcgcgtgccgctgtcgacctatcgcgcccagcgccgcggcggcaagggccggtcttcgatggccgtgcgtgacgaggatttcgtctcgcagatcttcgtgctcaacagccatgcggccgtgctgttcttctccaccgccggccaggtctataagctgaaggtctggcagctgccggctgggacgccgcaaagtcgcggcaaggccatggtcaacctgctgccgctgaaggaaggcgaggtcatcgccaccctgatgccgctgcccgatgatccggacatgcccgagatcgccgaggtcgatgaggctgcggccgatgaggcggcggaagaggcggccgaggcgctggatgccatcgccgacggcgacgcctatgtgatgttcgcgaccgccaagggcaatgtccgccgcaaccgtctcgccgatttcgtcaatgtgatgagcaatggcaagatcgccatccggctgggcgagggcgaccgtctggtcggcgtgctgccgtgcaatggcggtgacgacgtggtgctcgccagccgggccggcaaggcgatccgcttccccgtgggggccgtgcggctgttcaagagccgcacctccgatggcgtgcgcggcatctctctggccggcagcgacgaggtcgtgtcgatgtcgatcatccgccaccgcgaggtggacgtcgacacccgcgacaattacctgcgcttcgccaatgccaagcgccgctggctggcgcagttgaaggcgctggagaccggtacttcggcggtggtggacggcgaagaggcggcaccggtcgagaccggtgacctgcccggggacgaggccgaactcgcggcccgctacgggctcgacctcgagaccgcccagcggctggaggccgaggaggagttcctgctggtcgtcaccacccgcggctatggcaagcgcacctcggcctatgaataccgcaccaccaatcgcggcgggtcgggcatcgtcaacatgaccaccggagcgcgtaacggccacatcgtggcctgtttcccggtggcgcagggcgagcagatcatgctggtgaccgatggtggccagctgatccggacgccggtggcggatatccgcatcgccggccgcgacaccatgggcgtgatcgtgttcaagaccgcccaggacgaaaaggtcgtctcggccgcccggctgagcgagaccgcggaagaagatcagaacggcgccggcgaggccaatggcgatggcgaggccggcgacgagggggagcaggacgcgacggagacgaccgatcttcgcggagacgaagacgaggcgtaagccggcgcgggtggagacccagtggaggaccaggcattgagcggcaagggcatctatccggggacgttcgacccggtgaccaacgggcatatggacatcatccgacgcagcctgagggtggtggacaagctcgtggtggccgtggcggccaaccccggcaagggaccgatgttttcgctggaagagcgggtgagccttgtgctcgccgaactccagaccctgccgccggatcaggcagcccgggtcgaggtgaaatccttcgacaccctgctgatgcattttgcggtggagcagggggccggcgtgatcatgcgtggcctgcgcgccgtttcggacttcgagtacgaattccagatggcgggcatgaatgcccggctgaacacccaggtcgaaaccgtcttcctgatggcgtccgaaaaggtgcagttcatctcctcgcgcttcgtgaaagagatcggccggctgggtggcgacatctcgcagtttgtcagcccgcaggtgaagaagatcctcgatgtccggttcgaggaagaacgaaacggccttcgtccgctggactgagttgccgccagacccgatgaatatcgcgggacggtgtccgccagggcggtcaccgtcccgcgccgttctaagctatatcaaccctttgcatcggttacttcagcttcgatgaaagtcgacctgttcgatttcgatctgccgcgcgagctgatcgcccagcgcccggccgagccccgtgaaagcgcccgtctgcttcggatcaaggcggacgggttgtcggatcatcgtgtcgccgatctgccggatcttcttcgccccgacgatctgctggtggtcaacgacacgcgggtgattccctccaggctgttcggccggcgcggtgaggccaaggtcgaggtgaccctgcacaaggccgaggggctggacgtgtgggcagccttcgcacgcccggcccgtaagcttcgcctgggcgaccgtttcgaggcggaggccggcgggcgggtgctgggagccgaggtcatcgaacggcgcgatgcgggcgaggtggtgctgcgctttgatctggccggtggcgagctgatccaggcgctggaagaggtcggccgcctgccgctgcccccctatatcgaacggccggaaggcgccgatgcccgcgacaccgacgactatcagacgatattcgcccgtgataagggagcggttgccgcacccaccgcggggctgcatttcaccgaccgactgcttgcagcgcttgatgcccggggcatcgagcgactggcgttgacgctgcatgtcggtgccggcacgttcctgccggtgaaggccgaggatacggtcgaccaccatatgcatgccgaatggggccggctgacggcagagacggccgaccggctgaatgcggcacgtgccgccggccggcgcatcatcgccgtcggcaccacagccatgcgtctgctggagacggcggccggcgaggatcgcaggttccggccgttcgagggcgagacccggatcttcatcacccccggcgggcggccgacccgcggcaccgacgtgctgatgaccaatttccacctgccgcgctccaccctgttcatgctcgtctcggcctttgccgggctgaaccggatgcacgcggcctatgcccatgccatcgcaggcggctatcgcttcttttcctatggtgacgcctgcctgatcgaccattgtccggacgacgtcgcatcatgaccacgaccccgcacgaccagaacccgacccgcgccatcgcgggcgagggggccgaaccccgcttcggttacacgctgatggccgaggacggcatggcccggcgcggccggatcgtcacggcccacggcgccatcgacacgccggccttcatgccggtcggcacggccgggaccgtgaagggcctgacgcccgaacaggtggcggcgaccggggcacagatcctgctgggcaacacctatcacctgatgctgcgcccgggggccgagcgggtcgaccgcctgggcgggttgcaccgcttcatgaactggccggcgccgattctgaccgacagcggcgggtttcaggtcatgtcgctggcggcgctgcgcaagctggatgatgacggcgtcaccttccgctcgcatctggacggcagcaagatccggctgacgccggagcggtcgatcgagatccagcgcctgctggatgccacgatcaccatgtgcttcgacgaatgcacgccttatcctgcgacctatgaccaggccgcaagctcgatgcggctgtcgatgcgttgggcggaacgctgccgcaccgcttttaccgaccggcccggctacgcgctgttcggcatcgtccagggcggggttcatggcgatctgcgcgccgaaagcgtggaacggctgacggagatcggcttcgaggggtacgccgtgggcgggcttgcggtgggcgaggggttcgagctgatgtgctccaccctcgacgtcaccacaccgctgatgccccgggacaagccgcgctatctgatgggcgtgggccgtccgcaggatctggtggcggcggtccggcgcggcatcgacatgttcgactgcgtgatgccgacccgctccggccggaccggccaggcattcacccgccggggcccggtcaatatccgcaatgcccgccatgccgacgacccgcggccgctggatgatcgctgcggttgcccggcctgcacgcagtattcccgcgcctatctgcaccatctgcacaagtcgagcgagattctgggtgcggtgctgctgacccagcacaatctttggtattatcaggatctcatgcgtgggatgcgcgccgccatccctgaaggccggatggaggcctttgcggcggaattcgaggccggcctcgccgagggggacattccgccgctctgatattatcccccgggcgaaggtggccggcctccctggtcagcccttgaggtcggggaagtcttcttcgcggaactcgacgccgccgcggctttcgggtgcctcgcccgcattctcgccgcggcggagttcgacccggcggatcttgcccgaaatcgtcttgggcaggtcctcggtgaactcgatgcggcggatgcgcttgaagggtgccacccggctgcggacataggccagaatgtcccgcgccgtctcagcatcgggctcgaagcccttgatcagggagatataggccttcggcacggccaggcggaccgggtccggtgcgggaaccaccgccgcctcggccacggcgtcatgttcgatcagcacgctctcaagttcgaaggggctgatccggtagtccgacgccttgaagacgtcgtcggcgcgcccgacgaaggtaaaatagccgtcatcatcacggatggcgacgtcaccggtgcggtagaattcgcctgaggtggcgagcagggccttgccctcggcggcttcgtagccgcgcatcaggcttgccggacggcgatcgcccaaggcgagtgcgatctcgccctcctcgacctggttgccgtcggcatcgagcagggttgcgacatagcccggcagcggccgccccatggagccggttttgatcggctggccgggcgggttgccgaactgggcgctggtttcggtctggccatagccgtcgcggatggtcagaccccaggcctcctgaacctgctcgatgatctcggggttcagcggctcacccgcgccacagacctcgcgcaggctggtgcggatcgacttcagatcctgctggatgaacattcgccacacggtcggcggggcgcagagggtggtcacgccaccccgtgcaatggcatcgagcaggctggcagcctcgaagcgcggctgattggcgatgaagatggtggcgccggcgatccagggggcgaagaagcagctccaggcatgcttcgcccagccgggcgacgagatgttcagatgcacatcgccgggctgcagccccagccagtacattgtggaaagatggccgatcggatagctggcatgggtgtggatcaccagcttgggcttggccgtggtgcccgaggtgaaatagagcagcagctcatcttcggcccgggtctcgccatccggggtgaagccatgagcgaagcggggatcttcatgcgcatctgcgaagtcggtccagcccggcgcgctgccatcggcggtgatccgggtcagaccgcgggccccctccagcgcctcgaacttcgaagcatgctcggcgccggcaatgatgtggcgcacgcgaccacgctccagccggtcgtcaagatcctcggtggacagcagggtggtggccgggatgaccacggcgcccagtttcatggccgccagcatcgtctcccaaagcggaaccgtgttgcccagcatcagcagaatccggtcgccgcgcgcgacgcccagatagcggagatgattggcgacccgatccgagcgatcgcgcaactcgacaaaactcagcgacgtctcggcgccggtcggcacgtcgacgatccgaagcgccggacggttgcggctttcggcctcggtcgcaagcacggcatcgaaccagtcaagcgcccagttgaaccgctcggggcgcggccaggaaaatccggcacaggcgcggtcgtaatcctcgcgatgggccagcagaaaggcgcgggcctcggcatagttcatggtcatgacgacagggtcctctcaggtcgtacctccggccgcgaccggtcgcaggtgcggtgcgccggccgttctcgtccatcgatcattgacacagcacgcccggcgtgaccagacccgtcgctgcacgcgcccaagctgcgatgtcgcacgacgtttgaaccggatcgcatcggcgtgtgtttcgcggcgttccacggcttgaccgatcgcagcctcgcccctatggttacgcccgttcgcagccggggcggtcttctcccgggcagtcggtggcggcgaaccgcagatcctgcgagcccgtagctcagccggtagagcatctgactttcgattgggagcgccggccggaaacggtcggatgaaacaggcgtcaaagtcggggaacccgtccgcgtcgcggcgacggcaatcccgagccaagccgatccccttgagtgtaagggggatcggaaggtgtagaggccagacggcgcccacctaactcaagcgccccgtccgagggcgttccgacatggtgaagggatggtccgggccacaaacgcaccggttgcggttgcggcggcgaaagccgtggtggtggagtaatcagagggtcctgggttcgagtcccagcgggctcaccatctttggaaagcggcatgctctcaggagcgtgccgctttcttcgttacggctttcggtcagaatcatctttgtcggaaacattttattgccgatggggaagagtccgacaatgaggttgaaatactcagcttacgttcgggatcgatcattcttgatgaatggtcgtttaccgttaatttaccgggcattctcgatttatttaccacattcgttttaaggtgcgccggaaagcaggctgccgttgcggccgccattccgatgtggatgtggacgatggaccggattctcggacgtatgaccatcacgatcaaatcagctctgctgattgtgatcatggcggtggtggccctgatcattgccgtgttgagctatgacgggctgatggtcagcgaacgccacggcgagacgatgcgcaatgcctcggaacgcgccacctatggcgaacgcgccaacgggctggtgatgtcggtggtgtccgacagccgcggtatctatatgtcggccgattccgcgaaggcagagaagtttgcggtgacgctgatggccgccctcgacaagctgggcgagaccatggcggcctgggagcgtgcggttcccgaggcacagcgcgccgacttcgtgcctgtgatggcgaaagcgcaggaattcatcgcgttccgcagcgagcttgtgcgtctgggccgcactgaagggcctgcagcggcacgtgcctatggcgacaacgacgccaaccgcgcgaaccgcaaggcgttcaacgaccagctggagaagctggccgtgcagaacgcggcggccgttgaggccggggtcgacgccatgcgcgacttccatgatggccggctgctgctgctgctgggcgttgccgcggccggtattctgctcggcctggccgcggctggtttcgtcgcgatcgcgggcatcggccggccgctcgggcggatcagcggcgccatggagaccattgcggccggcaccgacgatgtgacggtcccgggcaccgatcgccgggacgaagtgggcgtgatggcccgggcgctcgaggtgctgcggggcgcgcaggcgacggcgcggcggcttggcgaagagcgtgaacgggcccaggtcgaacgcctgaagcgggccgaggcattggagcggcgcatccagggcttcgaccgggaggtcgtgtcgatcctgtccgaagtggacaaggcgatccggcacctgcaggacaccgccagcacgatgtccgggttggccgacgatctgcgcggccgggccgggtcctctgcggcggcggccgaggagacctcggccaatgtccagaccgtggcggcagccgccgaagaaatggccgggacactgcgggaaatctccaaccaggtggtgcgctcgaccgatgtcgcggccaaggccagcgcacaggcggaaggggctgatcagaccatccagagcctggccgaggctgcaggacggatcggcgacatcgttcggctgatcgaggacatcgccggccagaccaatcttctggcgctgaatgccaccatcgaggccgcgcgcgccggggaggccggcaagggcttcgccgtggttgcgggcgaggtgaagagcctggccggccagaccggtaaggctacggcggatatcgctgcccagatctcggccattcaggcggcgaccgagcgctcggtcgaggccttccgggcgatcggtggcacgatcgacaacatcaacgaaatctccaccaccatcgccagtgccgtggaagaacagaccgccgccaccggcgagatcgcccggaacgttcagcaggctgccgtgggttctcaggaggtgtcgaccacggtgtcgcaggtcaatcgtgcggccgacgataccggcactgccgcccgcagcctggcccaggcgaccgatctgctgtcggcacaggcggggcggctgcggcacgacatcgatgccttccttaccgacatgcgcaatcagagcctgtctgcagcatgacatgaggatatcaccacagctctctgatatatctgtgctatgagacgaacagggcgtcgcggatcaggcggcgctctgtgttttgtggtcttgtcacccgtctcgtatcagtgaagggggtttacggacgtcatgggcttgcagtttccgctccgtccggctctgaccgccggccttctgggcaccgtgctgttgaccggctgcctgcagtttccggccgaacgcgacatgcggtcggacatcatcgtcaaggatgaccggcacttcgttttcgaagcgacggccttcgatcgcgggcgttatgccaaggacagcgatcagggagaggccacacgaaccggactcctgattggagaactcgaccgtaagcgtctgtgcccgaacggttatcgcatcgtcgatcgcgaggaacgggtgatcggaaatgcaccggcgtcccagggccgggaatggctgctgcgctatatcggggagtgccgctgagcccggcgggtgccggcctcggccgacggtaggtccggtagggcaggggggcagaacagcgtgtgatctctggtcacaccggctcggatatcgatggcggatcaatggtatggccgggcatgaccagcatagtgcccctgcgaatcagggcttggcgaagcggtcggaccgtgccattgtgtccctcgacaccggtggcggagacatgccgtcgaccgggatggcaccgatgtcgcggcagtgattgatgcggcgggcggtgcccgcgtttcaacctgctcgtgaagtttccgacctgctcgtgaagccggagttcgcctcgatgaccgtgaagtccccgatccgtgccgggctgttcgccgtgacgatcgtcgcgctgggtgccgcccttccgctcgcacctgtcgcccaggcggccgccgcgaaggcgaagcccgtccagaccgcggccctcgcccccgaaccgcgcccgacggccaagccgaccccgccggccggcagcacggtggtggctgcggtgtcgccgtccgtggttgcgggcgctgcggcctatgatccgaacaaggtgaagtccgagatcgacgcggccctggccagctgggcctggtcgctgaacagcggccagcagggtgtcgtggtcaccaacatgtatggcccggacgccatcatgatgagcgacgatcagagccaggtgatgttcaacaacggcggtatcgtgcgctattacggcgcgctggtctcgcatcgccctgacctgaaggtgacgttcggcgacggctggatcaccgtgctcggccccgatatcggcaccgccaccggcttttacaccttcacctacacccagggcggcaagcaggtgacggaacctgcgcgctataccctgatctatcgcaagaccgtggatggctggcgcatcgtgtctcaccattcctcgcggcttccccaggcgcagagctgatcctcaacggatccggttccggccgggcacgagatgaagacggccccgcaggcgattgtggggccgtcttcgttcatggcgtcagcgcagcatcaccgtccggctctgctcacgcatgaactggggcagataccaggggccgaggccgcccttgccgcccgcgcctccagaccctttccagccgcagaagggctggtgcccgggccaggcaccggtggtggcgccgcttgcccggttgacataaagcgcgcccgcctctgcccggtcgaggaagaggtcgatctccgcctgccgtcctgcatagcagccggcggtgaggccataggcgacgcggttgccatcggcgattgcggcagccaggtcgtcgaagggttgcaccgatatgaaaggcaggaacagctcgtcgctgttcaggcgatggtcggggccgaggcggtcgacgatcaccggtgccagatagcagccgcggtcgtagatcccgccgccgaggcgctcgccccccatgatcacccggccggcgcgccgggcctcgtcgactgcagcagcctgacgggcggcggcccgatcgtcgatcacgggacccatgaacacctcgcgccggcgtggatcgccgagggtcagcgttgcggtgcgggcggtcagccggtccaggaaatcgtcatagatcgcggccgcgacatagaccttggacagcgccgagcatttctgcccctgaaggccgaagcccgatcgggccacaccttctgccgcccggtcgagatcggccgtcgcggtcacataggccggattcttgccgcccatctcgacgatcaccggccgggcgaaccgaccggcggcgaagcggcgatggatctccatacctacggcatggctgccggtgaaggcgatgccatcaagtcccttgtcggccaccagtgcctcgccggtggcggcaccaccgggcaggaaggcgagcacgcccgcgggcaccccggccttcaggaaggcctgtaccagcagggcgccggtcagcgcattgatctggccgggcttgtagaccaccgcgttgccggccaccagggcggccgagatcatgttgaccgacagcgccaccgggaagttgaacggcgcgatcacgccgaagacgccataggggcgcaacagagagccgcagctttcctcgggtttcgcacgggggagctggcgctcatagccgaggttccgctccatctcggcggcgtaatagcgggcaaggtcggccgcttcctcggcctcgcccatcgcctccaggcgcgacttgccgacttccagaaccagcagcgggcccatccgccatttcatgtcggccagaatgtcgccggcccgccggatgattgcggcacgctccggccagggcatggccgcccaggccggctgtgctgcccgggcgacggcgaccgcgcgtgcaaccgttacagcactcgcctccgccacctcggccagggtcatgtcgcggtcgatcgggctgcggatagtggtcgtgacggtcccggtgaccggatgtccctcgaccaggggaaagacggtttcacggcccaggccggcctccagggccgggaaaagctggtccaaccggtcgtgcaccgggctgaagtcggtgccggtattggaataggtgacacgtggcggggcggtgtcgtcgaagatgtcgctcatctggtctggcgtctcccaagggtgacggtctggcgccgtttcgcattctgagggggcgtcgatcgacgggagatcagccgggcccgcggataccccagggggcggcccagcccaggccgtcctccgtccggccgcggggccggtattcaagccccacccatccgtcataaccgagtgtgtcgagccggtcgagcagatgtgccggggcgatctctccctgatcgggctctgcacggtcgggcacgcctgcgatctggacatggccgatcagcggcagctgggcgtccaggcgccgggtcaggtcaccgcgggtgatctgggtgtgatagaggtcgaactggagcttcagtgacggatggttgatctcgcgcacgatggcggccgcctcgtccgggtcggccagaaaatagccgggcatgtcgcgcggattgatcgcctcgatcgtggcgacgatgccggctgcggcggcggtctcggcggcctcgtgcaggttgcgcttatagctcgcgcgcgcgtatgcgagatcggcgccggtttccgggatgccggccaggacatgcaggcgtcgggcacctacggcaacggcacgctccacgctttcgatcagcgcccggcgaaagcgatcctcgtgcccgggcagggccgcacagccgcgaccacccgccgcccagtcgtcgacggcgatgttgatcagggcggcctcgagcccggcggcgtcgagcgcggccctgagcgtcggggcgggcaggcggtcggcaaacagcatttcgatgcccgagaaaccgcaggccgcagccgcatcgaagcgtgcctccagcgggcgatcggtgaacagaaagtcgagattggcggcaaggcggggcatggggcagggcggctccgtggcaacggcatcgagggcgggagatatgcgccggggcttgccaagcggcccggccgggcccagtctggcacccggccgcaatcttcgtcgagcccggatgacgtcgcttccttttgatcccgccccgcccgcagccgatcccgtcgacgccgtcacggggccggtgcccaatcatccgctggatcatcggctgaagacgctgggcacggtcgcggcgctggccacccgctggcggctgctgggacggctgaatggtgccgggaaggcggtgcgggggcttgcagcctgccttggggccgaggtcaccatcggccgccggatgcgtacccgcgccggcagtgcctggccgggacggcggctgatcatgctgcatcccgatctgctgaagccggggcacgagaccgaccgcgaccagacctttctccacgaatgcgcccatctgatcgccgatctggagcatggccggtcctgcggccatgatgcgcgctggcgcgcggtgatgctggcgatcggcgaagtgcccgcaaccacgcaccggatcgactatctttccgcctcggcccaggcgcgggtgatctggcgctgcgtctcctgtgggcgcgagcacgccttcgtccgccggccgcgccgacccgtcgcccgctgtcattgccgggcctgcggccccgatcgcggacggctggaggagctggtgcctctgcgcgacgacggtgcgaccgcgaagacatgagcttccgccacggggactgtcatatttctgggcgccgctgaacggctgctggcgaggcctttggttttgccccgaggggggccaattccgcatgcgccccctggagggccaaaatagcgcgttggggtgatttccgtagcttgcatcggacgtgggggcggggtcctgaatcggccgttcagggggcattcggggtcccgaatttttctgcagaaaaatcccatttttctcttttcctgcccgtgggttgcccgtataaaccgcctccaccgacgtacccccccgaaatgacgggccgacatggcgcccgtccgctacgtgaccagggacgacggcagcggaatgggaacaacctgagcgtcccggtccatgccgggccgccgccggtttgtaggggatcagccaatgatgactccgaagatcgagcgctttctcgccggccgacgagaatacgacagcaatccttgtgtggttgtcgatctcgacgtgatcgccgagaagtatcgggagatcagcgagcagatgccgctcgtgcgggtgttttacgccgtgaaggcgaacccggctcctgaaatcctgtccatgctggtcgagctcggctcgtgcttcgataccgccagcttgcaggaaatcgagatggtgctcgccgccggtgcgagcccggatcggatttccttcgggaacacgatcaagaaggaacgggacatcgcccgcgcctatcagttgggtgtgcgcctgttcgccttcgacagtgcctgcgaactgcagaagatcgcccgctcggcccccgggtcgaaggtgttctgccggatcctggtcgattgccaggccgccgactggccgctgtcgaagaagttcggctgtgcgcccgagatggcgctggagctgctgaccgacgccgcttcggcggggctggatgcctatggcatctcgttccatgtcggctcgcagcagaccgaccccgagcagtgggatcgggccatcagccaggcagcggcgatcttccgcgacctgggggagcggggcgtgtcggcgcgcatggtgaacctgggcggtggcctgccggcgcgctaccaggacgaggtggccccgatggccgcctatgcgctggcgatctcgcaggcgatgacccgtcatttcggcaatcagctgcccgagatgatcatcgagccgggccgcggcctggtcggtgacgctggcgtgctggaagccgaggtgatcctgatcgccgaaaagagcttcgacgacccggtgcgctgggtctatctggatgtcggcaagttcaatggtctggccgagaccatggacgaggcgatcaagtaccgcctgcgcaccgaacgcgacggcagcgagaccggccgggtgatcctggcaggccccacctgcgacagcgtcgacgtgctgtacgagaaggcgggctacgagctgccgcatgccctgcaggtgggggacaagatcaccttcctgtcctgcggcgcctatacgaccacttatgccacgacgggcttcaacggctttccgccgatccaggcctactatatctgatccgtgcagggtcagccggggtgccgcggcaccccggtgcagacgtgaaaacgccggcagggcaggcccctgccggcgttttcgtcgtgtgcggatatatgcggccttcaggccttgccaagcagggccggcagctgcgacaggccgcccagcaccgccttgggcgcacccggcaggccgtcggccggcaggtcgccgcggttgatccagaccgcgctgtagccgaaatgggcggcaccggcgatgtcccagccattgctcgagacgaaggcgatctcgtggggcgccatgcccagcgcctcggggccgagggcatagacctctcgcgccggcttgaaggcgccgacgctttccaccgacagcacctgagagaaatggccggtaaggccggcggtggccagcaccgccgacagcatcaccggcgtgccgttggacagaatgccgagcggcatgccggcggctgaaagcgcctcgatcaccggacgggtgtcggggaagggcggcagggccagataggcctccatcagcttcgcgcgcagaaccttgtcattcagcccgaccgaggccattgcatagtccagcgcctggccggtgatggtccagaaatcgacatgctctcccatcaccgtgcgcagccaggtgtattccagctgcttgcgacgccaggtatcgctgagcgcgcgctccactgccggatccccgacgcggatcagccgcgagctgaccggggcatggacgtcgaacagcgtcccgtagacgtcgaacagacaggcgcggatgcctgtcagcggttcagccatggtggacatgccgtctcttacccctccaacaaatgacgtgccagggatctggcgttccggaacccggccgtcaatatgccggataggcgaagtctggtctgtccgtcactcccgcaggcggctgcgatcgagcatggcggcatcgaaggtgccggcggccgtgccgagagccagtgtcggcacgaggcccggatccggccgccccaggcggtggcgatagaccgtcagcgcttccatcacccgctgcacatagttgcgggtctcgccatacgaaatcttttcgatccagtcgatgacgtcgatggagggatcgcgagggtcgccgaagcgggcgatccattcgtcgaccttggcggggccggcgttataggccgcaaccgccaataccagattgccgttgaagcgatcgatcatctggcccagataggcgcggcccagggtcatgttgtagagcgggtcggtcagtcgctcgggctgataggccaccgcaatcttgccggcggtggtgcgggcggtgcccggcatcagctgcatcagcccgattgcgcccgccgggctgacggcttccggattgaattcgctctcctggcgggcgatggcatggaccagggcgaaatcgaccggatcatcggggcgcggatcgcggccgacaccgggcgtgacgccggcatcgtctccaacggccggatagcgcagttccaccgccagacgatcgtcgatttcggcaaagcgcttggcgaagcgcagcgccagatccgggcggcccagggcgcgcaccgcctcgatataggcgtgctgctcgtcgggcttggccaggctgtcggccagggcataggcgaaggtcgacagcagccggctgtcgtcggtgcgggcgatcagcgccaccatcaccgccagcggccggccggtgatggcggcgaaggcctcttccggcgcccgcgcctcgttgggggcggcaaagcttgcgagcgtggtcggcagatcgatgcgctcggcggccagctggccgtaaaaggtggtgcggtcgcgcgccgcttccatcagccagtcctgagcggcctgggcatcgcccagcgcgcccgcggcgcgcccggcccaataggcggcgcgtgcccggctgatcggccggctgacccgttcgtacatggcgatgaagtgccgcagcgccgcatccgggcggtcgaggaagcggagcgcgatccaacccgccagccattcggcttcggagaagcccgagggatcggattgctcatgcgaggcaaccaggtcataggccttggcgacatcgccgcgctccagcagcatccgggtcacgatatggcgctcgcgccaccagtcatcgggagccagatcgacggcccccgccttggttgccgccgtgatcagggctgcggcatgatccaggtcttcggcccgacgcgccgcgcgcgcctgagagaaggtcaggcccggatccgcgcgcagtgcgggcggcagggccgcgatcagcgcatccgccttgcggctgccggcattcagcgccaggcgtgcctcggcaagcgcccgggcatcggcgtcgaccagcggcatcaccatccgggcggcgccttcctggccgcgccagagcatgatgtccagccgccggcggtgatcggcggggcccagaagcccggcggcggagacgagcagggcgctctgctggcgttggctcatcaccatccggtcccagacatcccgggcgacctggccggcctcggcatcgcgacccagccgccgcagcgcatcgatcagccgcaccgccccttctgcggtgcgcggcttgtcggtgccgaaccaaccgaccacctgctccggcgtccaggtgtcgggcagcaccgtttcggcgcgggccatcagccgcgaaacccgcggccattcgggatgggcggcggcaaagcgttccagccggtcgtagaccgctggcgtgcggctgtcctgaagctctgcccagtcgatgtaatcgtccagcggacgcagcttcagcccggcggcaaggccgcgtgcatcgtcgtagcggccgtcatcgaccgccgcaaagaccgaccgcaccgtcgacatgtcacgcacgggcgggaccagggcgatggtcgcggcacgtgatgccgtcgcggcggccggggccgccacgggctgggccgaccaggcgatggcgggcgcggcgagcgccagggccagcgcggtgccggcgacgagatgacgaagggggcggagctgagcggagggcatcggaaagcttgtcctcgtggccggggcgacggccttgactgcgggaggcggtatcgcacgacaccgggccggaccggccgcgaaacagtgtatcatggcccccggggcgggcaagggcgggggccgggtgccgacctggccgcagattgaaaggaattcgggcagatccggctgccgcacgccttgtcgaagcctgccggcggggctatgttgcgcggacctgccgatgacccgtcacaacccgcgggtcacggccggccccgaacgcccggctgcgcgcgcccggaacaagccggagccgccatcgaccgggatcttgaccccgcataaggccagtctccgcccaatcaggcttgacgccttccgcttcgaggacggacccccatgaacgccgaacgcttccacggctctatcgtcgccacgctgaccccgttcaaggacggcaaggtcgacgagaaagcctatgcgtcgttcgtggactggctgatccgcgaaggcagcgacggccttgtgccctgcggcaccaccggcgaatcgcccaccctgtcgcatgacgagcatatgcgggtcaccgagatctgcatcgaggccgcagccggccgggtgccggtcatcgcgggtgccggctcgaactccacccatgaagctcagaagctggcgatccatgcggagaaggccggcgccgatgcgctgctggtggtgacgccctattacaacaagccgacccaggccggcctctatgcccatttcaaggcggtggccgaaagcacctcgctgccgatcttcatctacaacatccctggccgttctgtgatcgacatgaccgtcgacaccatggcccggcttgccgaactgccgaatatccgcggcgtgaaggatgcgaccgccgatctggttcggccgctggcggtgcgccagaccatcggcaccgagttcgttcagctgtcgggagaggacggcacggcgctggcctttctggccaatggcggccatggctgcatctcggtgaccgccaatatcgcgcccaggctctgcgccgagatgcaggcggcctggcgggcgggcgatgccaggaccgcgcttgagattcacgagcggctgatgccgctgcatcgtgcgctgttcaccgagaccagcccgtcgccggtgaagtatgtcgcggcgaagctggggctctgcgaagccgagatccgtctgccgctggtgccggtgacgcccggcaccgagcgtgtgctcgacgccgccatcgcccgtaccggcctggagccggtcggcccgtcgcgcatcggcaactgagccggcgcgacgcccgaggcccgacatccaaggggcctgaagcccgaggaatcccatggcccgcaaaagcggcttgatcagtcacggcgacgtcgccgtcaatcgcaaggcacgcttcgactatttcatcgaggatacggtcgaggcgggtcttgtgctgaccggcaccgaggtgaagagcctgcgcggtggcaagtgcaacatcgcggaaagctatgcttcggtggaaagcaacgaagcctggctgatcaacgccaacatccccgaatacggcggcggtaaccgcttcaatcacgaaccccgccgcaagcgcaaactccttctgcaccgcaaggagatcaaccggctcttcggtctgatcaagcgggagggggttaccatcgtgccgctggtgctctatttcaacgacaagggcatggccaagctgaagctgggcctggccaagggcaagaagctgcacgacaagcgcgcgaccgagcgtgaccgcgactgggaccgccagaagggccggctgatgcgcgagaaggggtaaggtcatggccagtgacgaccgcaagaccggtggagaccgcacgaccggcgacgaggatggcctgcttggccaggttcgtcgcaagctgatcgataccaagcggaaatgggcggcggaaggccgcgggctgagcggtcgcaccgggccccggcccgaggccgaacgcctgcctgccggccagcggctcgtcaccaacttcccggttctcgacctggggatccagcccgagatccggccgggcgactgggagctgacggtcgcaggtgcggtcgagaacccggtcaccttgcgctgggccgattttcaggccctgccgcaggtgcggatgcggtccgacattcattgcgtcacgacctggtcgcgctatgacaacgactgggacggcgtgtcggcctttgccctgatggatctggtgcagcccaagcccgaagcgcggttcgtgctgcttcattcctatgacggctacaccaccaatctcgacctcgacggcttcgcggatgacgatgttctgctcgcccatgcctggcagggtgagccgctgacccgcgagcatggcgggccggtgcgccttgtcgtgcccaagcgctatttctggaagagtgccaagtggatccgccggatcgagttctccgagaccgatcagccgggcttctgggaggtccgcggctatcacaattacgccgatccgttcgaggaagaacgctattcctgaacaagaccttccgcggcaggcaggcggcggcggattttcgccaggacggcgtcgaacatctcggccgtaagccgaccggtgttcacgttatagcgtgaacaatggaaactatccgccagcagcaggggccgtgtcacgggagacgcggccttttttccggacggtgccggtgccagcgcgtgcatcgcgccatggctgaaggggtgatcggccagccgcctgcccagggtccgcagcacggcatcatgggcgatgcggcccagtgccaggatgacctgcagcccggtcatcgccccgatttcagacaccaggaacggccggcaggtatttgcctcggcaggcgtcggcttgttctcgggcggcacgcagcgcaccgcattggtgatccggcagtcgaccggctccagaccgtcatcgggcctgcggtcgaaccggccgcggatgaagccgtggtcgatcagggtggggtacaacaggtcgccggcgtaatcgccggtgaaggggcgccccgtgcggttggcgccccgcagccccggcgccaggcccacgaccagcaggcgtgccgacagcgggccgaaagccggcaccggcccgttgtgccaatccggttcgctgacctgccgttcggcccgccaggcggcgaggcgggggcagagcgggcagtccggatccggaaccataagcaggggggcggcaacggctggcggcatgggggcatccattagtaagacggcggcgacgttacgatggccatgaacgacgacgccacccggcggatctccgcgcgggtggcgtgacatcgttgaccgggacgacgtccaggatcagaggccggcgttcacagatggatcagctcttgcgacgcggcggcgtgcgcggcttcaccggtgccggcgcgggcgcgggcttcgcaggtgccggggccggctcgtcctcttcgtcctcgtcttcgtaatcctcgtcgtcctcgtagtcgtcatcatcctcgtagtcgtcgtcgtcctcgtaatcctcgtcgtcctccagatcctcgtcctcgggttccggctcggaggcgggcaggggcacgtcttccatcagcttccggcgacgttcaccgcgctgacggccggcctcggcctcggcgcgcgagcgggcgatcaccggctccagatccttgaggtcgaggaagacgtcggcctggcggcgcagttcgtcggcaaccatcggcggctgggtgcggatggtcccgaccacggtcacgcgcacgccgcggcgctggatcgcctcgaccagacggcggaaatcgccatcgcccgagaagatcacgatgtgatccacatgatcggccatttccatggcatcgaccgtcagctcgacatccatgtcaccgcggacccggcgtcggccggtggcgtcggtgaattccttcgccggcttggtgaccatggtgtagccgttataatccaaccagtcgaccagcggccggatcggcgagtagtcctgctcgtccagcagggcggtgtagtagaaggcacgcaccacgtaagcgcgtgaccggaagtaatccagcagccggcgatagtcgatgtcgaagctgaggctgcgggcggcgccgtaaaggttggcaccgtcgatgaacagcgcaacacgctcgccttcgtggaaaatactgtcgatggaccgtggcatgagtatatctttccccagaattcgcctatgggtcgtcgtcaggagaggccggttgggtcgcgtatcggatcatccgccggcgcgacgtacttaatccctcatggccccagattacaagacggaacacgtccgatcatgatggaattgcgtaaagacacgatatttatcgcagttggcgccaatctccccgatgccgaaggtagaatgccgcgcgctgcttgtcaggctgcggtggtgcaacttgggaagatgggcttcgatgtgatcggcgtgtcgcgctggtacgagagtccgccgctgccggacaatggcggaccgtggtatgtaaacggtgtcgtgcatgccgaaacggtgcttgagccggtcgaggccctggagcggttgcatgcgatcgaagcggcattcggcagggtgcgtcgccagcgttgggagtcgcggccgctggatctggatattatagaccatggcggcgtggtccgtcgccctcggatcgcgccggtgcccatcgtgccgggcgccccggttcagaccaggggcggagcgccggacccggaactgccgcatccacggctgcatgaacgcgccttcgttctgctgccgcttgccgatgtggcgccgggctggcgtcatccgaccctggaccgatcggtggaagagttgattgccgcgttgcctgcagggcagatcatccgtccctgcatggaggaagccccggattccggcggcgaggctttgacttccgcatagtcgtgtcatagtgttccgcgcccgacgcgggagtacggccttgcggtcgcttctccgtcgtcataccttttttgagcgactctaaaagtcatcggagcaaccagccatggcccgcgtcaccgtcgaagattgcgtccgtcttgtccccaaccggttcgatctggtgctgatggccgcccagcgtgcccgcgagatctcgtcgggtgcggcactgaccgtcgaccgcgacaacgataagaaccccgtcgtcgccctgcgcgagattgccgacgagaccattgatctcgataccgtctcgcggcagctggtgcagacccatcagcgcgttcccgaggtcgacgagccggacgaggacatccttgatgccatcggcgaggtcgcctcgatcgccagccgtcagttggccgaggacgaactgtcgggcggtggttcgctgtcggtgtcggatgacgagggcgatggcttcggcgccccgcggttcgaggatgccgaccccgaagacgattgattcgtccggggtatctgcgtcgcaacccagcagcggccggaccggccggccgcgcacgggtttcgcttggaaggccggtcatacgggggccacggcttccgtcgacggaccggtcccgcgcgggccaggccggcgatgtgcgaatacgtggcgtcctgccatgcgggtgacgctgttcggtgatcaggcaatacgagctggtggagcgggtcaaggcctatgacccggacgtggacgaaacggcgctgaaccgcgcctatgtctacgcaatgaagatgcacggcagccagaagcgtgcatcgggcgacccctatttcctccatccgcttgaagttgccggcatcctgaccgagttgaagctcgacagccggtcgatcgtgacggcattgctgcacgacacgatcgaggatacgcctgcgacgcttgacgagatcgagcagatcttcgggggcgaagtcgcccggctggtcgacggcgtcaccaaactgtccaaaatcgaactgcaatcggaacaggccaagcaggcggaaaacttccgcaagctgcttctggccatgtccgacgacatccgcgtcctgctggtcaagctggccgaccggctgcacaacatgcggacgctgcactacatcgccaagccggaaaagcgccggcggatcgcgctggaaacgctcgagatctacgcgccgctggccgagcgcatcggcatgcaggcgatcaaggacgagctggacgacctggccttcaaggaattgcacggcgatgcgcgggactcgatcctgaagcggctgtccttcctgcgggagaacgggtccgagcttgtggcccggatcgtcgccgaactaaaggcggtgatcgcggagaccggtatcggcgccgagatctacgggcgcgagaagcggccctattcgatctggcgcaagatgcagcgcaagaatgtggtgttcgagcagctgtcggacatcatggccttccgtgtgaccgtcgacagcatccgggactgttatgccgttctgggggccgttcacggcgcgtatcgcatggtcccggggcggttcaaggatttcatcagcaacgccaagcccaacggctatcgctcgctgcacaccaccgtcatcggaccggaacgacagcggatcgagattcagatccgcacgcgcgagatgcacgaggtcgccgaatacggcgtcgccgcccactggctctacaagcaggagagtggcggccacgaaggccggcagtatcgctggatccgcggcctgctcgacatcctggagcaggcgtcgaaccccgaggaattcctcgagcataccaagctcgagatgttccaggaccaggtcttctgcttctcgcccaagggcgacctgatcgcactgccgcgcggtgccacgccgatcgacttcgcctatgcggtccattccgagatcggcgacacctgcgtcggcgccaagatcaacggccgcatgatgccgctgcgcacccagctgcagaacggcgatcagatcgagatcatcacctcgaaggcgcagaccccgtcgccggcctgggagcgctttgtcgtcaccggcaaggcccgatcccggatccgccgcttcatccggctgcgggagcgcgagcagtatgtcagcctgggccgggcgatccttcagaagaccttccgtcaggaacagcggcctctgacggagaagggcctcgaccgggcgctgcgggtcttcacccacaagacgctggaagacctctacgcagcggtgggtaagggtgacatcaccgcccgccaggtcatcgacaccgtcttccccgaggcccgtgtgccgaaggatgagggggagaccggcaatgtcgtgccgctgaagcgcatgcgcagcggcaagagcggtgtcaacggccacgccattccgatccgcggtctgatcccgggcatggcggtgcattatgccggctgctgccatccgatcccgggggaccggatcgtcggcatcgtggccaccggcaagggtgtcaccatccataccatcgactgcgagacccttgagcagtatgtcgacgagcccgaacgctggctcgacgtcgcctgggacacgggttcgaccggcgaggcggggcataccgcgcggcttgcggtgatggtgtcgaacgagccgggtggtcttgcggccttgaccacgatgatcgccaagaattacggcaatatcaccaatctcaagatcaccaaccgcacctcggaattcttcgagatgatcgtcgatgtcgaggtgcatgacgtgaagcatctgacccatatcatcgcggccctgcgggccgatccgatgatcaactcggtcgaccgcgcccgcggctgaccaccggtttcccacccctcggggccgcgtgtcgcacgggcgatgcgcggcttccgcgcatccctatcacggagttcgcccgacccatggacaccgaagaagtcctggacgtgttccgcgcctgcggcgcgctgctcgaaggccatttcatcctgtcctccggtctgcgcagcccgcgctatctgcagtgcgcgcgggtcatgatgcatcccgtccagggcgagcggctgtgccgggcgctggcggagcggatcaacgcgcgcctggccgacggcaccatcgccggcggtggcatcgactgcgtggtgtcgccagccatggggggcgtgatcgtcggctatgaggtcgcccgccagcttggcgtgccggccatgttcacggaacgggtggacggcagcttcaccctgcgccgcggtttcgcgatcgaggcgggctggcgggtgctgatggccgaagacgtcgtgaccaccggcaagtcgagccgggaatgcatcgcggcgatcgaggcggccggcgggcgcgtggtcgccgcctcggccttgatcgaccggtcggccggcaaggtcgatctgggggtgccgttcgtgtcgctcaccggactcgacgtcccgagctatgacccgaacgatcttccgcctgaactcgcggccctgcctgccgtcaagccgggcagccgcggcctcgcctgagcgcgaggccgcttccggtgccgggcggatcctgtctccccggcaccaaagcacgagaaggaatgcaagccagtgacccagaaccgaccgctcgcggcctggtccgcacccctgcaggcccatggcggccggcgtggcgacgggccgctccgcctggggctccggctcaatcatgcagccttgcttcgtcaggcgggcgacggccagcgcccggacatggcgcggctggccgaggcgaccgtgaaggccggcgccgacagcgtggttctgcgtgttgatgacggcagtggcctgatcaccgccgatgatgtgcgccgcatcgccgaacgtgcccgcgtgcccctgacgctggagatgcgtcccgacccggcgcgggtcgcctgggtcacctcgctcagccccgcggcagtgatgctgctgcccgagtccgaggccgatgtcgcgcgcatggccgaggtggcgagcggccttcacgaggccggcgtgccggtgctggcgctggtggcgcccgagatggaggccatcgatcaggtgcacgcctcgggcattcgcggtatcgaactcgacaccaccttctatggcgaggccgccgaagaagtgagggcaccgctgcttcagcagatccgccatgccgcgagccacgcacacgggatcggccttggcctgcaggccggccacgccctggactattcgacgctggcgccgatcgccggactgccgcatatccagggcatcacctgcggccgtttcctgatcaccgaagcgctgttcatcggtatcgaagaggccgtgcgccatacccgccggctgatcgacgccgcccgccggcaggcgcggcgccatgcgacacgcggggccgactgaccttatgatgcggatcatcggcaccgggatcgatatggtcgacgtccggcggatcgagaagacgctcgaccgcttcggcgagcgtttcgtgcagcgctgcttcacggtgacggagcgaaacctctccgacggacgtgtgcgccgggcgaacagctatgccaagcgctacgccgccaaggaggcgggggccaaggcgctgggaaccgggctcgaccgcggcgtggcgtggcgggatatcggcgtcgtgaacctgcccggcggcaggccgaccctgcagctcaccggcggggctgaacgccttctggcgcaactggttccggcggggtaccttccgaagatcgatttgacgctgaccgacgaatatccatatgctcaggcgctcgtgatcatcagcgccgtgccggatatctcggtgcaagacgggagttcaacgtgacgcgcgacacgagccggacggacggcgacaatccgcggaaccgcaagccgcgggcagccgaagaccgctcgggcggtttcggcgagatggtgaagacagtggtcatcgccgtcttcttcgccctggtgatccggtccttcgccttcgaaccgttcaacatcccgtccgggtcgatgaagccgaccctgctggtcggcgactatctgttcgtgtcgaagtacagttacggctacagccgctattcctttccgggcagcctgccgctcttcgagggtcggatcctgtcgagcccggtcaagcgcggcgatgtggcggtcttccgcctgccgaccgatccttcggtcgactacatcaagcgcatcgtcggtctgccgggggaccggatccaggtgatcgacggcatcctgcacatcaacggcacggccgttgaacggcgccggatcgaggattttgtcgagacgggcccgggcggtcaggagatccgcatcccgcgctatgtcgagacgatgcccgagggcggcccgtcctacgagacgctggaccagacaccctatggcgcgctggacaacacgccggtctataccgttccggccgggcattatttcgcgatgggcgacaatcgcgacaactcccaggacagccgtgttctgtcggccgtgggcttcgtgcccgaggagaacctgatcggccgggccgaagtgctgttcttctcgatcgacgacagcgctgcctggtggcaggtgtggaagtggccgtcggccatccgctggtcgcgcctgctggacggcgtgggttgaggatgagccgggtgacgaagaccagaggcatgagggcggcggcggtcgaggccggccgcggacgacagcatggatgaacaacgccaggccaccacgcttgcggaatgcgcgcgtgagatcggccatgacttcgacgacccgtcgctgttggaagcggccctgacccatccgagcgtcgatggcggcggtcgcgatcgcaatggccgggtccggctgaattacgagcggctggagttcctgggcgaccgtgtgcttgggctggcggtggccgaccagctctatcaccgcttcccgggggagagcgaaggcgcgcttgcccgtcgtttcgcagccctggtccgacgcgagagcctggcgcgggtggccgagatgctgtcgctcggccgctatctgcgcctgtcgcggggcgaggacgacagcggtggccgcagaaatcctgccaatcttgccgatgcctgcgaagcggtcattgcggccctgtatctcgacggcgggttcgataccgcccgtcgcttcgtcgaacgctattgggcgccgctgatggaggaagacctccgtccgcccaaggacccgaagaccgcgctccaggaatgggcgcaggcgcggggccttgaggcgcccgtctacaccgtgatcggccgcgaaggcccggatcacgccccgtccttccgcgtccgtgcccaggtggcacggctcggcgccgaggaggccaccggtgcctccaagcgcattgccgagcaggccgcggcccaaagcctgctgagccgcgccgaggggcgcggtggagaccagaaatgacgattgaaacccccggcaagacccctgggacgcccgccgaaggcgagatccgcgacgaggacctgcaggaaggcgggctcgcctccgatctcgacgacgattgggatgacgacgacgaggacgaagacgacggcctcgacatgctgccgccgcccgaggctccggcctcggtgccggtcgacgagcagaagaccggcttcttcgcggtcatcggggcgcccaatgcgggcaaatcgacgctcgtgaaccgtctggtcggctccaaggtttcgatcgtcagtccgaaggtgcagaccacccgcagccgcatcgtcggcatcgcgatgcacgggccggcccagctggtgttcatcgacacccccggcatcttccggcctaagcgccggctggaaaaggccatggtgcaggccgcctggagcggtgccggcgatgccggcgacgggctgctgatgatgatcgacgccaagcgcggcatcaccgacgacgtgcggctgatcgtggacgggttgaaggccgaagggcgccgcgcctgggcggtgctgaacaaggtcgacctgctggcgcgtgagaagcttctgccgctggcggcagaggtggacgggctcggcatcttcgaccggatcttcatgatttcggccgagaacgggtctggcgtcgacgatctggccgatgccctggccgcgatcgcccgcaaggggccctggatgtatccggaagatcaggcgagcgacgtgccgctgcgcttcctggccgccgagatcgtccgcgagaagctcttcctgagcctgcatgaggaactgccctatgcgctgacggtggagacggaagcctggaccgagaagccggacggcagcgcccggatcgatcaggtggtctatgtccagcgcgagagccatcgcaagatcgtgctcggcgccggcgggcggacgatcaagcatgtcggcagcgcagcgcggacggaactacagcagatcctggaacgtcgggtgcacctgttcctgttcgtgaaggtccgcgagagctgggccgacgatcccgagcgctaccgcgagatgaacctcgactacccccgctgaccgcaccggatcccctcaagggattgatgttgcagcattcaataacggcttgatcactcgcatgtacccgaccacctcctgaaaaggagggcgggtttcctgcgagaggttccggtccggttcatggaccccgcagcgccgatccggctgccggtccggtgatgtgcgcgcaagcgcccgccgggccggacacgcccggccggcccccgatcccgccccccgtcccacgccgatggcgcggcccgacccgcgcccgaggcgcgcgtgtccgagggggtggtttgcatgcatcatcgctatcttctgatctatcgttttctgctggtgaacatggtggcggccgcagggctcgccatggcctgggttcatggctggatcgaccgggtgctcgcctcggattcgagccggatctcggttctgatctttgcggtgtttctggtcggcctgacgctctgtgcctggcggatcatccagatcagcgacggcctgaacgatctgaagcgggcccagccggcgaagaacggccgggtcgctgcctatctttcgacgctgacccgcgtgcccgaggcgcgccgcccggtggtggccgaagggttgaaggccaagctctacgcccgggcatcgaatgtgcgctacatcgccgacagcctggttctgctgggcctgatcggcacggtggtcggcttcatcgtggcgctctcgggcgtcgatcagaaccgtgtcgccgatgtctcggcggtcgggccgatggtcgcccagctgctcgacggcatggcgatcgccctctggacgacgctggtcggcagcatcctgcacatctggcttcggctgaactatcagatccttgcgggcggcaccgtcaccctggtcgcggatcttgtcgcgcggggtgaaggcgatgctgtatgacgaccctctcaaacccgatggcgacgatggcgcgggaaccgtctttcgcgacgtcatcacgctcaccctgctcggtttcgtggccgtggtcatcctgctgctgccgcatctcaacccgccgcgcaagcaggatcaggcggaagtcaccgcgcccggcaatgtgattgtcgaggcgctgtgggaagccgatctcgacaccgatgtcgacctctgggtcaaggcgccgggcgatgtgccggtcggctattccaacaagggcggggtgatcttcaacctgctgcgtgacgatctcggccgctatggcgacgccaccgacagcaatcacgaagtctcgtacagccgcggcattccgccgggcgagtacatcgtgaacgtccatctgttccgcaatcagagccggcagctgcccgtgcgggtgaaggtcgtcgccagcgtcaagagcgaccagcagtcttcggcccggcagatcctggcgaccgaggtggcgctgaaccgcgagggcgaggaaatcaccgcgatgcggttccggctcgacgacaaggcgcggctggtgccggacagcgtcaacagcctgtatcagcgcctgcgcagcaatcgcgggtgagggaaggagagacgcatgaacgatgtcgtctatgtcttcgccgccaccgccggcatcaccgctctgcttgcgacgcttgcgatctgggcgccccggcgcctgccggtccggatggccgccatcgggctgacggccttgctgctgcccgcagcctatcttggcttcacgacgctgctgtcacagcccaagccgatcacgatggaatggctcgacaagggggcgggcgaggccacggtgctgggatccgtgatacgagagggtgaggggatctatctctggatccagcccgatggcggcaatatcccgcgctattacgttctgccctgggatctgaaacaggcccagcagttgcagaacgcgatgcgcgacgccgataaaaaccagaacgggctgaagatgcgctcgccctatgaacccacctgggaccggcgcgagccccgcttctacgcggcaccgcagccggccccgccgcccaagcgcggccccgaggaggaggatgacgggccgatgatctatcgccatcccggctgggacgtctgagcccggggcaggcagccgagaccggtcagagtccgacggacggcctcgtccagcggcgtgtgcggctcgtcgccgatcactccccgcagccggtcattggtcatccggatcgggatctgccacagatgacgcatctcgcgcagattgcggatcagcggtacgaacggcgcggcgaggccaagcaaacgccagggcaggtggatcgtcctgaccggtcgcccaacgacccgggtgatcgccgcggccatggcggtgccgtccgggtcccagtgacccgccatgtgcagggtggtgaaggcggacagccggtcgcggatcgccaccaggcgcaaaaaggtggcggccatgtcaggcagataggtccattgatggccgatgcccggccggccgggatggatcgtccgacggatcggtccgccgggctgtaccaggcattgcgagaaccagttgttgccgggcctgggcccgaagaagtccccggcgcgcaggacgatactgcgcacaccactatctgccgcccgttcgagacggcgctccatttcggtgcggatggcacctttcgcggtatcggggtgctgcggggatgtttcggtgagtatgggataggcatcggcgccataattgtagatcgtgccgggcagcagaatggtggcgccgacggcatgggcggcggcgatgctggcatcgatcatcggcagcaccagccggtgccagtcgcgatagccgggcgggttcaccgcgtgcaggatgaggttgcaccctgccgcagccttgcggacatcgtccggcgacatggcgtcacccggcagccaggtgacgcccggtgtgaccggcatcgaggttgcgcggcggctgagggcccggacctgccaacccgcctcgaccagttgccgcgccgtctctccaccgattccgcccgaggcccccaggaccagggcctgaccgctcatgctcatctctttgctccgtctgatagcgacggccccagcatccccccgatccggctgccagaaaattgacgaggttcctatggccgctatacttccatgcatggccatgggtgacccgagctgggatctgtatcgcacctttcttgcggttctgcgggagggatcactgtcggccgccgcccgccatctggggctggcccagccgacggtcgggcgtcatgtcgatgcactggaacaggccgtcggccagcagctcttcacacgctctctgcacgggctgatgccgacgccggcggcactcgaactcggcccctatgccgaaaccctgcaggcgaccgcagcggctctgctgcgggcggcctctgcgtcggttgcggaggtggccggcacggtacgggtgacggcgagcgaggtgatcggggtcgaggttctgccgccaattctggcagccctgcaggagacccatccgggcctgacgatcgagatcgtgctgtcgaacgcagtggaagatctgctgcgccgcgacgccgacattgcggtgcgcatggtcgcgccgatgcaggaggcgctggttgcgcagcgcgtgggctttgtgccgctggggctgcatgcccgccgcgactatctggagcgccacggcatgccacgcacgccggcggatctggaactgcatcggctgatcggcttcgaccgcgaaaccgccatagtccggcgatttatggccggtgcggcggcgcaggggctggccgggttcacccgcgcccgcttcgcgctcaggaccgacaatgatctggcgcagctggcgctgatccgggccggggccggaattggcttctgccagctggccgtcgcccgtcgaagcccggagctggtccgcatactgcccgaggtgaacgggctggtgctggacacctgggttgcgatgcacgagaacctgcgccgggccccgcgctgccgggtcgtcttcgatgccctggtggcggggcttcgtcgtcatgtcgcggcgggagagcccggatgatcgaatggaccgaggaggccatcgtgcttgccgcccgtcgccatggtgaggccgatgtcgtgctgtcggccctgaccgacggtcatgggaggcatcaggggctggttcgcggcggggcagggcggcgcatgcgcggcacgatcgagcccggcaaccggctgctggtcacctggcggggccgcctcgacggtcagcttggcggctatatgatcgaggcgctggacgagccggccggacggttgatcgacgacggcttgagactgacggcccttggtgcactgtcggcggtgctggatcgcagcctgcccgaccggctgcgcattggcgggcttttcgaacggaccgccgccctgatcgcggcaatcgaacatgcaccggaaacggtctgggcggctgcgttcgtgttactggagcgcgaccttctggccgatctgggctatgggctcgatctcggcagctgtgccttgacgggggggaccgaggatctgagccatgtctctccccgctccggccgggcggtgtcgcgagcggctggcgcgccctgggccgggcggttgctccccctgcctggcttcatgaccggcagtgtaccgctggatgaagcggaggtcgccgagatcgttgacggcctgcgtctgaccctttacttcctcgatcgacacctgttttccggtgccggccagcccgtgccgccgctcaggatcgcactggccgaccggctggcgcgccggagcggccggggaccatcctccgcagacggcaccaacccgatggagatccgatgagcgacgagaccggaagcccggacaatgcggggctgatcgagaccgtaccgttggccgacgcgctgggtgagcgctaccttgcctatgctctgtcgaccatcacctcgcgctcgctgcctgatgtccgcgacgggttgaagccggtgcagcggcggctgctctacgccatgcggcagctgaagctcgatcccgctcagggcttcaagaaatgcgcccgggtggtcggcgacgtgatcggtaaataccatccccatggcgacaccgcggtctacgacgccatggtccgcctggcgcaggatttcgcgctccgctacccgctggtcgacggccagggcaatttcggcaacatcgacggcgataatgccgcggccatgcgatacaccgaggcccggctgaccgaggtcgcgatgctgctgctgcaggatctggatcgtgacacggtcgggttccgtgccaattacgacggcaccgacgaggaacccgtggtgctgccggcgggcttccccaatctgctcgccaatggcgcgaccggcatcgcggtcggcatggcaaccagcatcccgccgcacaacgccgccgagctggccgaggcggcacgcatgatgctgggccatcgcaagaccgatggggacttccccgagggcacggccgttcgccccgaggatcgctatcgcgactgtccccatgaaacactgctgagccatgttcagggccccgactttccgaccggcggcgtgctggtggagagcaaggcctcgatcgcggaggcctatgccaccggccgtggcggcttccgggtcagggcgcggtggcatcgcgaggatctggcccatggtcgctatcagatcgtcgtcaccgagatcccgttccaggtccagaagggccggctgatcgagcgggtggcggagctgctgaccgccaagaagctggcgctgctggcggatattcgcgacgaatcggccgaagacgtgcgcatcgtgctggaaccgcgctcgcgcgacgtcgaccccaacctgctgatggaaagcctgttccgccagagcgatttcgagaaccgcttcagcctgaacatgaatgtgctcgatgccgaaggcgtgccgcaggtgatgagcctgcgcggcgtgctggccgccttcatcgaacaccggatcgaggtgctgcgccggcgcaccaggcaccgtctctcggaaatcgcccggcggctggaagtgctgcagggccagctgatcgcctatctgaacctcgacgaggtcattcatatcattcggaccgccgacgagccgaaagccgggctgatgacgcggttcgagctgaccgaggtccaggccgaagccattctcaacatgcggctgcgcgccctgcacaagctgcagcagatcgagatcgagcgcgaaagcaagcagctgaccaccgagcagaagaagctcaaagggctgctcgccgacgaaggccgccagcgggatgcgctggatgtggaatttgccgatctggtgaagcgtttcggccccgaaaccgaactgggccgccggcggaccacaccgggcgaggcgccgaagaccgagatggtctcgatcgaggcactggtcgagcgcgagccgatcaccgtcgtgctgtcgaccatgggctggatccgggcgatgaagggccatatcggacccgatcaggagttgcgcttcaaggagggcgacgccgaggcgctgcgcatcgaggcccagaccaccgacaggatcctggtcttcgcagatgacggccgggtctatacgttgcagggcgacaagctgccgcccggccgcggtttcggtgagccgctgcggctgatggtggatcttgcagccgacgcccagatcgtgaccctgacactggccgggactccgggcgatctgttgctggtggcaagcgacggtcgcggcttcatggtgaagcccgaggacgccgttgcccagacccggaccggacgtcaggtgctggtgcctggcgagggccagaagctgaagctcgtgcgccggatcgatgccgatgccacccatctcgccatcgtgggcgagaaccggaagctggcgatctatccgatcgatcaggtaccgcatatgacgcggggcaagggcgtgcggctgcaaacctatcgccagggcggtccgtcggatgtgcggggcctgaagctggttgatccgcaggacggcctctcctggcagaggggaccgcagacccgcaaggtgctgatgccagaactggcgcgctggatcaccaaagcgcggggcggcccgggcgcgctggcgcccaacggcttcccgcgggacaaccggttcggcgactgagcgtccagcacatctgatcagacgtaaaaaacggcccggcggatccccatccaccgggccgtttctcgtagacctgctcccttccggtcgtcccgtcccccgacagggctggccggaagccgggttgcttaccggtaaagcagatcgggcaggaaggtggtgatgcccgggaagatccacaggatggccagtgccacgatctggatcagcacgaaggggatcacgcccttatagatgtcccaggtcttgaccgacggcggtgcgacaccgcgcagatagaacagcgcgaagccgaagggcggggtcaggaacgaggtctgcaggttcattgccatcatgacgcccagccagaccggattcacatccagctggagcagcaccggggcgaccagcgggaccaccacgaaagtgatctcgatgaagtccaggaagaagcccatgatgaacatgacgatcatcacgatcatgagggcgccgaacgtaccacccggcatgccggtcagtacttcatggaccagatcatcaccacccaggccgcggaacaccagcgagaaggcagccgcaccgatcaggatgacgaagaccatcgagctgacccgggcggtgccgcgcatcacctcgttcagcatgttggttcgggcggcgcgcaggatggagatgatcaggccccaggcgatgagcaccagcaggatcgccgcgacgatgatgccgatgttctcggcggtgctgatcacgctgcgctggaagcgcagatccatgaagccggtcaggacgaggatggcgatcagcgcggcgcccgaaatgtagatcgggacggggctgcgatccggatcgcgggctgcacccagcatcagcgagccgaccgcgccgaccgcagctgcctccgtcggcgtcgccaggccgccgaggatcgaccccagcacagcgatgatcagcaccagtggcggaaccagggcgctgaagatgcgcttgccgaaaccaggaccccgacccactgcaacctcttcttcagagagtgcgggcgagccggtcgggttgatgatgccggcgaagacctgatacaggatgtagatgccgaccagcatcaggcccgggatcagcgcgccggcaaagaggtcgccaaccgagacggtatccggcgagaagatgcccatcttgagctgcgcctgctgataggcggagcccatgacgtcacccagcaagaccagcacgatcgagggcgggatgatctggccgagcgtgcctgccgcggcgatactgcctgtggcaagacgcgggtcgtagccgcgcttcagcatggtcggcagcgcgatcagacccatggtcaccaccgtcgcgccgactatgccggtcgatgctgcaagcagggcacccaccaccgagaccgagatgccgaggccgccgcgcaggcggccgaacagcagacccatcgtctccagcagttcctcagcaaccttggatcgttccagcaccacgcccatgaacacgaacagcggcacggcgaccagcgtctcgttggtcatggtgccgaagatgcgctggggcaggaaactgaggaacgacaggtcgaagacgccgagggcgttgccgacaaaggcgaagatgatcgatacgccgccgagcgtaaaggcgaccggaaagcccatgagcaacgccccgaccaggacgaggaacatggcgatgtcgagatagtccttgatcagcatggcgttacgcagccccgcccgtccgagacttgttggtatccgccaggccggcgatcaccaggatcgagcgtagcgccagcgccacgccctgaatgccgaccaggaccgtgaaggccaggatggtggttttgaacagatagacgccgggcagaccactggtctcgttggatgcctccttcaccgcccaggatgaggcgacgtaagggtaggcgacatcccagatgacgtagatgaacggagcgaggaagacgatgcaaccgatcagatcgaccatcgccttcttgcggggtttgcttcgccatagaacacgtcgacccggacgtgcgcgtcgtagagcagcgcatagcccgcagcgacgaggaacaggacgccgtgcatgatcaggatcgattcctgaaccgcgatcgcgccaacgccatagacgtagcgcatcagcacgattccgaactgcacgaccaccagcacgagagcaagccaggaaacgactcgtccgatcccttcgttcaccgcgtccacggcgcttgcaagcgctctgagggcgttcacggtgttccctcctaatgggttctttgtgccttcacaggcggctgctgggggagcgatcggccacaacccggccgaaacgtgctccttgtatagaagaagcgctctgaaattgcagtctttttgtcattttttgacagatcagcgcgcgttttcgttcctgcgaacgatccgacttaaagttcgccaagtcatcgacgcaagatgtcttgcagtcgtcgatttatgaaacgacgtttcaaagctcatccgccacggagcgtaaaggttgatcagtgatccatctttgtgccgcaatgtggaacgctgccgcccgtacaaaaaaacccgtgtctccgcggtgatgcaggcggtgacacgggctcggcttgtctgcggcacaacgggatgggtacgggccaaggcccataccctgcgcgacctcagaccgcgaacttcggacctgcggcccggatgttcagatagggctgctcagcatgctgctgccaggtcatgctgttgttgcggaaggtgtagtagctcttgacgatccgcttgaggatgtcgtcaccgccgccgctgagctcgttgatgaacgactcggcagcgtcacccagggccttgtagaccgggtcagggaaggggcggaccttcacgccgtgctcgttgatcagggttgcgaccgcagcggagttgcggacgatgaactgaccgacgccctcctggtagtcgctgtaggcggcctgacggacgatcgccttcagatcatccggcagttcatcccagtgcttcttgccgatgcccatctcgatggtggccgagggctcaccgatgccgggggtgtagtagttcttcgcaacccgatgcagaccgaaggccagatcgttccaggggccgacccagtctgccgcatcgacggtgcccgactgcatggcctggaagatttccccaccgggcagctgaaccacgttgcagccaagccggcggaagatttccgcgttcaggccggcggtgcggaacttcaggcccttcaggtcgtcgggagtgttgatctccttggcgaaccagccgaccgcctgcgcacaggtgttgaccgccgggaaagcctttacgccgaaaggtgcgtagagctcgtcctggagcttctcaccgtcgccgatcgcccaccaggcaaactgttcggcggcatagagaccataaggtgccgtggtgaagaaatggaaaccgggatgcttgccgccatagtaataagcggccgagtgatagatttccgcagccccctgctgcacggcatcgaaggcaccgaaagccggcaccagttcaccggcggcgaagaccttcacggtcagccgtccgccgctcatggtggtgatcttctgcgcgatgctctccgcggccgtcccgaggccggggaagttcttcggccacgaggtgaccatgcgccactcgatcttgccctgcgcgatggccggcgccgggaagttggaagcggcgacggcggcggcagcggcacccgcggcggccgatcccttgaggaacgaacgacgatccatcgatcggtctctccctgatgaattttttggcagcttttcgtgcgttttggtcggttgcccgacgtccccggatccggcggggggcggatcgccggcgaacgtagagatacccccgaaaccatcgccggtccggcccctccctggccgcgggtctccgccgcgatcaggccccggcccgacgatctgggggtagtataaggggtcatcgagtgaacgcaagctgacatggtgagattgggtcagtaatgttcacccaatcggatcaaggcttctgttgtgttgcgacgcaaaatacgatgatgcaatgcaatgcaaatcggtgccgagcacctgtccgacgggatagaaatgatctggcccttgcgcctttaccaaaaggaaacacgcaagggccatgactgccgtgcgaagttcgcgcgtaggtatcagtcggtaaaggcgggacctttcgcccgcgcgttcagatagggctgctcggcatggcgagtccaggtcatgcagtcgttccggaagccgtaatagctggcccagactttcttgagcagatcgtcgccaccgtcgcgcagacgcaacatgatgctctcgccggctttggcgagtgcgtcattcaccgtatcggggaagggctgcactttcacgccgtgctcggtctgtagcgccttgagcgccgaggcgttgcgaataaggaactccgaaacattggcctgatactcggaaatcgctgcctcgcggacgaccgccttcagatcgtcgggcagggcatcccaatgtttgcggccgatgccgatctcgacagcaccctggccctcgccgataccgggggtgtagtagttcttcgccagacgatgcagcccgaaggccagatcgttccagggccctacccattccgcagcatcgatcatgccgctctggaaggcctgaaacatctcccgtcccggcagctggacgacgttgcagccggcttcacgccagagttcgccgttcagtcccgcggtgcggaacttcaaccccttcaggtcatccgggccggtgatctcgcgcgcaaaccagcccgcggcctgggcgctggtgttggcggccgggatggccttgatgccgaacggggcgtacagttcgtcctgcagcttttcaccgtcgccatacagccaccaggccatgtgttcgggcgcgtacatgccgaaaggcacgctggtgtaaaagttgagcgcggggtgcttgccgccgtaataataggcggctgaatggtaggcttcggcagccccctgctggactgcgtcgaacacgccgaaagccggcacgagttcatccgcggcatacagcttcacggtcaaccggccgccgctcatcctggtgattttctgtgcgagacgttcggctgtggtaccgaggccgggaaagttcttcggccaggacgtgatcaaccgccattcgatgcggccctcggcgatggccggggcggcgaaggtggtggcagcggctgcagcgccggtggcaacgctgcgcttgatgaatgaacggcggtccatcggccggtcttccttgcacggttcctgaaacccgatggacatacccccaacggtataccaccgggggacctgtctaggcccgggcgccgctgctgtccaggagcatctgcagaaaaatgatgcgccgcaccagatgatggtgcggcgcattcttgcgtttggcagacttgaagatcgggtgcggatcagccgaccgggatggggtcgaacttcgcccggagtgccaggtagccgccttcggcactgttgccataggtgcgggcatggtcgagataggtcatgtacgaggtccaggcccgccgggtcacgtcgtcgccgcgatcgcgcagttccagggcgaccgcacgggcggcatcggccagtaccttctggacctcgtcagggaaggtccggacctggacgccatgctcgttcttcaacaccaccatcgcctcggcgttgcgggtgaagtactcggtgaaggcggtctcgtattcggccgcgcaggcgctgcggatgatcgcctgcagatcttcgggaagttcgttccagtgcttctcggagacaccgagctcggccacggcgcagggctcgttggtgccggcgacgtagtagttcttggtgatgcgatgcaggccgaatgccagatcgttccaggggccgatccattcggccgcgtcgacggtgcccgactgcatggcctggaagatgtctccgggcggcagggtcacgacattgacgccaagccggcgcaggatttcggcgttgaggccggcggtccgcatcttgaggcccttcaggtcctcgaccgtcttgatttccttgttgaaccaaccggcggcctggacgccggtgttgatgcagggcagggccttgatgccgaaaggcctggtcatctcgtcctgcagcgcttcaccgccaccatgcagccaccagccatgggcttcccaggcggtcatgccgagcgggatggaggtgaacagggtcaggcccggattcttgccggcgaaatagtagctggggctgtgatagcactcggcagcgccctgctggaccgcatcgaaggtcccgaaggccggggcgagttcgccggcaccgaacaccttgatcaccagacggcccgcgctcatcgccgcgatgcgatcggccagccgctgggcagaggtgccgacacccgggaaattcttcggccaggatgtgaccatgcgccattcggtgcgcgactgggcaagcgcgggtgccgcaaggccgctggcggccacagctgtggttgccgcggcggcgacggcgccaccgcggaggaaggaacggcgattcattttggacgggcctccccacgtggatgctgttcggcccgctgccgacggccaccgccgcgctctcccgatgcggtgggacctggatctgccggtgccgggccgatgggcgcgcataccccgtctgcgggacggacgagccgcgcgaccattcttggtcgccgattataggaggcgtgcgccgaaagtgaataggtcaaccatgcgttcgcgaatacgaccatgcacgcggcatgctttcgccaccgctgcgtgccgcggtcatagcgtgaagggcgaacagtcttcgatggtgtcgaataccggcgtcatgcctgacggggcaggggcacccaggcgccatcgaccagggcttccatcggggcgaagcgggccttgtaggccatcttccggctctcggcgatccaatagccgagatagacatagggcaatcccaactcgcgtgcgcggtctatgtgccagagcacgatccgcgtcccgaggctgcggcgtgccgcgtcgggatcgtagaatttgtaaacggccgagagcccgtcgcgcacccggtcggtcaggcatacggcgatcaactgcccctcttcgccccggaattcgacaacctgggtgtcgatggggctttcttccaccatcatgcggtaatcatggaaggtcatggttgccatctcgccatcggcgtgacggcttttctgatagcgcaggaacagctggtactgctcctgcgtcgccgtcaggggcacgatggtatgggcgagatcggcgttccggcgcaatacggtccgctgactgcgggtcggctccatacctgccacccggatgcgcaccggcacgcaggccgagcatccggggcaggcgggccgataggccatgtgctgcacgcgtctgaagccggagcgcagcaaccagtcgtagaaggactgggcgttgggcacattcagatccgccacgacgtcccgctccagccggccttcgatataggggcacggatgggcgacggtcatggtgaacagatgctgcgcccgatgcggccactccctcatggcgatctccgaaggcgggagcacgcgcggcgtgtgacgcgcgttcactgacgataactatagcagtcgcttccaccccggaccaaggccccgcgggggccttacatctgaagagagccgctctcgctgatgtcgtgatccaggcgctgaacttccagcccttctttttcgagccgggcgatcagttcacgagcatggtccgggccgcgtgtctccacgaccaggtcgacctccaccgccttgatcggcacatgagagaaggcgcgttgatgataaacctcgaggatgttggcgccggcgtccccgatcagccgggcgatcagcgccagctctcccggccggtcatacgaaatcaccctgagccgcatgaccttgccgtcccgcaccaggccgcggagcaggatggaggacaggatccgggtatcgatattgccgcccgagaccacgaggccgaccgtgcggcccacgaagcgctcgtgatgcgcagggtcgagcagggccgcgaggccgacggccccggcaccctcgaccaccgtcttctcgatctcgacgaacagctgaaccgcgcgctcgatggcggtttcgctcaccagcagcaggtcgtcgacgcagtcggcgatcacctgccgggtgaactgtccggggctcttgactgcgatgccttcggcaatggtcatgccctgggcggccggaacctcgcggcccagcgcctgcaccatgaacggatagcgatcggcctgaatgccgatcacctcgatctccggcttgagcgccttggcggccgcggcgcaaccggcgatcagcccgccgccccccaccggtaccagcatcacgtcgatatccggtgcctgttccagcatttccagcgccaccgtaccctgaccggccgcgatcaacggatcgtcataggggtggacgaaggtgaggccccgctcggccgcaagcgaatccgccctggcgcgggcttcttccagcgtgtcgccttcaagcacgacctctgcgcccagtgcgcgggtgtggccgaccttggtgaagggcgtgaagcggggcatcacgatggtggcgggaatgccgagcctgcgcgcctgaagggcgacgccctgggcatggttgccggccgacatggcgatcacaccccgcgcccgggtcgcgtcatccagggcgagcatgcggttcagcgcgcctcgctccttgaacgaggcggtgaactggaggttttcatacttgcagaccaccttcgcgccggtgaggtcgctgagcgttcgggaggccttgcagggggtgcgctcgatcgatccggcaaggcgggtggccgcctctcggatctggtcgagcgtcagcagggtggaggctggcacgtcgggggctccggtacagggcccgtgccgcgtccggtcagttggccggtgcggtcgcgggcgccagggtcagtcgcttcgtcccggccgcggcgtcgatccgcgaccagtcggtgatcatggggatgaagcgggtctcggtccagcgcgatgcgaaggcatcatagccggcggagagcggattgccgctctgtccggtgctctggatgaacatagagcgctgcgggtcggcaagatcgtagatcgcgcgatagccggggccgtgggtcgatcggaacatctgcggcccttccggtgcatcggcagcccagcgttgggcgttgacggtgaacggatcgccgccgatcggatgcgagatggcgagcacgtccttgagcaccggcacggccgacagcacccggttctctgagactgccggatgcgccttgccccatgtccaggttgagatgtcttcaccctgggtacggatcagcagggctatcgcgtcatcgagcgcgcgggcgatctggacggcgcagctctccgtttccgtggtccgccggtcgtcgcaccagaccgggtcgcgggtcagcgcgacccgcaggaattcggtgcggtggccgcgatagtcgccgaacagatcgtcgcccagttcgtcggctgcgatgcgcggcagcagggcgtcataccaggccgagaagatcagcggtgcggtctgatcggccgccatgtcgccgtcccagcgcttcaggatatcgagcgcctccgcggcggccgggtgctcggggctggcatcgcgaatgccggccatcatcagcggcatgaactggcgggccatcagggagacggtatcgcccatcatcgaacggaagctctcggtatcgtgcttgtccgtctcgtcgagcatctggtcgatgcggtcggcgcgatagggggccgtccattcccggctgatgaaatagggatagccctcgggcgtgatccgctgattggcggtgacgatccggccatcttccgggttggtcagctgcggcaactcgtcatagggaatccacccggtccagtctccctcgccggtccagccgcggctgggaagaaagccgtcgcccgaggcccggatcggcacgcgggccggcgccagataggcgatccggccgccggtgtcggcgaagacgatgttctgctgcggccagtagaagtcgcgcagcccctcgcggaagctggggaaatcggtggcggtgttggcggcgaaggccgcacgcagggtgggatcgtcatcggtcagcgccacccagcggaaggccagaacatggcgtcggtcggtcagttccccgccgccattgacgacatcggtcacgatcgggccattgcggctttcgcgcacggtgaagctctcgggctccgcccccttgatctggatggtctcgctgcgggtggtgaaggccagggggccatccggtgtttcgtaagtgtcggcgcccggcgccgtcagctgttcgatcacgaaatcctgcgtgtcgggaccggtattggtgaagccccaggcgaaactgtcggtgcggcccagcatgacgctgggcaggccgggcagggtggcgccgatcacctccaggccgggcgccgagagatgggcgaggtaccagagcgacggcgcagcgagccccagatgggggtcgttggcgagcatcggcttgccggttgcggtgtgggcgcccgacagcacccagttgttggacccgataccgtcgatcggcggcgtggccccctggtccagcagggttgcgaagggcgttgcggcatagatcttcgtcaacgcgtccagatcggtaccgaggccggcgatttccggcagggcgacattgccgtcggcatcgtagtccggccagagatccgagatctgctccggcgtgatgccggctgcaagcatgcgggcgcgcagcagctcgtcgcgccagttcttggccaggtcccaggccatcatcttcagccacaccatcgaatcggcgggcttccagggcgtcggcgtgatacccgtcagcacgaattccagcggccaggcgccgtcatgactggcgatataggcattcacaccggcgacataggcatccagccggcgacgggtctgatcgtcgagcttttcataggcccgttcggcatggccgtagacaccgatggttcggatgaagcggtcgatcgacagcgtcgacttgccggcgaattcagacagccgccccgatccgacccggcgctgaaactccatctgccagagccggtcctgggcgtggaggaaaccgagggcgaagaccgcatcctcgatgctccgggccttgatatggggcacgtcgttctcgtcacggatgaccgtgacctcgcctgaaagcccttgcagggcgagccgtccctcggtctcgggcaggctggtgcgcagccagatcacgccgatcaccacagcggcgatcacgatgaagacgagaccgcccagaattcgaccgatccagcgcatgaagatccccgcctcttgccgtcagaacgccgcggaatccgtgccgcgtcacggcggcagtctgatggaggcggagctttggatcaacctctgcgtcacatggactgaggaagaagagtggatcgatggtcgcggatccgcaacgtcatccccatatgatgcaggagagccatgaccttcgccccccagatcaacgaggagcagaaccggatgtcggacctcttccccacccgtcgacgcagtaccccgggccgttttccggatgtcgatacgatggtgacgcggctgaagcccagctatccggtctattgtttgaaaccttcgcggctggccgatgccgcgcgcaccttcatcgaaggttttcccggcgaagtcctttatgcggtgaagtgcaatcccgaacgcgctgtcatctcaacgctctatgaagcagggatcgccggcttcgacgtcgcctcgctcgccgaggtggcgctggttgccgatctcttcgaagaggcggagctgcacttccatcatccgatcaagagccgggcggccattgccaatgcctatcgggtctatggcgtggaacgcttcgccgtcgatcacgccgacgagctggccaagatccatgccgagacccgcggcgggccggtggtgatgatggtgcggctgaccaccgacagcagccgcagcacctatgacctgtcagccaagttcggcgcctcggtgcccgaggcggcggcgatgatgcgcgaggcccatcgcctgggccatcaggtcgggctgtatttccacgtcggatcgcaatgtccggatccgcaggcctatgacgaggccatggcggtggtgcgggcggcgatggatcacgcgccggaagtgcccgtggtggcgctggatgtcggcggcggcttcccgggacgctatgacatgggtgttgagatgccgccggtcggcgactatttcgccgccgtccgccgggcgctcgataccatcccgccgctgcccggccggcgcattctgtgcgagccggggcgtgcgctggtggctgacgggctgtccctggtggtgcaggtgcatctgcgcaagggcgaccggctgttcatcaatgacggcatctatggcagcctgtcggagaccgtgaccggccagctgcgcttccccgcccgcgccatccgcccggccgggccgctggatgcagagcgtcagcccttcaccatcttcgggcctacctgcgattcgaccgatgtgctgccggcgccgctgctgctgccgtccgacatccgcgagggcgactggatcgagatcgatatgatcggggcctattccaacgcgctcgccacccggttcaacggcttcctgcccgaagccgtggtcgaaatcggcgaacccgccgcaagggcggcgggttcggtgttgcggcgggccgaggcggtgcttccggtcacttgaccgacagctgcgcctccagcggcccgcccggcaggccggtatagaccgcgcgcacgacctggccttctttcagcggcagcggccggctgatggcgcccagcgtgatcagatcgcccggcttcaggctttcgccgcgggccttcagatggccgatcagccagaccagggcattcaggggctggcccatgatggccgaggaccggctctcgacgatcagcccgccatgaccgtcgaggaccttgacctgcatctcggccatggcggcaacgaattccggtgtgggctgaaccggcaccgccttgccgaccacgccggtacgcatgccggcattgatcatcgcgagcgtctcggcgttcagtggctcgcctgaggccagcagcaggtcgggaacgtcgatataggccgagaccgtggcgagatgggcggccacctccagcgggttggtcgcctgcatgatgccggcatccttgaccgtaaccgccagatcgacctcgaccgtcggccgcgcgccgacgtcgcgcggcacatcggcaccgttctccaggatctggccggcgaagatccgccccaccaccggggcgcgggccccgaacatctcctgcgtggtgcgggccgtcagcgtcagcttccagccgagctgcgccggccgcgacggcatggcggcagccaggaagcggtcctgggcggcgtaggcctgcgcaagatccggcttcacctcaggcgccttgggctggatccgcgccagccaggcccggccgagacgttccgcctcttcggcgaccttgggtggaagggcgacggaggcgggccgtgtcgcgggctgcggctcacctgccggttgcgacaccccgggtggggttggcgccgctggggtggtgggtgccgcgggtgcctgcgggacaagaacccgcggtcccgactgctgtgccacggcgggcagggcgaggagggcggccacaaggctggttgcggccgccatggccggaagacggaacgagatcggcacctggaactccggaaaccgtcagggaaaagagaaaggccgtgcgatacggttcagccgttcagcttcgccgccacgtcgcgcgcataataggtgagaacaccagcggcaccggcccgcttgaaggccagcaggctttcgaccaccactttctcgccatccagccaaccgttcgcaatcgctgcctgaagcatcgcgtattcgccgctgacctggtaggcgaaggtcggcacgccgaattcctgcgacacccgctgcacgacgtcgagatagggcatgcctggcttgaccatcaccatgtcggcgccctcggccaggtcgagcgccacttcgtgcagggcctcgtcgctgttggcggggttcatctgataggtacgcttatcggcggcgcccagattctttgccgagcccaccgcatcccggaagggcccatagaaggcagaggcgtatttggcggcataggccatgatgccgcagccggcgagcccgtcggcatcgagcgcgtcgcggatggcggcgatgcggccgtccatcatgtccgacggcgcgatgacgtcggcgccggcgtcggcctgaaccagagactgccggcacaacatgtcgacggtcgggtcgttcaggatctggccgttctcaacgatgccgtcctggccgtggctggtatagggatcgagggcggcatcgacgatgatgccgatatcggggacggcatccttgatcgcccggatcgcacggcaggtcaggttgtcggggttggccgcctcgcggccgtcgggggtcttcagcgcctgatcgatcgagggaaagagtgccacggccggaacgcccagatcgcgcgcctcacgcaccgcagcgaccgcgcgatcgatcgacagccgttccaccccgggcatcgaggcgaccggctgcgcgaccccttcgccatccactacgaaaaacggccagatcaggtcgtcgggcgaaagccggttctcggcgaccagccggcgccaccagtcggtccggcgattgcgacgcatgcgggtgcgcgggaaacgtccgaggggggtcggtgccacgacacgatactcctgatcgaaagtccgaaaggctctgccggggccagagaatgcacccggccgggcccgacgtaaaccggatgccgctgcgccgcggtaaaatcgcccggcggggcgtgcatcgtggccgcattcgggtgaaattgacagtcacccggtggcctctatgatgcccggcatatcatggcctttgccatggccgcgggccgatcccggttgccacgccgccggcctcgtcaacacgaaggatcagaggaaaccagatgagcgacgcgcagatcctgttcgaccgtgccggttcggccggtatcatcaccctgaaccggcccaaggctctgaacgcgctgaccctgccgatgatccgcctgatggcgccgcagatgaaagactgggctgcggatgatgcggtggccgtggtggtggtgcgcggtgcagcgcgccccgatggccggcccgccttctgcgccggtggcgatgttcgcgcgctctgggacgagcgtgaggacccgaccagcacgctggcggctgagttcttcggcgaggaatataccctcaatcgcgagatcttccgctatgccaagccctatgtgtcgctgatcgatggtgtggtgatgggcggcggcgtcggcctgtcggcgcatggccgctggcggattgcgaccgagaacacgctcttcgccatgcccgagaccgccatcggcatgctcccggatgtgggcggcacctatattctgccgcgcctgcccggtctgtcgggcacctatctggcgctgaccggggcacgcctgaaggcggcggactgcctggcgctgggcatcgcgacccatttcgtgccctcggcgaagctgggcgagctgaccgaggccctgtcgcaggtgacggccggtgccggtgccgacgccgaggtggaggcggtgctgaaccgcttctcggatgcggctgccgccggcaccccgcagatcacccagcatctgcccacgatcaacgcctgcttcgcgggcgacgatatggccggtatcctcgcgcggctgccggtcgagggcggagaatggggtgcgggcgtggcgaaggagttgtcgcacaagtcgccgaccagcatggtgattgcgctccgccagatgcgcatcggcggcaacctgtccttcgaggactgcatgatcaccgaattccgtgtggcgacccgcatcgtgcggacccatgatttcggcgaaggaatccgctcggtgctggtcgacaaggatcatgccccggtctggtcgccggcacgtgtcgaggatgtcgacccggcagccatcgacgcgctgttcgcgcccctcggccagcgtgacctgcatttcgactgattttgcgtcgattctgcgtcaaaatgaatggccgcaccggcgagccggcgcggccatcttgacttcggcgtcgtggtcgagatgatcgcctattggactgcaacgccggcagagagaccggcgaaagcaggacgttcgtcaaagtaaacggccccgctcatggcggcacgggcagcggaccggcgacacccgcagccccgacccatggcctgaactcccgccgggcaacgccgaggacaaggtgcgacagtcttatctggagacaattcgtctgatcgagcggcttcaccgccgctttctcgacgtgatcaaggccgagctggatcgtctcggtatcagcgacatcaacaacgtccaggcactgatcctgtcgaatatcggcgaggaacagctcaccatcggcgagcttaccgtccgtggctattacctgggctccaacgtgtcgtacaacgtgaagaaactggtcgagaatgaatatctcgaacaggaacgctccccgcacgacaagcgagcgatgcgcattcgcctgactcagaaggggcgggatctttgcgaccgcgtcaatgaactctacgagcgcaactgcacagccctcgccaagggcgtgctggaggccgatgatctcaccgaggtgaatgagagcctgcggacgctggagcgggtctggtccgactatatcaattacggccggttctgagcctggccgcataagcgacgaccgccaaagagaaaagggcgccctgcgaagcgggcgccctttctcgtggttcggccgaaggtccggcgctcagaggccgtcgagagccggcgccagatagcccgacagcgtcatcagcgacacatgtacgccacgattgtagtaccgggtcgggaaggggcggctctcgatgtcatcccaccgcacgccgtcattcaacggccggcccttgcgggcgatcgaggacgaccaggtaccaccgccatagatgacggtgggataggtcatggggtggctgtcggtgaagccggcgccgcgcaggcagcgatggatctccttcaggcggccctgatggaagagcggcgattcgctctggaccaccaccatgccgccatcggtcaggatccggtggcagtcggcatagaaggcggcaccgaacagcccctccgccgggccgaccggatcggtgctgtcgacgatgatcacgtcatagctgccggcggctgcgttccgcacccaggcgatgccatcctcgaaacggatcgatgctcgcggatcattgttcgacgccgtcagctcggggaagaatttctccgacacccggacgacgcgctcgtcgatctcgaccatgtcgacctgctcgatcccgggatggcgcaaaacctcgcgcaggaccccgcaatcgccgccaccgatgatcagcacccgccggggccgttcatgaatgaacagtgccggatgggccatgacctcgtgatagaagaactcgtccttgtcggacacgttcacgaagccgtcgagcaccatggccgtgccaaaaccggtggtgcggaacacctccaggcgctggaacggggtccgctcggcgtggaggacttcggccacctgcagactgtactggaagccggtgccggccatgcgttcagtgaaccacagctcgctgtccgccgctgcgatgatcttttccatcttgtccgatacctgagctggaacgtcggaaagggcgggtgaccgggggtcagccgttgacgaccttcttgggcgcttcgacaggcacgcgaccggcaagcatcgcctgatggccgcgctccagcgacatggtcgagaaggttcccgacttcagcgcttcgcgcagatagtggaaggcctgttcggtgtgcaggctgtcgccgcaggtgaacaggtccaccgccgcatagccgtattcgggccaggtgtggatggccagatggctttcggcgatgatgatcgcaccgctgacacccagcggcgagaaatgatggaaggtatgggtgacgatggtcgccttggcgcgcttggctgcctcgagcatcgcatcggtcacgtagtcgacattcgccagaagatcgccgtcgcagtcgtagaattcagcgatgatctgatgtccgagagccttcacggcacaccccccttttcagagaaggtggcgatccaccccaggtctcacgccacagttcgttacacacccaagaggacgaaagccgggccgcccgatcttcacacgatcggaacacggtccggccatcggaacgggtcaccggcattgcctcgtgcccggataaagtggctggaacctagggatggggggagggggtgtcaaccgaatttcatgtgacgatcattcccgatcgtcgcggatgcgacggacgcacgggcgggcacgaggttatgctgtcaggcagaggtccgcatggcggcgatgacggacctttgcatgtcagacacgatgccgcgacaggaggagacgaccggcccaatgtctacaagattttatgatgatcgcttcacacgtcgtcgcatcaccgtcgacgacgggaccggcatccatctggtcgaaggcggcgaggggccgcccctgctgttgctgcatggctaccctgaaagccatgtgatgtggcacaaggtggcgccggcgctggcggcgcatttccggctggtcattccggatctgcgcggctatggcgacagcgacagaccggccggcgacgcggcccatgcgacctattccaagcggcgcatggcggccgacatggcacaggtgatgaccgcccttggccatgagcggttctcggtcgcgggccatgatcgcggtgcccgggtgacccatcggctgctgcgcgatcaccagcagcggatcgtgaaagcctcggtgatggatgtggtgccgacgctcgacgtctatgaggcgacggacatcacggtggccaccagctatttccactggttctttctcatccaggagggcgggctgccggagcggctgattgcgggcgatcccggcttcctgctcgactgggcctgcgaccggctgtgcgtcgacccggcggcgatcggccccgaagagcgggaggaatacaagcgctggttcgttctgcccgaaaccattcatgcgacctgcgaagactatcgggccggggcgacgatcgatctggagcatgatcgggcggatcgggatctgaaactgaccgtgccgctgctggtgttgtggggcgcgcatcgcctggtcgggaaacgtttcgatccgctggcgatctggcggagttacgccgagacggtggagggcgaggcgctcgactgcggtcattttctgccggaagaggcaccggacgaggtggcccggcggatgatcgctttcttcaccacataaaaaccagccggacgccatgtgtcccaagcttgtcccttgagccctgccgcgggcgatgcccatgatgaggcattcgcccgtgcaaaacatgcagggcatcaggggaccggccagaccatgagcagacgtgaccgacacgccgagagcgacacagccgagcgaccgcatggtggcgggcggctcaggcgctatttcctggccggaattgtggtgacggcgccgatcgccatcaccctttatgtcgcctggtggtttatcgcctttgtcgacgatctggtgctgcgtttcgtgccgccggcttaccacccggaccagtacctgccgttcagcattccgggtgccggtctgattgtggtcgtgatcggcatcaccctgatcggcgcctttgccgccggtctggtcggccgcgaactggtccggctgggcgagggcatcgtggcccggatgccggtgttgcgcagcatctatgcggccctgaagcagatcttcgagacggtgctgacccagggatcgcagtcgtttcgcgaggtggtcctgatcgaatatccccgccgcgggctctggtcgctggccttcatcaccggcaccaccggcggggagattcagcggctgaccaaggcgcggatggtgaacgtcttcgtgccgaccacccccaatccgacctcaggcttcctgctgttcgtgcccgagaccgagatcgtccgcctggcgatgaccgtggaggaaggcgtgaagctggtcatttcgggcggtctgatcacgccgccggatgcggcagatcctgaagcgcgggcaccagctgtgccgcgcgtgaccgagtgacgcgagggacttgataaacccgatgggaatgcgcatgtttaacggatcatgatgcatttcggcgttcatcatcggtccgcctgcctgttgcgcggcggcaatctcgtcacgggctgaccgcccggaccgttcgcgtccgttgacccggcgcccggtccgggtgcctgcgccgttgcggcgccgtggccatgtccgcattcgggacatgggccacatccacaaaccggaaacgtcgacccgcccaggcaaccgaggtcacagtctcggggcatggggcgccgccgcccggtctacctccctcgcgacgagagagccgtcaggatgtccgcccgtcatgatccgtcacggggccccgaaaaccgggccaccgtgatctgcttcgtttgtcatcgtgccgtgggggccgatgacttccacagcgatggctgccccgtttgcggggccggccggcatctgccgccgatccgcttgctgccggacgatgcccgccggcttgccgcgcttgccggtcggctggtgacacaaaacccaccgcttgtggcggccctgacccgtgaactggcccgtgcggtgatcgtgcgcgatgcgcatggcgcctggggaactgcacggatcggcgcagaactgcgtttccgccttgatggaagcgcagaacccgtccgccggcgtctccatctgcccgagacggcggggcaggccgcccagggcttcgatctctccctcgcaacccccctcggcatcgcactggtcgggctggccgcgggcgcggtcatgcccttcaccgacctctgcggcactcgacgcctcgtccggctggacggggtgcgtgacgccgcctgaaccatcatccgaaagaaacggagacaacatcatgatgaccaatgaaaaccttcagcacgcaccggccattcccgcccagccaccgccggtgatcctgggcgaaagcgattacgaccggttgagcgcgctggccgatatggccgctgtggaacccggcagcgccgtcgccttccttgccgccgaactcgatcgggcgaccatcgttgccgatgacgaactgcccggcgacgtgattgcgatgcaccgccgcctggcctatcgcgccgatgacggcgccgagcatcaggcgatgctggtcttcccccgccaggccgacatcgcggccaaccgggtgtcgatcctgaccccggtgggggccgcgctgatcggcctcaggaccggggcatcgatcgcctggcgcgaccgtatggggcgcgagcgccatctgaccgtgacggcggtcggctgatcagccggagcggagatagcgcacggcctgatcgcgctcgaacaggtagagcagggttctgagcgcctggccgcgcggcccgtcgagttccggcgtgcgctcgatctccagccgggcctgtgcctgggcggtctcgatcaggtcggcatgcagatcaagatcggcgaaccgcatttccggttcgccgctctgcttcgtccccagcgcatcgccggccccgcggagcttcagatcctcctcggcgatcacgaacccgtcctccgtcgcccgcatcacctccaggcgcttgcgggcgatttcgcccagcggggcggcgtagagcagcaggcagctcgcctgatcgtcgccccggcccacccggccgcgcagctggtggagctgggcgagcccgaagcgctcggcgtgctcgatgatgatcaccgtcgcatccggcacatcgacgccgacctcgatcaccgtcgtcgccaccagcacatcggtccggtcatcggcgtccctggcgcggaagcgggcgatggcggcgtccttgtccgcgcccttcatcttgccatggatcaggccgacccgcggccccagctgatctaccagatcctcggcacgggcgctcgccgccgacagatcggctttctcagagacgtcgaccagggggcacacccaatagactttgtgaccctcgtcgatggtccggcgcacggcatcgatcacctgatccatgcggtccatcggcagcacccgggtctggatgggcttgcggccagcgggcttctgccggatccgcgagacatccatatcaccataggtggtgagcgccagggtccgcgggatcggcgtcgccgtcatgaccagggtgtccaccccccggcccttggatgagagctgcaggcgctgatggacgccgaagcgatgctgttcgtcgatgaccgccaggcccagatcgcggaaagccaccccctcctggaacagggcgtgggtaccgaccaggatgtcgatctccccggcctccagtgccgccagcacatcccgccgcgccttggcccgctcgcgccccgtcagcaggccgaagcgcagcccggccggggcgccgagcttcgccagcgtttccatgtgctggcgcgcaagcacgtcggtgggcgccatcagcgccgcctgcgcccccgcttcgactgcgatcgccatggcgatcagcgccaccaccgtcttgccgctgccgacatcgccctgaagcagccgaagcatgcgcaggggccctgccatatcgccggcgatctccgacaggacctgacgctgatcctgggtcagacggaagggcaggccggcttcgatcggccgggtcagccgcccgctcccggccagatggcggccggccgcccgtcgctgacggttgcggaccagggcaatcgccagctgattggcgaagagctcgtcataggccaggcggcggcgggccggatgaagcggtgacagatcatcggcatcggtcggggcatgggctgtggcgagcgcgccccgccagccggcccagccttcacgggcaagcacgccgcgatcgatccattccggcagctcgggcaggcgggaaaccgcgaatttcgcggccttgcgcagcagcttgggcgacagaccgtcggtgccgggatagatcgcctcgaccgtctccacctcggcccgcttctcgggcgggacgatatggtcgggatggggcatctgcacctcgccgccatagcgttcgaccttgccgctgacgatacgaacctccccgtcgggcatgagccgccgccagtcggcctcgcggccgtggaaaaagaccagggtcacgcccgtgccgtcgggatccgcgcaccgcacccggtgcggctggcgcgggcgttcggccggctgatgttcaaggatggtgagcgtgaaggtgacgatccgtcccgctggtgcgatcacggcgggcggcgcgtaacgcctgtcgaccacggagatcggcagcgtgttgatcacgtcgatcacccggttgccgcgtgcggcacgctccaccagtttaagcacgcgcgggccgatgccgggcaggctggtggcttcggcaaatagcgggaagagggcttcggggcgcatctggtccggtcaacaggcacggtcgggcgtggtgggcgcatcgggcgccaacgataggggcggggccgggccgtgacaagctgcatggccgcaaggccccgaagccgcgccggggggtgacagcgaagggcgcgcgggctatatcacgggacgcagacgacaagcaggaagggcaccagctctcatggccgaagacctcgaaatccgtcgccgccggctgcgctatcagagctggtatcgcgggtgcaaggaaaccgacatcctgttcggcaaattcgccgatgcctggatcgaccgtttcgatgccgaccagctcgatgccttcgaagcgctgctcgacgaaagcgatgtcgacctctacaactggttgagcggccgcgagcctctgcccgaagatctggcggacaacccggtcatgaagatgatgatgcagttcgacgtggcaaccgcgcccgatcgcggtctggccgagggtggcctcggcggcgcttgagaactgacctctgagatcgggcctccaagaccggggccccgccggaacctctccattcccgccaacctttcacgccccagaccgtttcgaatgaacgacgtcgccgcctcgctctggtccttttcggggccggtccttcggggacggaggacgcgcttgaaggatgcgacgcccgtgctgatcgatcccacgcttttcgaccgccccggacgcatcctgctgaccgaggcgcccgacggtctggtctggcagctggcggcagagttcgcagccggcagaccaaagcgtgatctggttctggtgatgcgtgacgacgcccggatggcggccgcggccgacgcgctgaaagttcatctgcccgaagcggaggtgctgcgcctgccggcctgggactgcctgccctacgaccgggcgtcccccaacggcatgatcgccgccgagcggatggatacgctgaccaggctggccggcggcccggcggcggacgacccgaaggcggggacgggaagccggccgcgcgcgatcgtcgtcaccacggtcaatgcgctggcccagcgcgtgccgccgcgcgagagcctggcactggccaggcttcggctggagccgggacaccggctgtcgacagagcgtctggtcgactatctgacgcataacggttatgtccgcgccggcaccgtgatggagccgggtgagtttgccgtgcgcggcggcatcgtcgacctgtttccggccggtgagccggacccggtccgcctggactttttcggcgacgaggtggaggcgatccggaatttcgaccccgtcacccagcggtccaatgcccgcatccgccggctggatctgaagccggtgagcgagatcctgctgaccgaaggggtgatccagcgcttccgacagggatatcgccaggctttcggcgcggtcggtaccggcgacccgctctacgaggcgatcagcgccgggcggcgccatgccggtatggagcactggctgccgctgttccacacccatctggagccggtgaccgcctatttcgaccgtccggtgatggtgttcgatcatctggccgatcaggccttcaccgaacggcgcgtgctgatcgaggactattacgaggcgcggcgcacggggccggtgtcgatcatcggcggcgagcgcgaggccccttaccgggcgctgccacccgatcagctgtacctgaccgcgaaggaatgggccgaaatcggccgcagcgaaaccctggtcgccgtgcagcccggtgctgcggagcggccgctcgagcagggctggcaggcggcgcggcttgccgggcgggctgcccgcgacttcgcacccgagcgcaaggacgaggacgtcaacctcttcgaggcgctgaaggcccatgtcgatgccgagcggtcggccgggcggcgggtggtggtctgctgttacagcgccggctcgctcgaccgtatccggacggtctttgaagatcatggtctgaagcagctggagcaggtggagacctgggccgatatcgccaaggcgaagccgggcgcgctggtgctgatcgtgctgccgctcgaccacggctatgttgcgggcgatctttcggtcctgaccgagcaggacattctgggcgaccgtctgcaccgcaagacccgccgcaagcgccgggcggagaattttctgcgcgatgccgacagcctgaccgtcggcgatctggtggttcacgtcgatcatggcatcggccgctatgaggggcttgagaccatcaccgccggcggcgcaccgcatgactgcgtgctggtggtctatgaaggcggcgaccggctgttcgtgccggtcgagcatatcgacatgctgtcgcgctatggcaccgccgacgggccggcgccgctggatcggctgggcggcagccagtggcagcagcgcaaggagcgcaccaagcggcggctgaaggacatggccgacgcgctgatcgcggtcgcggccgagcggcagctgaagggcgctgcccggatcgagcggccacaggggctgtatgacgagttctgcgcccgtttcccgtacacggaaaccgaagatcagttgcacgcgatcgaggatgtgatcgacgatctggcatcgggccggccgatggaccggctgatctgcggtgatgtcggcttcggcaagaccgaggtggcgctacgggcggccttcattgccgcgatgagtggggtccaggtcgccgtggtcgcgcccacgaccctgctctgtcatcagcatttcctgggctttaccaagcgcttccagggatttccgatcaagatcgtcgaagtgtcgcggctggttgcaggcaagcgcgccaccgaggcgaagaaggcgatcgccgatggtacggccgatatcgtcatcggcacgcatgccctgctttcaaagggcatctcgttccgcgatctcggcctgatgatcatcgacgaggaacagcattttggcgtgaagcacaaggaacggctgaaggagctgaaggccgatgtccatgtgctgaccctgacggcaacaccgatcccgcgcaccctgcagctggcgctggccggtgtgaaggaattgtcgatcatcgccacaccgccggtcgaccggctggcgctgcgcaccttcaccatgccctatgacagcgtcatcgtccgcgaagcgatcctgcgcgagcattatcgcggcggccagaccttcttcgtctgcccgcggatcgagcaggtcaaagaggtggaggaacggctgcgcagcctggtgcccgaggtcaagatcgcggtcgcccatggccggctggcggcgggcgagctggaagacgtgatgggcggcttctatggcggcgaatacgatgtgctgctctccaccagcatcgtggaaagcgggctcgacattccgcgggccaatacgatcatcatctatcgtgccgatcttttcggcctggcccagctctatcagctgcgcggacgggtggggcgcggcaagctgcgcggctatgcctatctgatgctgcctgccaatcacggtgtcacccgcaccgccgagaagcggctggatgtgatgcagaccctcgacagcctgggcgctggcttcaccctggccagccacgatctcgacatccgtggtgccggcaatcttctgggtgaagagcagtcgggtcatatccgcgaagtcgggctcgaactgttccagcagatgctcgacgacgcgatcgaggcggcaaagaccggaggcggcgacgcccccgcacgggcgccggtgcgcgactggtcgccgcagatcaatctcggcgccgccgtgctgatccccgagacctatgtctcggatctggatgtgcgcatgtcgctctaccgccgtctggccgatctggacgagggcgacgagctggatgcgtttgccgccgaactggtcgaccgcttcgggccgctgcccgacgaggttcgccagctgcttcagattgtcgcgatcaagcggctgtgcatcgccgccggtgtggaaaaggtcgaggcgggacccaaaggtgccaccatcgccttccatctcgaccagttcgcccggccggaggggctgatccagttcattgccggccagtcgggcacgatccggctgcggccggatcataagctggtggtgatcagggcctgggcgaccgtcgacgaccggctgaagggggcgcgcgacctgatcgcgaccctggcccggatcgcccggaccgggaaggcggcatagaccctgccggagcaggtcgcgtccctgtcacgtctgcacctcaaaacggtcacacgccacgggttacgccaggccgacatccttcccatatgtgtgatgccttgagtttcatggcctgcagacacgatgtctgcaggtgcacccccatcgcgacaggaaaggacgtcagccatggcgaacgccgataccgctgccgggaaggccgtcgacaccgagatggaaaccctgaaggccgacctggccgccctgaaggccgatctggcgaaggtgaccagacaggcgggacgcacggccggcgtcggcgccgaggagttgggcgacaaggccaatgaagagatcagccgactgaaggcagaggtcgatcgcctgatgcatctggcgagcgagcggagccgcggtgcagtagccgccgccgagcacaagatcgaagagcggccgctgaccagcgttctggtggcctttggcgttggcctggtgatcggcaagctgatcgatcgccggtgaggggggatcatccgatcccttccgacctcccaacgacaccggagcctgcagccatgctgatgagacgtatcgaagcggcactggcgagagccggtgccgctgcaggcctctacggtttggccggcctcgtccttctgggcgcggccggctttggtgtggcggccttctacatctggatcgacggcatcacctggcatccggcctcgcctgcgctgtggacggggctgcttctggccgtgatcggcctgctgatgatgggggcgggccgcgtggttctgcgcgcaccgaggctgccagcgcgtcaacagccttctgccgccggatcttcaggccccccgggtgcggccgatgttgccgccatgaccggcgtggtctcggaactgatccgccgcaatccggccgaaggcgtcaccatggcagcgcttgcgggcgtcgccatcggcgcgtcaccggaaatccgccggcttctggccgatgccgcgcgcgcggcgctcgcgcccaagccgccctcggatgatcgtcagagcaggacctgacgcgccctgagcaacagggaatcggccgtgtccgacggctccagcgtcgcatggcccatctgcatccagatcggcgtcgtcggcagcccgcccagcccgtagtcggtggtggcgaggctgccggcgatcttgtgcagcgctttcatcgaccggtccccgggggtgtcgggcagaaccaccaccagagtggcatcatcagcccgcgccaccatgtcctcgacccggacaagccgtttcagggtctcggtggcacggctcatcaccgaccgggctgcggcgggaccgcggcgttcgatcagcagtgagagattgcggtacgagaccgtggcgatgctgagcggtttttcccacttcgccgcctcgaaaaccaggcgcgacagatggacgcgcaggaattcgggccgataggcgccggtttcggcatcgattgtcgagggtgcctcgagcgaggtgaagagatcggtcagacgtcgccggatgcgccgacggcgcagggcggacagtacccgaccgtgaagttcgtcgggcgggtagggacgctggatcaggtcgtcgatgccggtcttgagcagggtagccgcatcgggtgcgactgtggcatgaccgacagccagaaccggcacgtcgtaaagggccggcgtgtcgcgtacatgcagcgccagccccagccagtcttcgctgttgccaccgtcgaaggacaggatcagggtgtccaccgattgttcgtgcagaagctgggccgcttcggctgcgcctgccgttctgagcaggcgatagcgcgattgcagcagctccgccacatcatcgagatcctcgcccatctgggctgccagaagcagggtcggcggcccgtcattagcggtcgggcggcgcttgtccagttcgacccggaagctgcgcgcggtggcggtgcggcggcgcagttccgcctgcatgatgccgagacgcaccagcttggccatgcgggcagccaggaagccgagattgatgccaccggacagcagctcgtcgacaccgaccgagagcgaccgccgcctcagggccgatgacgcctgggtcccgatcatcagcaccggaatgtgctgggtgtcgggatcgttgcgcatcatgtcgacgaaatcgcagccatcgccatccggaaggcggtcgtcgatgatgataacgtcggtcagaagctgtcgggaaagacgaaggccctcggcgccggttcgcgcgctgaacagaaacatgttttgcgcgcgcaggccgtccatcacctgctgcgcggcgcgaggatcttgcatgacgaccaggacgcgcgcgatatgagccatgggcgccggagtctcccgtcgcgaaggatgcctctgccgttcccctgcgatcatccggcgccgagagcccgccggagtatcttgccgttcacgccgcgcggcagactgtcgaccagaacgaggtcgcggggccatttgtagcgggcgaggtgcttgccgacccaggcattcacgccgtcgagatccagttccccggcacggccgggtttggggaccacataggctgcgatgatggtcagcgcatcatcgaccttcctggggccgacggccacttcggcgatcgccggatgggcgctcaacgccgcctccacttcgatcggagagacccgatagcccagcacggtcatcacttcgtccgagcggccatcgtaccagtagtagccgtcgctgtcgacgcgcgcgagatcaccggtgaggaaccagtcaccccgccaggcggctgcggtatcttcgggccggttccagtagctgatcatcaatccgggctcgtcgcgatgcaccgcgatcacgcccacctcatccggtcctaccggatcggtccccccgtccagcggcagcacctggatccgccggcccggttgcggccggccggggctgcccagacggagcggcgtctccgggccactggagatgtaggtcgacacctcgctcatccccagcgcctcgtagagcggcagggacgcggcatcgaaccagcgatgggtcagggggggcggcagggcttcgccggcggtcagaccgtggcggagcgtccgcaggcgttcgggggtcagcgtgccgtatttcagcatctgtcgatagaccgaggggacggcagcgaaaatcgtcgcctccgcccgctcgatcaacagcggccagaccgacggatcacgcggcccggcataaagaactgccgtcgccccatgtgcccaggggtccatcaggccgacgcccagggtataggtccagttcaactggccggcatgcagcacgcgatcctcaggtcccatgccatgccagcccggccccatcggccggcggccccagacggcgcgatgggcgtggagcacgcccttggggcggccactggtgccggaggtgtagatcatcagtgcgggatcatgggccggcagatgcatcggcgccatgtcccggcgccctcgtatggcggcttccagccagtcgaggccgagcaggcgcataccgcccggatgcggaggtgcgatctccagcccgtcggcgacgaaggccacggcagcgccgcagtcgcgggcgatgaaaccagcttctgccggggtcaactgggccgaggtcggtacggcgatcagcccggcggccgctacggcgaaataaaccagggcgaattccagacgattgcccatccggatcatgatccgcgagcccggggccagatccagcgcgtgaagcgctgccgtcacccggcggacctgatcatacatctgtccgaagctgatctcgccgcgaataccagtatcgtccagcaggatcagtgccgccttgtcgggctgccgttcggcattccaggccagacagtattccgtgaggttgaaccgctcggtgtcgaacacatgctgcgccgcaggcatggccggcagggcggcggatgcgacgacaggcgaagcggcgaccagcccgtcggactggccggcaggggcagaggcggcgggggctgctgcgggcaccggggcaccctttacggaagcgtcactgatcatggcgctgagggtaagcccggacgcgcggtttcggaagtgccaaaaaacggccatcgaaacgtcgcggaaccggatgggtaccggtcacgaacgacaaccccccgctccgggggagcggggggcgaaggacattgatgatgtgaggatcagaggccgaggcgctcgccggtttcgcgggcctcgcggcggagcgaatcgaccacattctcgaccgaccggcgcagggcttccgagttgtgggcgagatgggcggtcgcatctgcaaccgaagtcgcagcttcggccgtgcgcccggcgccgcccgccacctctccgatggcggacgagatggtacgggtgccgtcggcggcctgattgacgttgtgcgcaatctcgccgatcgcggcgatctgctcttccaccgcactcgcgatggtggtggaggcctcccgcacacggccgatggtctcgacgattcgggcaatcgcgccgaccgcctgctcggtgtcgccctgggtggctgcgatgcgggcggtgatctcttccgttgcttttgcggtctgtgtggccagggttttgacttcagaggcgaccacggcgaagcccttgccggcctcgcctgcgcgggccgcctcgatcgtggcgttgagcgccagaagattggtctgcgatgcgatgtcgttgatcagctgcaccacatcgccgatctgccgggccgatccggcaagcctgcggacgatcccgtcggtgtccgccgcgcggctcgaagcttcggcgatgatgtccgaggcggtggtgacctgccggccgatttcgtgagccgacgcggtcagttcttcggtcgccgtggcaacggtctggacgttgacattggtctcttcgccggccgcggcgacggtcgccgaattggccgaggtcgtgtcggcgatgccgcgcatttcggccgcgccgcgctccagatcctgggcgaggccggtcatctcgtcggcaatgccccgcacttcgcgctccagggtgtcggcaagacccagtgtcgactcccgacgggcttcctccgcgcggcgttcggcggcagcctgggcaaggcgcagacgctcggtctcggcaagcgtgtcgcggaaattcaccagggcgcgattgagcccgccgatctcgtcgcggcggtccgtgccgggaatgtcgatgccggtatgaccttcggtcagccgcccgatgacgcccatcgacgccgtcagcggccgcttgatcagcatgatgacggtgatggcgagcgcgacgacgaccaggatgacgagaacgatgccgccgaggatcatgctgtcacgcacatccaccgatgctgcgcgcatcgagtcttccggaatgttgatgaacaggctccagggcttgtcgtagccggtgatcttcaccggcaccaccatgcggaagacgttcttttccagactgggagaccaggccacacgctccatgccgcgtccttcgaccacggcgcgggcatagtcggtgatgtcctcggtggtcagatccttcatcggccggccgcgcagttccggcttggggtggttgaccaccagccccgcatcggtgaacagcagcacattgccggtgccgaagggcttggtttcgttcagccgcttgttccagccgtcgagttcgatatcgacgccggcaacgccgatcggcttgtcagcgaccaggatcggcaccgatgccgacagcgtcatgaccttctgaccggcaatgtcatagatggtggggggcgtcagataggtgttcccggtgctcatcgggatctgataatactcggaaccggggccggtatagacggtcaggtggctggtattttcagtgccgccgatccggttgacatagctgatgaagcgaccggtatcgtccgaacggggcgtgttgcggaaggcggcatcgttcccgtcgagcgcatttggctcgaagcctgcccagacaccgagcagatgggtcttgtccgcaaaagtccggtcgatgatcgcgtcataggcaccgcgatcggtcgtgccattggccttaagtgcgctcagtgagctggcgagagatgcagcggtgcccacatcaagggcaagatcgcgcccgacctctgccgccagctgcttcgacagggtacgccccgtctcaagcgaggattcaagaaccctgttctccgcgatccgggtgaccgccgtaatcccgacagtcagcaatacggcgagcgctccgccgccgatgaggatgatcttcgatgaaagcccgagcgtgagacgcatacggtaccccgcgttcatgtcctgcctgtcccggccacacggatacttggctgcagccggcctgcacagcgttctcgtccattgcgaggtactttagacgaaatgtgttaatcaactccttcagttatcaatgaatctagacctatatagtcgaagtttattctgaaatacaaaaccggaaagagagttttgtattttgtggcgggcggaatgtgccctcatggaagccacggcatctccgtattgttcaagactgtgtgaatatcattggtttgcatcgatctttgggacgatcacggattgccggtcccgtcggcgggcggttatacctgccgcgcggatgacaggcccgacggagaaagcaccgatgtcgacacccattgaggatcctgtggccggtggctgttttgcgatcggcctcgaccggtccagcaagcccttcaacgccggtacgctcaaccggctggcggcggcgcatggcggatcctacaccttcacggccggggcggactggcaggcgagccggcattggcgattctgggaagaggccgccgccgccgaggccgcggcgccacggccgacggtaccgcaccttgccttcgaaacaccggccgccacggttttccccgagggcttcaccctggtggccgttgaactgaccccggatgccgtcgatctgccgtcgttccgacacccgtcgcgggcgatctatgtgctgggccctgagcgcgggatgctggcgccggagttcctggaccgggcggcccatgtcgtgaagatcccgatgcgcttctcgttgaacgtcgccatggctgcaagtctggtgctgttcgaccggctgcgctcacgcgaacggccggggccggtgcagaagctgaaccgtcgccgggcggaggcgaccatggcggccttcctggacgcccatcgcagcctgatggagccgccgccgccgccttatgccgattgaagcgggaccacgggatcagggctgcatacccagacgctccgccgtctcccgggcttcgcgacggagcgaatcgaccacgttttcaacggcacgccgcagcgtggtcgccgcgccggacagatggccggtcgcgtcggcgaccgaagtggcggcttccgccgtacgtccggcactgcccgccacctctccgatggccgacgagatggtacgggtgccgtcggcggcctgattgacgttgtgcgcgatctcgccgatcgcggcgatctgctcttccaccgcgctcgcgatggtggtggaggcttcccggacgcggccgatggtctcgacgatccgggcgatggcggtcaccgcctgctcggtatcgccctgggtggcggagatcctggcggtgatctcttcggtggccctggcggtctgggtcgccagcgttttgacctccgaggcgacgaccgcgaagcccttgccggcctcaccggcgcgggccgcctcgatcgtggcgttgagcgccagcagattggtctgcgcggcgatatcgttgatcaactgcaccacatcgccgatctggcgggccgaaccggcaagcctgcggacgattccgtcggtgtcggccgcgcggctcgatgcctcggcgatgatgtcagaggcggtggtgacctgccggccgatttcgtgagccgacgcggtcagttcttcggtcgccgtggcaacggtctggacgttgacattggtctcttcgccggccgcggcgacggtcgccgaattggccgaggttgtgtcggcgatgccccgcatctcggccgcgccgcgctccagctcctgggcaagttcggtcatttcgtcggcgatgccccgcacctcgcgttccagcgtatcggcgaggccgagcgtcgattcccgccgcgcctcttccgcccggcgttccgccgctgcctgggcaagacgcaggcgctccgcctcggccagcgtgtcccggaaatgcaccagggcgcggttgagcccgccaatctcgtcgcgacgatgggtgccggacacgtcgatcgcggtctcgccatcggtcagccggccgatcgtggtcatcgatgccttgagcggccgctgcaccagcagccagaccgtgactgcaagcgctgcgacgatcaggaccacgagcacgatgccgccgatcaccatcgcatcgcggatctcccaggatgccgcgcgcatggcgtcttcgcggatgttgaccaggacgctccacggcctctccagacccgtgatggcgaccggcacggcgttccggaaaaccatggcctcgacactgggcgaccaggcggtgcgctccagcgcctcgccccggcgaacggcatcggcgaaatctgcagcatcggccgacagatcggtcagcggcgccccgattttggacggatcggggtgggtcaccgtcagggcgccgtcggtgaacagcacggcgttgcccgcatccagcggatggatcgcgttcaggcgatcattccagaccttcagattgagatcgacgccggcgacgccgatcaccttgccgtcgaggcggatcggggcagagagcgagatggtctgcacatcaatgcccgcgatccgccggatcaccggcgggctggcatagggcttgccggtctcgaccggcgaccggtagaagccggcatccggtccgtcggcatagcccgtgacggcgccgagttcgcgggcccccttgacccggctgaaccgggtgaggtagcgcccgctgtcgtcggtgttctcctcgccctggaagaggatgtcctggccgtcgacggcattgggctcgaaagccgcccagacggcgagcaggtccgggtgctcggtgaaattccgttccaggacggcatcataggttgccctgctgctgaccccctgcgccttcagcgtctccatcgtgctggcgatgccgcgggcgatcgaaagatcgagggagaggcttcgcgcggcttcctgtgcgatctcacgcgagagggtgcgacccgactcgcgggagaggtcgagcacacgatcttcggccacccggctgaccgccaggatgccgatcgccagaagggctgcgagcgccccgccgccgatgaggatgatcttggcggagagcccgagtgagatacgcatgcgaaaccctttgggcgaagtggccgacgaacaccgagattccgaaggtatgccgagcttggttaatcaatcattactagaatcaagtttacatgatttgcgtaaaagtgctgcatcatgcaaaccggttggaagatcccggatcgtgtttccggaggggcaggataagaagtccgggtagcgatgcccgcccggccgggtcgtcctgaaggccgatgttcatcgcgtcatgcccccctgccggcgccgtccgggccagccccgacagccggtcccagagggtcagcagaaaggcgtaattgctgtcggtctcggccggaaccgtcgaatgatggatgcgatgccagtccggtgtggcaatgacactggagagtggccggtctgcctggccgagatcgagatcggcatggttgaacagcgccgccaggctcagggccgcttcgaaggcgagaactgccgtggccggtatgccgagcaccagaatgaccaggatcttccagccggcagagagcaggatttcggcggggtgaaagcgcagggccgtcgtcgtgtcgagggcggtatcgagatggtggatgcggtgcagccgccagagcagtggcacacggtgcatcgccacgtgctgcgcccagatcgcgagatcgagcgccaggaaaccgaccacggcggccagccagccgggcagacccagcatcgggaaggcgcccagaccctgcgcttcgaagccgagagcggcgcccaccgcggctgccggcagaacaagacgcaggaccagggtatcgatgaccgcaagacccagattggtggtccaccgccggcgacggtcgagcctgtgatgccggccgcgccgcggccgccaccgctccgccagggccagcagcaggaacccgccgaggaacagcaggccgcggacaaggccttccaccgccgcgatgccggcgggatcggatgtggcgggcatctgcggcaacctcgacgcgtgatggggtgtcatcgtcgatatggggcgcagccgccctgccgtcaccctgccagcgcagcctttccggcgggcgccggcagacgggctggggaaaacggtgcgagcagcgcctgaaaacggcttgcgcaggcgtcccaggtaaaacgctccgcatggctgcgtgccgcgctgccgcccagaggcagtgcccggcggattgcggcgcccaggtctgcatcgagcgcgccggtaccgccggcctcgtcgaccacgtcgatcgggccggtaaccggatagccggcaaccggcacgccactcgccatcgcctccagcatgaccagaccgaaagtatcggtgcggctgggaaagacgaagacatcggcctgagcataggcccaggcaagggcggcaccgcggcgcagccccgggaagacggcatccgggtgtcgccgcatcaactccggccgggccggaccgtcgccgatcaccacccgggtgccgggcagatccggcgtgctgagaaaggcctggatattcttttccaccgccacccggccgacatagagcatcagggggcgaggcaggtcgggaagccgcgcgagttcatcatcgccctgagggggcggtgtcccgcggagggtgggcgaaaaaccgtcgaggtcgacgccgcggcaccacatggcgacctgcgaaaacccccgctgcctgaggtcctcggcaagcgagggggtcgcaaccatggtccgcaccccggcattgtgaaaccggcgcatgaagccataggagaggctgagcggcaggccggtgcgggcggcgacatattccggaaagcgggtgtgaaaggcggtggtgaaggggatgccatggcgcaaagcccagcgccgtgcggcgctgccgagggggccctcggtcgcaatgtgcagggcatcagggcggtgggccaggatccgccgcccgaccatggccggggtggcgagtgcgagccggatttccggataggtggggcagggcagggtgcggaagtcggcaggcgcgatcaccctgactgcggcaccacctgccgtcatggcatcgaccatgcgtcccagcgtgcggaccacaccattgacctgtggcgcccaggcatcggtgaccagggcgaggcgcgtgacggggggcgtgatgtcctgggtcatcgatcaggccgccggctcacgcgcagggcgacgggcatcggccggcgccggcagcagcccaccggtggtctgggaccggcgggcacgggccagggccacgagttcgcggcggcgggcgcgggcgccccagtcgaggatctgcagacggccatcgcgggtttcggcgatggccgtgcagctttcgacccagtcgccgtcattggcatagacgatgccatcggtttcgcggatgtcggcatggtgaatatgaccgcagaccacgccgtcataaccgcggcgccgggcctcgtcggtcacggcatgctcgaagcggttgatgaagtcgaccgcttccttgacccgctgtttcagataggccgaaagcgaccagtagggcaggccaagccgtctgcgcgcgatgttcagccagcgattcacccgaagcgccaggttgtaggcaacgtcgcccagcagggcgacgcccttcgcatagcgcaccaccatgtcgaaggcatcgccatggacgatcaggaagcgtcggccgtcggccagctcgtgctcgctttcgcggaccagttcgattccgccgaaggcgaggccggcataggccatcaggcactcgtcgtgattgccgatcacccaggtgacccgggtgcccgccgcggccttggcgaggatcgcctgcacgacctgattatggggcccatcccagaaccaggaccggcgcagccgccagccgtcgacgatatcaccgaccagaaacaagtgatcgcagtcgacggtgtcgagaaaatcgagcagcagatcggtgcgacagaagcgcgtacccaaatgaagatcggaaatgaacaccgtccgatactgccggcgttcgccctccgtacggctgtcgaccgttcgccggtcctggcctgccggcggccgtcggtggggatggccggcatggtcgtgatcgcctgatgccgtggtacccgggcgaaaggagagcggcggctgaactcgtgcgaccgtggtcatcggcaagggccctccgggcgactggcgcctgaagcggcggagcaccgctccctcggcacgtgtcgctttctcggagcgaagtcttaacccgttcgaccgtcaggttttatggcgtggcaatgacgttccggtgacgatggttccgggaaagaagaggttccgggaaagaagggtaatcccgcaacgaaaacgggcgacagcctgcgctgccgcccgttttctcgaaacccgggagtccggctccgcctcagtcggcgggaaccagatccacggccttgtcacccttgcgctcggtgagcaggctgtactcgagacgctgtccctcgttcagcgtcgagaggcccgcgcgctcaacggcgctgatatgcacgaagacgtcctttccgccctcgtcgggggtgatgaagccgtagcccttggtgctgttgaaccacttaacggtgccggtcgccatgtctggtcgctcttcctggtcttggtgatccgacggccgcgtctccacacgcgatcggtccgccggacgtgatgatggaggcggaaagtgaccggacactgttcagcgtcgatgcggatcgccggttcctccccgccgtccggcatcttccggtacgcgcactcctggtcctgcggcggtccggccccgcatccgtcccgatctggtgcaaacctgatccggtacggatggccggcctgacagccacccgtcacggcgcttgtggaagcgccatgcgtcgtgcagggtctccgtcgccggagacccgaccggataccacccgctgccccgcctccctgcggggcctgcgaccgggatccggaagccgggttgtcagtcggccggaacgagatcgacggccttctcgcccttgcgctcggtcaacacgttgtactccagccgctgaccctcgttcagggtcgtcaggccggcccgctcaaccgcgctgatgtgcacgaaaacatccttgccgccggtatcaggcgtgatgaagccgtagcccttggtgctgttgaaccacttgacggtgccggtcgccatggcgcgtcgcccttcccttccgactgcggagcccgccgttccccgcggcggacgtcacgatacaaggaggcgtggaaaccggtgagacgccgaaaggttccatgtcccggaccaaggcaggacacaccactccaggtagcgcaatcctccagccttttcggccgccggtttggtttttactttcggagaaactgagcggcgatggcgccgtgccgttgcctgaacgggtaggtctggaaccgcgctgacgggatccgtaagacttggccggacgggggctgggggcgaaatcgcctgccggtacgcgcgcgctcctgattccagaggttccgccggaacccacccggaaaacgacaccccgagcgctcgaacgaagaccggggtatggtcggagaacgaggcacggaaccgtcctgcgggcgggatcgcctgcgggtcatcgtctgattcgaaacgatgacttcaaccactataggcaggttccaggccggatgcgacagcaaaatggcgcgcaaccccctgtacggcctggaatcgcgcgcgtggcggcacggggcgaaagccgtgccgatcagcccacgctctggctgatccggcgtgcggcatcgagcaatgccgccagatttgcggccgcacggctgcctgcgatatgcggggtgaggccggcgagggaaacggccgcgatcacccggccgtcgcgatcgcgcaccggtgccgccatggccgccaggccttcgaccacgtcatcgacggcgatgacgtgcccctgcgtgcggatccggccgagttcctcccggaaggtatcggcatcggtgatgctgtgcggggtaagccggctcaatccctggccgatcgcgcgctcgatctctgccaatggctggaaggcgagcagcagcttgggggcaccgccgacattggcgggcagggcaccgcccactgcccaccagcgcacctgaatcgatcggtcatggtggaacttctcaaggcaaagcgctgaatgttcgcggtaaattgacagaaaggtcgtcccgtcgatctcgcgcgccagatcggtgaggatcggggccgcagccttgcgcagccccagattgtcgggtacggcgctggacagctcgatcatcgccaggctgagggcgtagcgatgggtctcgcggtcctggaccacgagacccgcttcgatcagtgtcaccagcagccgccgcgtcgtggccttgtcgaggccggtccgggcgacgacttcggtcagggtcgcccagggttcgacgacggtgaaggcgcgcagcacctggaccgcgcgcagcacggcacgcaccgtggtcgggccgctgtcgctccctacggtctcgccgcctgcggctgtcgtctcgggctcgtcacccatccgtccgttcgccttcatgcctgccactttcacccataccggccgctcggccgggatcgcgtctgccgtcatctgccgcggatatacttatcctgcaactcttcaatgcgcgagtagccgatcaggctcttgaacagctgcggctgggtgcgggcgcggggcaggttgcgggtgctgcgatcgcgcgccagcacggacagattgtcgaccagcgcctgggtcgccgtcatcagcggcaccagcgggaaggtggcaaagcctgcgacatcggcaatttcctcgggcgacagttcatcttccagccagcccaggatctgcagcgacagcggcttgcccaccgcatgccggagcgcgacgagatcggttttcgacttcacgcagcgtgaaatcggctggatgaggtcggcgccggcctcggcataggcctggccgcggcggatgcactcttccatggtctcggcatcggtgcgggcgacgatgatggtgtccggatcgcggcgggcatcgacggccgcccggatcttggccgtggcttcgtcgatgggcaggatctcaagcgcgccagcgaccaccgggcagcgcttgggcacgacctggtcctcgaagatcatcgcggcggcaccggccttctcgaaggcgcgcacggtgcgcacgatgttgaccacattgccgtagccggtatcggcatcggcaaccagtggcatgtcgatcacgtcgccgatagcgcggaccacacccacattctcggtcatggtgtaaagctcgacatccggctctcccagcaggctggccgagacgccgaagccggtggtgaagacggcgtcgaagccggcatcggcgaccagccgggccgacaacacgtcataggcaccggccatccagacggtctggccggcctcgatccggtcgcggagcatgcgggcatgggacatcgattggattctctttcgtggaaaggagcgcatctgtcgtgcggcgcggccggccgggtgcgccacccggccggcctcaggcacggttacttgccaccgcgaaccgggtcgatcacggcgccgagtgagcggaagccgccatccttgagctgcatcagcaccacgccggtctggccgcggcgcgaatagggatcgtccgacagcggcgcgaaggtgatcgcggggccgatcttctgatcgaagcccttcatgccttcgagcgcgccgaccagcttttcgcgggtggggtcgtcgcccgcctgcttcagggcttcggcgaaagtcgccgccgccgaatagcccatcagcgccaggctggacggggtcgatttcgggaagcgcttgccgtattccgcgacaaaggccttgatcgccgggttctcgccatcgaccgggtcgtaataggaggcgacatagagggtcttgccggcaccgccgcccagcagctcgacgaatttgggatcattcaggccacccgcgccgaacacggtcgggttccagcccagcttctcggcattcttgaagaagatcgccgcctgctggcccagggcgtagaggatgaccacatccggctcggccgccttcagccgcgccacctggctggtgagatcggtggccaggcgctcgaaattctggacctcgaccagcttcatgccatgagtggcgagctgcttctcggtatactcctgcgccggtttaccccaggcgtcgttctgaaccagcatcgcgatctttcgggcgcccaactcgttcacggcatagtcgacataggccggggcctcggtcgactgcggcgagggcagggcgaagagcagcttccgcggcgggttggtcaccgcatccgaaatgctgagcgcgcccacgatcggcacgcccttcggttccagatattcgtaggccgcgagtaccgtagcagtgccgaccgggccgaccagggccagcacgtcgtcgcgctccaccagcagcttggcgttggcgacggcctttggcggcttgaattcatcgtcataggagacgagttcgatcttgcggccgttgacgccgccctgatcgttcagcatgccgaaataggtttccataccctcctgcacggccttgcccatataggcgagcgtgcccgagagggcgagggtgctgccgaccttgacggcgtcgtcggaaacgccgggatctgcggcgaaagccgggtgcgacagccccgccggcagggcggatgcaagggcgatggcggcggcagccgtcagcagacggcggcgcagccggtcgaagcgcagggtcatccggtctctcctccctgtggtgccggggatctcttgatgcgggcggatccgccggcggtgcggatgcgaagtcttcaaggggggcggatcagccgcccagataggcacggcgcagggcatcatcgacgagcagcgcttcggccgggccctggaccgccagactgccggtttccagcacatagccgcggtcggcgaggtcgagcgccagttcggcatcctgttcgacgatcagcatggtgacgccctcatcgcgggcgatgtcggcgagcgcgtcgaagatcacggccttgatcaccggcgcgacacccatcgagggttcgtcgagcatcagcaggcggggctgcgacatcagcccgcgggcgacggcgagcatctgttgctcgccacccgacagcgtgccggcctgctggtccatgcgctcggcaagccgggggaaataggtgcaggcgcgatcgatgccctgcgccgtggcggcacggtcgcgggtccagccgccgacgatcaggttctcgcgcacgctcaatcccggaaacaccatccggccctggggaacatgcgagatgccgcgggcgaccagcccttcggccggctttcctgcaatgtcgtcgccgtcgaagacgatccggccgtcgaccggcttcagcagccccgacaggcagcgcagcagggtggtcttgccggcgccgttggcccccagcacggccacaacctcgcccggcatgagcgacagatcgatcccgtgcagggcacggatcgccccataggcggcgacgaggcccgagacctccagaatgggcgtatcaggcatgggccatctccttcgtcgggcccaggcggcgccggtcgcgccgggggatggcatccgcatcgcgattgcccagataggcggcaatcacggcttcgtggcgctcgatctcgggcggggtgccggcggcaaggaagcggccctgctccatgaccgtgatccggtccgacacccgcatcaccagcgacatgttgtgctcgatcagcaggatggtcaggccgtgacgatcgcgcagccgtagcagcaggtcgccgagggtgcgcgcttcggtctggttcatgccagcggccggttcgtccagcagcagcagtctgggatccagtgccagagcgcgggcgagttcggcgagcttctgacggccataggggagatccgcgacgatggcgtcggcatcgccgccaagccccacctcgtcgatcagaccaagggcatggtcgcgttcgcggatcgcttcgcgccgttccgacggcaggcgcagcatggccggcagaatgcccgccgacatcgcccggtcgcggccgatcagcacgttgtcgagcacgctcagttccgggaacagctcaaggttctggaaggtgcgcgcaatgccgagccgggcgacccggtggggcttgaggcccagaagctcctggccgccgaagcggatgctgccgcgcgcggcgtcgtagaaccggctgacacagttgagcacggtggtcttgccggcaccgttggggccgatcagggcatggacgtccccctgcccgacggtcacatcgatgccgtccacggccttcaggccgccgaaagagatggcgaggtcgcgaatggtcagcagttcgggtgcagcggtcacgggcgatgcctccggaacagcgtgtggccaaggcccgaaaggccgcccggcaggaacatcagcgacaggatcatggcgaggccatagaccgaccgctggacctgatcgagccccagataggtgaggcattgcggcaccgcgatcacgaaggcggcgcccaggatcgagccgcggatcgagcccagcccacccacgatcaccatggacacgaagctgatcgagaccatcagatcgaaggtggacgggtcgatgaagcggatcagcgggccgtagagcgcaccggcgacgccgcaatagaaggaggacagcgcgaaggcgacgatcttgaggcgggcggtgtcgagccccatgatccgggcggcggattcgctgcccttcaccgccttgagcgcacgcccccatcggctggccccgaaattggcccccatccacatcagcaccgcgaccaccgcaagcagcatccagtaggtgccggcgccaccgagttccatgccgaagagatccggcgcggcgacacccatgccgttctcgccgccggtcagttcgccgcccgatttggcgatctcggcgaagatcatcacgaagccgagcgtcgccatggcaagaaagacctcttccaggcgcagcagcgggatggcgagcagcaggccgacgaccatggcgacaaggcctgcggcaagcgccgcgaccagcagagtgacaccgtattccccggtcaggatggcggcgccataggcgccgatgccgaagaacacggcccctgccagcgagatgagattggtgtagccggtgagcagattggtgccgaaggccgccagtacatagaccagcaccaggctggcgatgaacaggaaatagccgccgaggatgaagggcagggccagcaggatggcgacgccgaggcccgtgagggccagacggccggggcggctgcgcgcggcgggcagatcgaggctcatggtcataggtctccctccgcctcagatcttcttggtcgcgtggcggccgagcaggccggcgggcttgacgatcaggatcgcgagcatgaccaggaagggcatgaattccttgaacgccgagtcgacataagcgccggtgaggttcgctgtcagcccgacgatggcgccgccgacgagcgcgcccggcatcgaggtcaacccgcccagaaccgcggcggcaaaggcgaagtgcagggcctgctgcatcatggtgaaatgaaggaaggtcagcggtgcgatcagcaggccggccacagcacccaccatgtaggaaagcatccaggcgaggccgtgcatgcgggccactggcacgccctgcagccgggccgcggtttcgttgctcatggccgcctgcatggcgataccggtccgggcatagcggaagaaggcgaagagcgccgccgacagcaccagacaggtcgcgatgatgccgagatcggcgagactgaccgccacgccgccgatcaggatcggcgcctgcgagaacggcccggccatgtcgtggggatccttgccccagatccagaccgcgacgtcgcccaggatgagatacaggccgagggtggcgatcgcattggcgagcagtggcttgccgatgaaacggccgatcagcaccacttcgatcgcaaggccgatcagggcggcggcggcgatggtcaggatggccgccagccagtaggggacgccggcttcgagcagggtccaggcgatgaaggccgagatcatgacgccttcgccatgggcgaaattgatcacccccgtcgcccgatagaccagcacgatgccgagcgcgacgagaccgtagatggcaccgagcgcgatgccgctgaccgccatttgcgcaagcatgggatcagcctccggtgcgggcgcgatcggcatcgaccgcgcgcttgagatagggcaccagtccgcccgcttcgagcatcgcccggtcggcgaccgacagcggttcgaacggcttttcccagcccctggtcaggttgcggacgcagcctgcctgccagtcgacctccaggctgtcgaagcggtcggtggcggccgcgacgccggggcaggggatcagcggaaagcccatgctgatttcaccccgccagaagccgggcgagaaaccgtcggcgatcacgcccgcgacacccagatggcgcatggcgcgcatcgccggataatgcggatggccgtagccgaaattgtcggcgccgaccagcaggtcgccgggccggaccttctgcggaaagccgggctcgtcatccttcatcaccagcgcggccagcgcgtcgatgtcggtgatcttgatgttctcgacaccgatgatgcggtcgatgtcgtagtcgtcctcgcggaacacccagacggcgcgaccgcggagatcgggcagcgacatgggctgcactcctggatggggaaagatggcggcaacgggccgacgacaggcgctgccgtcagagatagcggcggggatctgcgatccggccttcgatggcggctgcggccacggctgcggcattgcacaggaagatttcggacttcggatgccccatgcggccaggcacgttgagcgtgccggtagagaccgcccgctggccctcggccatggtcgcgatccggccgaagcaatagtcgcaggacgggctgctgacgaaggcgcccgcctcgaccagagtggtgatcaagccctccgccgcggcccgggccatcagcgcccggctggtcggcacgacatgaagcgcgaagccgggggcgatctgacggcctttcagcacctgggccgcggcgcgcagatcctcgatccggccgctggcgcagctgccgagatagccggcctggacctcggtgccgatcacctccgagagatcgcgggtattggagggcgtgggcggcaggacgaccaccggctccagcgccgacaggtcgacggtgtggcgggcggcatagacggcatcggtgtcgctgaataccgggtcgagggcgagcttcggccggtctcccagccagtccgcggttttgtcgtcgggcatcatgacagcggtggtggcgccggtgaacatcgcaaggccgcagatcgtctgccggctttcgatgctcatctccgtaaccgccggcccgcccagctccagcactttgaaggcggcgaatttggggccgagcgcccggaccagatggtggaagacatcccgcgccatcacccccggccggagagagcccgtcagattgatccgcaccgtctctggcacccggatcgagatggcggggcggacgaaggcctcaagaaggttgcggcgcagcccgatcgccagcgaaccgaaggcgccgagctggctgacatgaccgtcgaaatggaccgcgaagccgccgggcaccgcatagccgacctcggccgagacctgatgaccgatgccatggcgctcgtaaagggctgcgccctgttcggcgcaccaggcccgggtcatctggtgaagctcttcttccttcggcgtggccgtcggaaccatgtggtcgatgaagatggcaaaccgggatggatcatcgacacgctctataccgaaatcatcccgcatctgacggaagatcacatcggtataaccgggaaaatcatacgcgataacgaaatcggggcgagcctcgatttcgtctccggcccgaacatgatcgcgacccgaggtccgcgcgagaaccttctccgcgagcgtgtagcccatgacttgttgtcctcccgtcacgccaccagatttcatgcaccggtgatcatcttgacttgagtggatcctgcgcggcctgcttgttggtgtcaatatgcaaatcatggttcattgaatgaaccaaatgagggtcggtgtatgaaccgcggccgaatcctgaattgcttgatcctgatcaaggtcggagggagcatcggggtggagattgtgcgtagcagcaatgaagggcccgtgaagggccgcaggctcagcaggaggttccagctccatgagcggtccgggcgtgatcaccgccgtgcgtggcgcggtgctcgatatccgttttcccgcgggcgatctgcccgccatcggccatgtgcttcacgtccacgacggcgacgcgcccgagatcgtggccgaggttcagtcccatctggaccgcgagcatgtgcgcgccatcgccctgatgccgaccggcgggctgcgccggggggccgaggcgatcgccaccggggcgccggtgatggtgccggtgggggatgccgtgctcggccggctgctcgacgcgaccgggcggatcggcgacaagggggcggccctgcccgacgacgtgccccgcgcgccgatcctgcaggccgcaccggccctcgccgatcagaccgccgccaccgatgtcttcgagaccggcatcaaggtcatcgatctgctgaccccgctcgcccatggcggcaaggccgcgatgttcggcggcgccggtgtcggcaagaccgtgctggtcatggagctgatccaggccatggtgtcgggctatcagggcatctcggtcttcgccggcatcggcgagcggtcgcgggaagggcacgagctgctgctcgacatgcgtaattcaggcgtgctggagcggaccgtcctggtcttcggtcagatgaacgaaccgcctggcgcccgctggcgggtgccgatgacggcgcttgccgtggccgagcatttccgcgaccagcggggccgcaacgtgctgctgctgatggacaatgtcttccgcttcgtccaggccggcatggaagtctcgggcctgctgggccggttgccctcgcgtgtcggctatcagccgaccctggcgagcgaagtcgcggcccttcaggagcgcattgcctcggtgggcggggcggcggtgacggcgatcgaagcggtctatgttccggccgacgacttcaccgacccggcggtgaccgcaattgcggggcatatggacagtctggtcgtgctgtcgcgatcgatggcggccgagggcatgtatccggcaatcgatccgatcgcctcgtcctccaccctgctcgacccgctgatcgtgggcgaaacccatgcccgcacggccgaagaggtgcgccggaccatcgagcattaccgtgaacttcaggacgtgatttcgctgctgggcctggaagagctgggggccgaagaccggcgactggcagagcgggccaggcgcctgcagcggttccttacccagcccttcaaggtgaccgaagccttcaccggcacaccgggacggtcggtcaggctggccgataccatcgccggctgccgcgcgatcctcgacggcaaatgcgacgactggccggaagatgcactctacatgatcggcgatctggaggaaggacgccagcgcatggaggcccggcaccgggacgagcggcgcggggatgcggcagcatgagcgggcggcgcctgcatctggtgatcgccacacccgcaaccgtcgtccgcgacctggacgacgtggtgtcggtgcgagccgaggatgccagcggcggcttcggcatcctgcccggccatgccgatttcctgaccgtcctcgacgcctcggtgatcggctggaggcgggccgacgggcgtgcggaatatggtgtggtctcgggtggcgtgctcagggtcgagggcgggcgcgatatttcgctggccgcacgcagcgtggtgaccggcagcgatccggaacggctcaaggccgacatcgccgcggcccgcgaggcacgcgacgatgccgaccgcaaggcccgcacggcagaggtcggcatgcagacccgcgccgtgcggcagatggtgcgctatctgcgtgaccggcccgaggaggtgacgccatgaccggggaggcgacgccatgaccccgccgcgcgaccgccgtcaggaccggcggatggagcaggccgccgatcgccaggccgcccgcgaggcggcgaaacgcaaggatcatgagcccgggatcggtcaccggttggggcagatcggtgtgctcggctggatgatcgtgacgccgatgttgctcggcctgttcctcggccgctggttcgaccggctggccggcaccggcatcaccttcgctgccgccctgctgatggcgggcgtggcactcggtttctggtcggcctggaaatggatgcatcgcccatgaacgccctctcgaccctgacggtggatccgacggcgctggcgctggcatttgtcgcggggcttgccgccggggccgggttttttctggtgctgcgacggaacacggatctgtttgccggcggccgcatcggtctcgccatagcgatgcaggtggcgcgcttcgccgttctggtgccggttctggtgctggcggcccgccagggggcgggaccactgctggcggcagccttgggtgttctgatcgcgcggcgggtggtggtcggccgggtacgccgtcgatccgccgccatgctgcccgacggggggcggtcgtcgtgatcggatcaccgctcgaaaccccgatcgcctttcatctggggccggtgccgatcgcaacgccggtgctggtgacctggggcatcatgatcctgcttgccggcggttcctggatgctgacccggcggctggagttgatgccgggccgggtgcaggccgtgctggaactggtggtcgaggccatcgacggccagatccgcgagaccatgcgggtggagcctgcgcggtttcgcgccctgatcggcacgctgctggtgttcatcctgaccgccaactggtcctcgctggtgccgggtatcgaaccgccgaccgcccatatcgaaaccgacgcggcactggccgccatcgtcgccgtctcggtgatcgtcttcggcatccaggcgcaggggctcggcggctatctgaagacctttgccgagcccagcctggtgatggtgccgctcaacctcgtcgagcagatcacccggaccttctctctggtcatccgcctgttcggcaatgtgatgagcggcgtgttcgtgatcggcatcgtgctgtcgctggcggggcttctggtgcccatcccgctgatggcgctcgacctgctgaccggggcggtgcaggcctacatcttcgccgtgctcgccatggtgttcatcgcctccgggctggaaggcgagggcggctcaccgcccgcgtccggccatacgtccacatcttcttcctcccctacctcctccgggactgagtcatgaccaactggatcgagatcgtcagcatcctcgccgccgcgatggcggtgtctttcggcgccatcggccccgcgctcggcgaaggccgggcagtggccgccgcgatggatgccatcgcccgccagcccgaggcggcgcccaccctgtcgcgcaccctgttcgtcggcctcgccatgatcgagaccatggcgatctactgtctggtgatcgcgctgctggtgctgttcgccaatcctttcgtcggctgatcggcccctcgccatgcatatcgactggtggacgctgggcatccaggcggtcaacgtcctggttctgatctggctgctcggccgctttctgttcaagccggtgacggcgatgatcgaccggcgccagcaggcggcgcgggcgatcctcggcgaagccgaggccgcgcggcaggcagcccttgccgaacgggcgaccgctgcctctgaacatgcggccctgaaggccggccatgccgctgccgaggccgcggcggttgcggcggcagatcgggcggcggccgccgtgatcgatgcggcacaggccgaagctctgcggatcacggcgcgggctacggaagcggccgatcgcgcggcggcggcgcgcaccacggaagtcgaggccgcagccaggaccctcgcagcaaggatcgctgcgcgcctgctggatcgcctgccggtcggagcgcgcctcgacggcttcatcgacgggttcgctcaagccctggacggcctgcccgatgcggtcaaacgacgcttcaccgatggcggtgaaacgctggtcctgcttgccgccaccgaggtgagcgcggccacccgtgcaacgctcgaggcggccatcggccgggtgctcggttccgtccccccgctggagatcagggtcgagcccgccctgatcgcgggcttcgaggccgcagccgatcatgccgtggtcaccaacagtttccgcgccgatctggcgcagattgcccgggagttcgcgcgcgatgaccgccagtgatccgatcgaggaggcagccagggccgaggccggcgtctggctggccgatggcgaggcccggctcgatcgcgcccgggtgggggctgccgccgaagcggtcggccgggtggagcgtatgggtgacggcatcgccctggtctcgggcctgcccgatatccggctgatggagctgctggatatgggcgagggccgccgcgccttcgcgctcaccctcgacaccggacggatcggcgcggtgatgatggatgacggcgccggcatcgcagccggcagccctgtgcgcggcaccggccaggtggtgacggtgccggtgggcccgggcctgctgggccgggtcgtcgatccgctgggcaggccgctggacgggggcggggcggtgaaggcgacggaaaccctgccggtcgaacgccctgcaccggcgatcatggatcgcgatctggtcaccgagccggtggagaccggcctgctggtggtggacgccctcttcgccctgggccgcggccagcgggagctgatcgtgggcgaccgtgccaccggcaagacggcggtggcggtcgacacgatcatcaaccaggcccatagcgacatgatctgcgtctatgtcgcggtcggccagcgtgcgtcggccgtgcgccgggtgatcgatgcggtgaagcgtttcggggcgccggaacgcacggtgttcgtggttgccggcgcaggcgcgccggccgggctgcaatggatggcacccttcgccggcatgaccattgccgaagcggtacgcgatgccggcggccatgcgctgatcgtgatcgacgatctgacccgccatgccgcaacccaccgcgaactcgctctgctcacacatgagccgccgggccgtgaggcctatccgggtgacgtcttctatctgcattcccgcctgttggaacgggccgccaagctgtcaccggaactgggcggcggctcgctgaccgcgctgccgatcgcggagaccgatgccggcaatctttcggcctatatccccaccaatctgatctcaatcaccgatggccagattgttctggaccgcgggttgtttgcggccgatcagcggccggcggtggatgtcggcctgtcggtcagccgggtgggcggcaagacccagaccgcagcccttcgcggcgcggtgggccggctgcggctggactatgcccagttcctggaactggagatgttcacccgcttcggccgcatgaccgacacccgcgtgcgcgaccgcattcgccgcggcgaggcgatccgggcctggctgcgccagccgcgctatgcggcactccgcccgatcgacgagatcgccgtgctggtggggctgtcggaaggcgtcttcgatggtctgtcgaaggatcaggtggagaccgtccggccgcggctggcggcacatctggacgcgcatgcacccggtgctgcccgggtcgtggcggctggcggcaagctggatgatgccgcgcgggccgaactggtcgcggccctgaaggagctgacgggtcatctgccggcactcgctgccacggggacaaacggatgagcggccgcctccacgacgtcgaagcgcggatcggtacggtccgtcagctggaggcgatcgtgaccgccatgcgcggcatcgcgtccgtccgggcgcgggaggcgcgcgagcgtatacaggcggtccgggcccatgccggcatcgtcgggcgcgcaatcggcgacgcgctggcgatgcaggcgggtgatgaccggggcggggcgccacggcgggtggtgccgacgcgcaccgctcttctggtcgtcacacccgatcagggctttgttggtggtctgcccgaccggctgctcgaccgggcgatggaggtggccgggtcggctccggtggatctgctgatcgtgggcgaccgcgggctgatgctggccggcgtgcgcgggctggatgtggcctggtcggtgccgatgtcggcccatgtggatgacgtgccggcccttgccgatcatgttgcaggcgccgtctatgaccggctcgacaccgggcgggtgcggcagctggcggtggtgcacggtacgccctcgtccggcggggagggcaacaccgtcgagatcatccatcgccagctggtgccgttcgatttctcgcgtttcccggtgtcgggccggcgcgtggcgccgctcatcacgctgccgcctgccgacctgctggacgggctggccgcggaatacgtctttgccgaactctgcgaggtgctgctgctcgcctatgcggccgagaacaccgcccgcatgaccgcgatgatcgccgccaagacggggatcgaacggcggcgcgaggatctgaccaatctcgcccgccggatccatcaggacgagatcaccgacgagatcatcgaactcgcgacgggcggcatggctgtcggacgcaacggcgccggctaggatcgggacgggtcaggatcgtgaggggcggcttgccggcctggtttcgacctgccccatccaggcggtgacccgctcttccagccggtcgacttcgcgatcgaaggcggcgagatcacgaacgccgtcttcgagccgcgtcttgagggcccgataggcatcgtgcagctcctgctgatcgcgcgacagcgctccaccctcattgccgtcgtcatgcagtttgcgggtctgcatttcgagcatcgcgcccatatcctgaagcttcttggcgatctggtcgtggctgctgctggtatccatggcggtggatcctccgactgtggccattggcatcaggacatcggaccgcatctttcgggatgccagaggggggcgccgatgtcgcgcggaagacgcaggaccgccacgctgcgctcactgcccgcgccgcatgcccagcgccatcactccggcggccgtgaagtttcccgtcatcgccaccagaatcggcagcagatagctgcccgaggcgtcgtagatatagccggcggccgtggggccaaccagcgtgcccaccgccacgcaggtatagagaatgccgatgatgccgctgacattgcggctgccgaaggcatccatgaccactgacggaagcacggcgacccagccgccatagaacacgccatagaggaaggcaaaaaggccgagcgcccaaaggctggagaacccggcccagatgatcagcgatgcgcccatgcccacatacatgcagaccagagtcgtccgccggcccaggcggtcggcgattccgccgagcataaagcggccggcagtgctgccgataccgatcacccccagaagcagggctgcggtcgccggtgccgtgccgcgatccgtggcgtaggggacgagatggacgaagggcacgaaaacgccgaaggccgagatggtgcccgacagatagagctgaaagaaggcacgcgagcgcagggcctcggcaaccgacatgcctggcgccggaccggttccctgaaccgcgacggcagcgccgccatccggtgcaagcccgcgatggcgtggatccgcctccaggagcagagccatcccggcgccgaggacaatcgccgccacacccatcaccacccaggctgttcgccagcccagtgcctcgatcgccagagacgccgccggtggaaccaccagggtaccgacgccgatgccagccacggcgaggcccgatgcgaaggcgcgtttgcgggtgaaccagcgctggacacaggcgatcgcaggaacataggaacagccgacgcccaggccgacacccagcccgtaagcgatatagacctggttcatggatgtcgcctgtgccgccagaatcatgcccagaccgacgaagaccatgccggcaagggtgatcggtcgtgccccccaacgatccgcaatcggtccggtgatgaggccaagggcgaaatacagaaaacccgccagggagaagatcagcgagacctccccgcgagaggcaccgaacgtgccctgcagcgggtcgacgaaggcactgaaactgtaggcagctccaaagccgataaacatcacggcaaaggctgcagcaaccacgaaccagccgtggaagaccggagatgcgggggatgtggtggtcatggggagcccggacgccttgatcttgttcttctgaggaggggacgaggggtcatccgacccgaaggtcttctgcataccctgcggtagattcccaccgaagtcatcttcttccgtcagcggccacatgctgcaacaattatcggcctttgaaaaagaaaaattatctgaccgcgtaatccagagagacgaggacaaaataagaacatcctcagatacaatacgtcacccaatctgcccccaaaagaagagcttaagcgtctgcggggcagccataacgcaggagaccggtcatgagcagcagtgcggaagcccgcgaacaggcgctggaggtggcggaacggttgggcacgctgggcccggtggtcgtgaagcgcatgttcagcggggcagggctgtccatcgacggtgtgaactttgcgttcgtgatcggtggtaccctctatttgagggtcgacgaccagagtcggcccgaatacgaggccatggggctggagccgttccgctatgaccggccgggacgaacggtcaccgtcgggtcgtattacgaggcgcccgacgaggtcttcgacgatgacgaggcgctttgcagccgcgcaagggcagcctggcaggcggcgctgacggcatcgcgtgcccgtcctcctaaaaagccccgcacgccccgacgcaggaaacccggatgagggccggaaagctgcgaccactagacgcgccccgctgccatgaagctgccacatggccgggctagcatcctgcagatgcccattcgtgcaggagctgaacggtatggagaagaccggggtcgtcgatgcgctcggccaggtgcagctgttgctgccggcctggatcaccaccgcccttgcggcaaatgaccggctgaagctgtatctgagcatcctgcaggccgcgcgacatcggtcgaccgggcccggcgctgtccccgtagacctgacgcgggaggcggccgcggccggcgtcgacggcgcctgggccagcgaagccgtcgcaactgcaacgcccgatgccgacggcgtacatctgtcggatctgccccggctccggcagttgctggcccaggacctgaagctgatggcccggccgctgatcgatggcggccatgatgaggcaggcacctggaccaggcgggttgcggcctggatggcccggcttgacgggatggagggcaaccggctggaggatattgtgttgacggcgctgaccgccggtcgcgatatcgcccccgacggcttccatccgctggtgatggacctgcacaagagcctgaaccggctggcaacggagctggccgacgagcagatcgacggcgcccatgtctgggccattgccgatgctgaccggccgaggattgccgctttcatgcgcgggctcaatcgcacccggccgctcaaatttgatcatccgggccttgagacggccgcgacccgcgacggggagcggctgctgatccagaacgacatcggcaccaatgacgcccatgtgctggtcgtccaggtacaggccctgcgcatcaccctgacctattccgacctccaccggcagcgcttcgccttctttcagggactgctgggcgcgattggcgccgtctggtcggacagcgagagccgccggacccgcgggctgaatgccggcgaggcctatcacgtcggcacggcgatcttcgactgtgccgacgagacggcattgcacggcacactggaagggctgggcgcacggatcgtcttcctgatcgactggaaccgggcccgcaaacgactggcccccttcgtgtcgaagctcgacgcgatcgccgtcctcaccgacgcggcaacgcgtgaggcggggcacatggcctggctggtggccggcgggcccgatctggtccatggcgcgatgcaggcggtggggcctgaatatttccgcatcggcgaccggctggacgaggtcatgggccgtaccgccgcgatggcctttctggtcgagttgatggtgcgggcgaaagaggccctgctgcgcaatcagccggccggggtggtggcagatgatgcccgggtgatgctgctggcgcatctgcgccaccaggtcagcgagttcgaggcgctggccgaccatgccggcttctgccatgccctcgccgaaggtgtgcgggacgggctgatccatggccttgagcacgatgttgccgccgcaaccgcttttgccgaccgcgccaagacctgggaacgtcaggcagacgaactggtcatgcggttgcgcgaacaggcagatcgccagccccatcgtctgccgatgctgcggctgatcgaacgggccgatgatgtcgccgatgcgctggaagaggcagctttcctgctgtcggtgatcgccgagggccacgacctgggctggacgtccgaggtccgcgaggtgctgcgacgcctggctgagaccacgttcaccgcggccgaggatcatgtccgcgctctggcgattgcacgcagccttgggcctgatggtacggcagacgatcatgaagagctggtggcggtcctctggcggatcgtcggggccgaacgcgccgccgatcagctgttgcgcgacgtccgccgcgtgcttgcccggcacctgaccgatgcggcgtctctcaatctcgccaccgatttcgctgccgcattggaactggcgaccgacgccctgctggtcaccggctacgggctgcgcgacctcgccttcagccgcatgggagccggagcatgacgcgccagaatgtgaagagcgagggcatggcagggcttgcgaccaccatccccgtcatcctgccgggggccgccctggccgaaaatacgagcgccgcgagcctcggcaacaaggcctttaatctggcccggatggcggcgctgggcctgccggttccgccgggtttcgtgatcggtacggcctggtgcgcgcgggcggaagaggtcggcccggccctgtggcgccccgcgcttgagcgcctggaggaagcgacgggccgcaggcttggggatccccgccggcctttgctgctgtcggtgcgctccggtgcaccggtctctatgccgggcatgatggagaccctgctcaatatcgggctctccgacgcaaccgttgacggcatgcttcggctgaccggccatccgcggctcgtctgggatgcctatcgccggctggtggcggggttcggtgaagtggtggcgggtatcgatcccgccgccttcgatgccgatctggatgcgatccgcggctcggtgcccgagcgggcgctggatttcgatgcgctgcgcaggctgacccgccgccatctggacacctatgcccgcaccgccggcacggccttcccgcaggatcctgccgaccagcttcaggccgcaatccaggccgtgttccggtcctggcaggcgcccaaggcacggtcctggcgggcactgcatgcgatcgccgacagcatgggcacagcggtcaccgtgcaacagatggtgttcggcaatgccggcggactctcgggcgccggcgtcgggttcactcgcgatcccaccaccggcgtgcccggtctctgggtggatttcctgttcaatgcccagggcgaggatgtcgtcgccggtcgccgctcggccgagggacatgaggcgttgtctgctgcggcgccgcatctttgggcggaactggtggcgtcggcggcccggttggaacagactttcggcgacatgcaggacatcgaattcacgatcgagaacggccgcctgttcctgctccagactcgcgacggcaagcgcacaccgctcgccgccgcacgcatcgcgctcgatctgctggacgaagggctgatcgatgcccgcaccgcccgcgaccgcctgcggtccctcgaccgggcgagcctcgccgagcgggtgatcgccacggccgacggaactgtggccgaaccgcttgcccgcgcggccagcgcatccgccggggtggcgagcgggcccatcgccctcgacgaagcccaggtcgaggcagcgcgcgcccgcggcgagacacccattctggttcgccgggacgcggaaacccgggatgtggccgcactcgaccgcgccgccgggctgctcaccatgcgcggcgcccgaacatcccatgcggccgtggtagcccggcagctcggcaaggtctgtctggtcggttgtggagagctgacgattgacgaggccgccgggcgggtgatgatcggtggtcggatcttcgggaccggcagccggatcacgctggacggcaataccggcgcggttcatgccggtgcgctggaggtggtgacccgcgagccccaggatctcctgacccgcatggcgacggtgctagccccggactgaccccaggcgggcgagacgttcgaaacaaaggtcggtggtgatggcaagcagtccgaccaggatggcaccctgaaccacataggccgggttggagcccgacagcccctcgatgatcggtgagcccaggctgacggcgccgaccgtggagccgatcgtggccgtgccgatattgatgatcaccgccgtccggatacccgccagcatcaccggaaaggcaagcggcagttcgatgcggagcagacggcccgttggcccgaaaccggcaccgtccgccgcttccttcaatgccggtggcagggcacggagaccggctgccgtggtctcgaccaccggcagcacgccatagcaggcgagcgcgatcagtgtcggcaacggaccatagcccacggccggtaccgccagggcaagcacggcaaccggcgggaaggtctgcccgaccgccgtcgccatatcgaccatgcgcgcgaagtcacgaccggccggccgggtcacgaaaatgccgaccgtgatgccgaccaggcagatgatcacgctcgaagcggccaccagcccgacatgcgacagcatcagggtcaggaaattggtacgggtgtagatcggtcggggcaggtccggatagagcgtccggaacaggggctccgctgccggcatggcgagcgtcgcgatcaccagcgccgcggcggcccagggcagcggatcgcgccagagcggacggcctgggcgatgcaagggcggggtgccggcaaggctcatcttgcaaccagcccgcccagggtcaccaccccgagctttcgaccagaggcatcggccaccgccagccgatcggcccgggcggccaccatggcgccgagggccagatccaacggcatgtccggatgcagcaccggccccccggccacgtcgcctccggcctcgatccgctcggccaccgtgcgggtgcgaagcatacgcaggccggcgagcggcccgccgacgaattcccgcacgaaatcatccgccggtcgggcaagcagggcggccgggcgatcgatctgtaccagccggccatcgcgcagaatggcgatacgatcagcgaggcgaatggcctcgtcgacgtcatgggtgacgatcacgatcgtcttgcccgtggccgtctggatgcgctgcaattcggtctggatctcgtcgcgcgtgacggggtcgagcgcgccgaagggctcgtccatcagcagaacctcggggtctgcggccagcgcacgggcaacacccacgcgctgctgctgaccgcccgaaagctcgtgcggatgtcggccgccgaactccgccgggtccagacccaccagatcgaggagttcctcgacccgcgcccggatccggtccctgggccagccaagcagcaccggcacggttgcgacattgcgcgccaccgtccagtgcggaaacagcccgatcgactggatgacatagccgatgcggcgccgcagcgcgacgggctccagactcgcgatgtcggtgcggccgagcgtgatccggccactgtcgggctcgatcagccggttgaccaggcgtagcgtggtggacttgcccgagcccgagggcccgaccagcgcacagatctccccctcgggcaccgtgaaggagaggtcttcgaccgcagcacggttgccgtggaatttgctcaccccgtcgaagacgatcatgctcatgacgtgcgggctccggtgaggcgggtggcgagccaggccgaggcggcgcgcagcaccacatcggcagcgagggcgagggcgatcgcggtcagcgcccccagcagaaccagatccgtggcggtctgacccaggccctggaagacgaaggcgccaagccctccggcaccgatcaacgccgcgaccaccgcaagaccgatcgtctgaaccagcacgatcctgaggcccgcgagcagcaccggcagggccagcggcagcgagacctgcaccaggatctgacggtcagagagccccatgccgcgggccgcctcgatcgccgcttcgggcaccgaggcgaagccggcgaccacgccgcgcgccgtgggcagcagggcgtagagggcaagggcgatcaccgcgggtgccacgccgatccccgacacgcccgcagccttgagtgcggggaaggccgccgcgaggccggtcaacgggccgatcagcagggcgaaaagcgcgatcgagggcacggtctggagcaggttgagcacgccgaagattaacggagccacaccgcgccgggcccgcgcccagaggccgagggcaccgcccgacggcaacgcgatcgccagcgccagcacgaccagttgcagatggcgcaggatctcgacgccgaaccggtcgcggcgggccatgtattcgcgcatcagcgacagatcatcgagccggcccgaggcgaccgccgcccagatcaggccgagcaggaccaccacacccagcggccccagcaccgggcccggcctcagccgggccacggcgtcgatcagcaccagaagggccgcggcggccaggatccagaagccggcaccgaaggaagtgcgggcggaggtaccgcgttcggcaaggaccccggtggcgatatcgccggcagcgaagagcaggccgaaaaacagcaggccggcgagcgccgccgcaaccaggtcggcaccgcgcccgggccggaccagcgcggtggcacccagccccgccaggatcagcaccaggatggcgaactcggccccgggcagggcgtcgacggcagccacggcacggccggagaggatgcggttgggggcgatggtcacgaagcccgcaaaggcggtcgccgccgccatcgccaccaccagaaccgcgagcagccggttgccgcgcggggaggggcgccctgcgggcgccgcctcgtcgtcgacggcatccaggccgtcgagcgtgctcacttcagcagccctgccttcttcagatgcgcttcggcaacggcccgcggatcctgcccctcgatctggacgctggcgttcagcgcctgaagcgtttcgaggtcgagggtctggaaggccggctccagcaggccctcgatatccggatgcgccttcagcaccgctccgcggatcaccggcgccggctcgtagaccgcctgcacgcccttggtgtcttccatgaccttcagcccgaccgcggcgatggcgccgtcggtgccgtagaccatggccgaattgacacccgaagtgccctcggctgcggccttgatggtcgcggccgtgtcaccgcccgagagcaccagcaactgatcggccgagagcttgaacccataggcctcctggaaggcgggcagggcggccgggctttcgacgaactcggccgagcccgcgagcttcacatcgccgccgcctgcaacccatttgccgaaatcatccagcgtggcgagcttctgcgcctcggctacgtcgccgcgcacggcgatcgcccaggtgttgttggccggcgccggcttcagccagaccagatcattggcctcggcatcgagctctttcgccttggcataggcggtatcggccttcttccaggccggatcggcgtcgatgttgaagaagaagccggcattgccggtatattccggatagatatcgatctcacccgccagcagcgcctcgcgcacgatcttggtcgggcccagagagatccggtcgttgacggtatagccggcattctccagcaccaggcggatgacattgccgagcaccgcaccttcggtgtcgatcttggagccgacggtgatggcgtcggccgcacgggccggacccgtcacgacggcagcggtgccgacagcgagcgtggcggcgagggtgagaaggcccgcacggcggaacaaggtgcggcgatcgatggtcggcatggagcggcgtcccccattggttcctgacaagacgggggcgggtctctgccgcgccaccccggaacgtctgcgacgtctgtctcttttccgatgccggtgctccgtcgatgggaccaccagcgcgacgcgaacaacggcagcggcgccgttctcgttccgtccatcctagcagccgtttccgcgcttgccgaacccgaagggcggaaattcgcgctggacaggcacccaactgacagaatggcgtcaggaagtcgcccgcccgcacatcatgattcgacccgcgcctcagatcccggcgagcagcgccgccagcgccaaaaccgccggcaatgcctgaatgaacaggatcttacggctcgccgttaccgcaccgtagagccctgccaccacaacgcaggccaggaagaagacgaggaaggcgaagccctcatcaccgccgcgcaccatgccatagatcaggccggctgccagaaagccgttatagagcccctgatttgcggccagaacccgggtctgcgccgcgaaatcggcggtggtgccgaaggccttccgaccgcgcggcgtgtcccagagaaacatctccagaacgagaatataggcatggatggccgcaaccagcgcggcaaggatctgggcaatcatgcgggcctccgcggggtggatgccgcatgggacagtccagtcggctgtctcagttaagcccgatggtgaccattgggtcaatctccgatgatgccaggatttccgggccaggttccgtgctttgcgaccgtatgcgatacggctatgctcacaacacgagacgatatcggagacggcgcccaggtgaggacaacacggatcggcagacggctccgacggggcggtatcgctgcgtgccttgctctcggggcagcctgtatgaccccaggcgccgccacgacggcggcagcagatggtgcttcagtcgcactcaccgaaaccgaacggctatggctggcgacaagcggccccgtgaccatgtgcgtcgacccggattgggagccttttgagcggatcgacgaagccggccggcatgtcggcatcgcggccgatcttctccgtctggtggcgacacggctcggcatcgacatcgtgctctaccccacggccagctgggatgaaagcctcgccgcttcgaaggccgggcactgccggatcctcagctttctgaaccggacgccagaacgtgagcgctggctggtgttcaccgcaccgatctttcgcgaccagaacatcgtgatcacccgtgaagagcacccctatatcggtgaccttcacggcgtcagcgacgagaccgtggccctgccgcgcggcaccatggtcgaggagcggctgcggcggctctatcccaatcttcagatcacaaccaccggcagcgagcccgaagcggtcgagatggtttcggaacaccgggccgacataaccatccggtcgctgatcgtcgccgcctatgcgatccgcaaggaggggttgttcaatctgaagattgcgggccaggttcctgaattgacgaatgaattgcgggtcggcgttctggccggagaaccgatgctgcgcgacattctggacaagggcatcgcaacggtcacaccgcaggagcgggaggcgatctccaaccgtcatgtcgccgtgcagatccagcgcggcatcgattatcgcctcgtctggcaggtcggtgccgcagcggccgtgctgctgctgcttgcgctttactggaaccgtaaactggcgcggatgaatcgggaactggtccgcctgtcgaccacagacccgctgaccgggctgttcaatcggatgaaggtcgacggtttcctcgaggaggaactggcccgtgcccgacgaaccgggcagagcttcggggtgatcatgctcgatctcgaccatttcaaggccgtcaacgatcagcacggccaccagctgggcgatgccgtgctggtcgatgtggcagccctgctgcgtaccggccagggcccgggcggcttggcagggcgttggggcggcgaagaattcatcctggtctgcccgggggcggatctgcccgaaaccgcccggcgggccgaggtgctgcgggcggccatagccgcccatggcttcgcggtcggcccctgcaccggcagtttcggggttgccgcctggcgccccgaagaccgggtcgaggacatcgtgcgtcgggccgacgcagcgctttacgatgcgaaacgcgccggccgcaaccgggtctgccgcgcgacggatgaaaccaacggcatgcgcgcgcaggcagccggctgagcgatcagcccgccaccgaccgcagccagccggccatcccggccatggccgtatcacattgcgggaagcgcgccaccgaccccggatggaccgggaagttgtgatgcatgtctggcgcatgcagatgcgtaacggccatgcctgccgtttccagccggcgggcaagggcgatgccttcatcccgcagcggatcatattcggccgtcgcaaccagcaccggcggcatatccggcaggacaccagcccgcagcggcgacagatccggatccgccggatcaccatccggcgcatactggcgccagaaccagtgcatcgcctcggccgtcagccgatagcccgtggcattctcgacataagaggcatggccgcccgagggatgatcggtcgccgggtagagcagcatcaccccggcgggccgcaccgccgcctgaccatccgcgtcatccgccgccatcagaacccgacgggccgtcaccatggccagctgcgcgccggcgctgtccccgccgagcaatacccgccacggatcgccaccgaaacccgccgcctcggccaccgcccaatgccaggcggcgagggcatcatcccgggcggcggggtagggatgctcgggcgccagccggtactcgaccgataggatgatcaccccggccgcatcggccagcagccggcagaagggatcatgggtctccaccgacccgaacacccagccgccgccatgggtatagaccagaaccgccggcgccggcgtcatccgctcgggcagataaagccgcccggtcaaccccgccccgatcaccacatcacgcacccgcaccgcattcggcagtccagggatcgcctcgcgcgccaagagcgcccgcaccatcccctcccgcgcctcccgcacccgcgcggcatcatcggcaggcggggggccggagacggcgtcgagcgtgtcgaggtattggcgcagggcggggtcgatcggttggcgggggggcatgggggagatctccttggagcatgcgcgtcggtaggcggatatgtggcagctattgtcggagtttgcggggacgagtccactttcgcgcttcgggtctgtcggacagcgcgaagctcgccagagctgcttcattgacattttacgtcttacgtaatatgtaaagatagcaggagcaagcccatgatccaatcttttgcgtgccgggaaacggaagccctcttcaatcgggaacgatcccgacggttcggcgccattgaacgtcaggcccgccgcaaacttctgatgctcgacgcagcccacgttctcgatgatctgcgcagccctcccggtaatcgcttggaagcccttcgcggcgaccgggcgggtgcgcactcgatccggatcaatgatcagtggcgactgtgcttcatctggacagaagccggcccccgagacgtcgaaattgtggactaccattgagtcctactttggttaagccccgcatggagggcagggaggcccgacggtgatgccgacaaaatacgagcccattcaccccggtgagatcctgagcaccgaattcctcgaccccctcggtgtctccgcaacggaactcgcacgcgccatccacgtgccccctaatcgcgtgacccgtctgatcaacggacaggccgcggtgactcctgacaccgcgctgcgactggcccgcgccctgcgcacgacgccggaattctggctgaatttgcagatgcggtttgatctggatatggccgcagatgcgggtggagtgatggatgatattcaaccgattgtcgttatgtaaataaatgcgctattcgaacggatcacaccttgccgtcccgcctttcaatggcctggatcccgctctctggtagtgaggcgtataattccgcgatgtacttgggttcggatacggtcttatccacgatcatgttcagaagcgtgaagagtgtctcggcagttttccggtcgtcacgcaggtcgatcgccttcgtggcctgctggaaaagagcgcagatgccgatctgctgcgcgagatgatcggttttgccgccgagcggctgatggagttggaggtggcgacgctgaccggcgccgggcatggcgagcgcaagcccgatcagcgccttgtccaccgcaacggctaccgcgagcgcgactgggagacccgggcggggacggtggcgttgcgcatcccacgcctgcgcaaaggccgtgcttcctggagccccgccggatggcggaaaaggcgctgaccgccgtcatccaggaggcctatgtccagggcatctcgacacggtcggtcgacgatctggtcaaggccatgggcatgaccggcatctcgaaaagccaggtcagtcgcctgtgcgccgaaatcgacggcaagatcgcaaccttcctcgaccgcccgctggagggcgactggccctatgtctggctcgatgccacctacgtcaaggtgcgccaggacggccgcatcgtcagcgtggcggtgatcatcgcggtcggtgccaacaccgccgggcgacgcgaagtcctgggcatcgacatcggccccagcgaggccgagaccttctggaccgacttcctgcgcaagctggcgcggcggggcctgcgcggcgtcaggctggtggtctccgacgcccacgaagggttgaaagcggccattgccaaggtgctgaatgccacctggcagcgctgccgcgtccatttcatgcgcaacgtgctggcccatgcgggcaaacagggccgccgcgtcgtctcggccttcatcggcaccgccttcgcccaggacaccgcccgggccgcccgtgtcaggccgcccgtgcgcaatggcgccaggtggccgaccaactgcgccccagagcccggaaactggcggacttgatggacgacgccgaaaccgacgtcctcgcatacatggacttccccgccgcgcctgcactcgaccaatcccatcgagcgcctcaacggcgaaatcaagcgccgcaccgaggtcgtcggcatcttccccaacgtggccgctatcacccgactgatcggcgccatcctgctggaacagaacgacgaatgggccgtccagcgatcccgctatatgaccctggaatccgtcgcccccttgggcgatgatccgctgaccagcctgccgcccgtcgcggcagcctgactatcacggacaaccctgccggagattaaacggcgactgcgctgttacaccaatccttgggacacgatccgctcggatatctcaaccccggccgctcataaatccggcggctttccctcgtccacattctgtccgctcccatttcctttggggcggcatcgaatcacaacagattcaccggattcaataacattccggacgggccctcagaagcgatttggtggtactaatcacgacgctcaggtcgggctacgctgcaaatatgaaatccgatttggtgaggtcgaagcggctgaagggctttggagtcggctccgcgagacaagtgcgcccgtccatcgaggtcttcgtctgtcgatactgaaccgcaaacaagcgcagaatggcttgacgaacgaggaagacgccgagcgaactcagttgatagagtatcagtcggccgcagagttagagcgcagtatgcggctacttggctctatgatgtcgcagtctgaataattggtgagcgctgacaagtatttgcggccgagcctggattgcgatcaaccgcaccatgctcactattttctgcgctgctgcgattttcaccctttgaaggagctatatctgccccgcagggcgtgcgagaacctctcgcccaaggtcagcggcccgcaacccgctatctgattgataaataaggcgataccctgtccatttatacggcaatcggcggtatggcggatggggtgggattcgaacccacggtgggcatgaccccacgccggttttcaagaccggtgccttaaaccgctcggccacccatccggttcgacatgggtagcagaaggcgaggggggcggcaagacgtgcgaacgcaggccaacgcaggcgcggtgcgaaaacgcctggcctgtgcggtacatgacgggcaggtggagcggagagagcgccggcggcgtcggggcggggtggacgggaaagtcccccgggacccgacgccgccgggcccgacagtcggacggggcgagccgcgcgcctgctcctgaggtaccctgccgcctctgcgggggtgttgcggctctcctccggtgcgcggtccgtcgcggtcccgtcgggatcatggcacgccgtggggtctgccaaccgctgccatggtccgtcttaccggcctctggcgggtcggcggccgcacggcgcgtccctcgggcgggtgccgccgtcgccgcgggcggggagcagccgcacgcgcgtgtgccgcttgcaactccgaccgttcatgcgggcggcccgacgtcatatggtggaggatcactccaggcacataaccgcacgcccgcttttgcgtgcaggacgcctaatcaacctccggcggggatgtcacgggtccgagagcggggaccgtcaccctgtcgtgaacggctgccgacctcgcccggcctttatgcggcggccccgtctctggggcgtcccggcctcggggtttcgtcctgcttcctgtaggttagggatgggatcggttttcaccgccggcaagaccgcaggatgatttttcgcccgatttttttcacggcattttaaccataccgaccgggtggcccgaagcggggcaggaccatacgaattcaggcccgcgagcccctggccgggcttgccgcacgcggaagacgtgtggcacaaccggatgcgacaggacgcccccgaccatcctccccagagcattccggagatcggcatgatccgcgacaccggccttcccacgaccgaccaccgccccgcgatccgtccggaaaggcgggtggcacggctgatggccgcgaccggcctggctatggtgctggccgcctgcggcggcggacgtggcgcggaagaggcggtcgcctcggtccagccgcaggtggtggcaccgcagccgccagcccagcccgccgccccggtgccggtctcgctggcccatgcccgcaccgtcagcccggccgacccggccttcgatgcctgggttcagggggtgaagaaggaagcgcgtgcccagggaatttcggaaggcattcttgatgccgccttccgcgacgtcaccccgatcccgcgtgtgatcgaactcgatcgctcgcagccggaatcgaccatcaccttcgagcagtacatgacccgggtggtgccgcagcggcgcatcgatcagggccggcgcctgcgtggcgagttccaggccgatctggccgatgtcgaggcgcgcttcggcgtgccgtccgaagtggtggtggcgctctggggcgtcgagaccgattacggccgggtgaccggcacctatccggtcatcgcctcgctggcaacgctcgcctatgaggggcggcgggccaagttcttccggggcgagttgctgcacgcgctcaagatcctggacgagggccatatctcgcccgccgagatgcgcggatcctgggccggcgccatgggccagagccagttcatgccgtcgagcttcgtgtcctatgccgtcgacggcgacggcgacgggcgcaaggacatctggaacacccgcaaggacgtctttgcctcggccgccaattatctgtcgcggcgcggctggaacccgaatttcggctggggcgggccggtggaactgcccaagggcttcgatcgcagccgcatcggcctcgacggcgaaagccggacggcagcagcctgggccgccgccggcgtcacgggcaaggacggggccgccctgccggtcaccggcaacgtgccggcgaagatcgtgctgcccggcggccgcaacggcccggcctatctcgcgaccgagaattacgaggtgatcctgcgctggaaccgctcgcagtacttcgcgaccgcggtgggcacccttgccgaccggattgccggccgttaacatccggtcccgacagcgttcgaaaccgtggcgccgcggcggcttcccctgacggtccgccagagcggcgtctgttgttgacacaccgcccatccccatccccgcacttctccgggagacgacacgtccatggctccacccgtcgacggccgcgccgcccgcgcttcccgccgcacgctgatgctcacgggcgtggcccttgccgcgctggcgctgaccgcctgcgcggggcggccgacccagccgacatcgtccgccccggccgtggggcagggcacgacgccgtcctcaagctcggccgcccggccgaaccagaagatcggcaagccctatcaggtgatgggccgctggtattatccggccgacgagccgggctacagggaagagggcgtggcgtcctggtacgggccgaccttccacggcaagtacacggccaatggcgaggtctatgaccagaacgcgctgaccgccgcccataccaccctgccgctgccctcgatcgtgcgggtcaccaatctcgaaaacggccgggtgctgatcgtgcgcgtcaacgaccgcggacccttcgtgggtgaccgggtcatcgatctgtccaaacgctcggcccagctgctgggggtgatccagaagggcacggccagggtgcggctcgaaaacgtcaccgaggaatacgggctcgactacctgcccgaggcggatggcgtaatgctggcatcgctcggcgccgaggcgaccgcaaccccgcccgccacctcgccgcgcgggcccgtggtcgccaccgcgagcatcgtggaagaacaggtcgaggccgtgccggcaggagaggtcttcgcgaccccggtgccgccgcccgccggtacccgcacggcgccgggatcggaccgcacctatgtccaggtcggcgccttccgcgagcccgagaacgcgcgcgcgctggaaaaccggctgctcgactacggccacacggtgatcgcaccggcggatgtcgacggccagcgcttctatcgggtccggatcggcccgttcaaggcctcacgcgacgcggaaaaggtggtggcgcggctgagccgcgacggctacggtcgcggctcgatcgtcacggactgacggcgacgggcctttgtcgcccgccttcgccggtccatcttcaagtcctgagcagacgagctatcgaaagagcatgacggtgatcgcacagagcttgcgcaacggcacgacgttcccccgccgccggcgcgacatccgcggcgtcacggcacggatgagcgccggtatcgccctgctggcgtcggtgctggcttccgggacggcgcttgccgccgccccccatttcgaaagcgccgccaagcaggccatcctgctcgacgacaccaccggtgccgtgctctacgccaagaacgccgacgagcgcatggcgccgtcgtcgatgagcaagctgatgaccgcctacatcctgttcgagcgcatcaaggaaggccgggtgtcgatggacgacgccttcccggtcagcgaacgcgcctggcggatgggcggctccaagatgttcgtggaggtgaacacccgggtgaaggttcaggacctgatccagggcatcatcgtccagtccggcaacgacgcctgcgtcgtggtggccgaaggcctggccggcagcgaagaggccttcgcacggctgatgaacgaaaaggcccgcgagttgggcatgaccggcagccacttcatgaatgcctcgggctggcccgatcccgagcattatatgacggcccgcgacctttcgacgctcgcccggcggatcatcgacgacttccccgagttctataaattctattccgagaccgaatacacctataacggcatcaagcagggcaaccgcaacccgctgctttacaaggatatcggcgtcgacggcatgaagaccggccacaccgaagccggcggctacggtctgaccgcatcgatgaagcagggcgaccggcggctgatcatggtcgtgaacggcctcggcaacgtcaacgaacgctccaacgagggcgagcggctgctgtcctggggcatgcgcgaattcgagaaccgcaagctgttctccgccggcgaggtggtggagagcgccgaggtctggctgggcgatcagggcaccgtgccgctggtaccggcgcgggatctggtcgtcaccctgccggtggccgatcgcgacaatctggctgccaaggtggtctatgagggtccgatccaggcaccgatcgcccagggtcaggagatcgcgaagctggtggtcgacgtgcccggcgtcgagccgctttcggtgccgctggttgccggccagaacgtggccgaggccggaccggtcggccggatcctggctgccatctcacatttcgtttcgggtgctgccggcaacgccgaatcccagacgcagcagtgatgaggcggatcgtgacggcgaccggccgcttcatcaccctggaaggcggggaggggggtggcaagtccacccagcttcgccgtctggcgcggcatctgcgcgggcaggggatcgatgtggtcgaaacccgcgaaccgggaggtgcggccggcgccgaggcgatccggccgctgctgacccagggagatgtcgcccgctgggacgtgctgtcggaaaccctgctgctcgccgccgcccggcgcaatcatgtcgagcagaccatccgcccggcgctcgatgccgggctctgggtgatttccgaccgcttcatcgacagcacccgcgcctatcagggcggcgcccgcgggctcgaccccgccgtcatcgcgacgcttgaagcctgggtgctggacgggctgatgccggatctgaccgtgatcctggatcttccgcccgaaaccggcctggcccgcgccgggcggcggatcgaaaccgcggcccccgcggcgcccggcacgggcgaagaccggttcgagcgcatggggatcgatttccatcaggcgctgcgacaggcctttctggccatcgccgcagcagagcccgcaagatgcgcggtcgtggatgccaccgccgatatcgacgcggtcgaggcagccattcgcgatattgtgaccggtcgcctggctcctggccgggatgtgccggcatgagcgaggccatctcgggccatccgcggttcacaccacagcttgtggggcacgaggctgcggaacgcggctttctggaggcctggaacggcggccgtctggcccatgcctggatgatcaccgggccgcgcgggctgggcaaggcgacgcttgcctatcgcatcgcccgcttcgtgctggcgaccaccgaggatgccgcccgggccgcgaccgagggtgccgggctgttcggcggcccgccgctcttcgatcccgcgacaccgcctgcaagtctcgacatctccgccgagcatccggccgcccggcggatcgcggccggcagtcatcccgacctgctggtgctggaacgcggggtggacgaccggggccgcccgcgcaccgagatcaccgtgggcgaggcccgggaacttcgaccgtttctgggccagacatcggccgccggcggctggcgggtggtgatcatcgatgccgccgacgagatgaaccgcaatgccgccaattcggtgctgaagttgctggaggaaccgccggcgcaggcgctgatcctgatggtcgcccatgcgcccggccggctgctgcccaccatccgctcccgcgcccgacggctggcgctggcgccgctcgacgatgcgcggatggagcgctttctgacggcgcgcctgccggaacttgcgccatcacggcgcgccgtcgcccgggcgatggcggaaggcgcgcccggccgcgccttgacgctcgcacaggggcaggggcccgaactgctggccgccctgatcgcctgcctcgacaccggccggccgttgccggactggaaggccctgattgcgctgggggaggcggtgggccgacccgatgcgctggaggcctacgagaccctggtcgaggcctggggctggtggatggcccgctggctgcgcgcccatgcacgcgcgggcgggatcgaccgggaggtgatccccggcgaggcgcgcctggccgcgcgtctggccggggcgcgtccccttgaacaatgggtcgagctgtgggataggttgagcgcgcggctccgccaggcgctctccgcaaatctcgaccgcaagcaggtgctgatcaccgtcgttgccgagttcgcggcggcgagcggttgacgacgccgtacacgatgccgagatgagaccgacccggccccgcgaccccgtgagcggccggccctcccctgtccggagacgcccgatgtccgcggccgacgccttctacgtcacgacgccgatctattacgtcaacgacaagccccatatcggacacgcctacacgacgatctcgtgcgacgtgctggcccggttcatgcgtctggacggcaagcgggtgatgttcctgaccggcacggacgaacatggccagaaggtcgccaaatcggccgagctgaagggggtcgacccgcaggcttttaccgacgaggtgtctgagcgctttcgcgaactgaccggtctgctgaacgtcagcaatgacgatttcatccgcaccaccgagccccgtcaccgcgaagcctgtcaggcgctgtggaagaccctggtcgacaagggcgagatctatctcggctcctatgccggctggtattcggtccgcgacgaagccttctatcaggaaagcgagctggtcaacggcaaggccccgaccggcgccgaggtggaatgggtggaggagcccagctacttcttccggctttcggcctggggcgagaagctgctggcgcattacgagcgcaaccccgacgccattcagccggtcggccggcgcaacgaggtgctgagcttcatccgcagcgggctcaacgacctgtcggtgtcgcggaccaccttctcgtggggcgtgcctgtgccgggcgatccggcccatgtgatgtatgtctggatcgatgcgctcaccaactatctgaccgcgatcggctatcccgacacctcggacgagcgtttcaagaccttctggccgaccgtgcatcataccgtcggcaaggacatcgtccgcttccatgccgtctactggccggccttcctgatggctgccggcctgaccccgccgcgccgggtgttcgcccatggctggtggacgatcgaaggcgagaagatgtccaagagcctgggcaacacggtcgatccgcacgacctggtgtcgacctatggcctggaccagacccgctatttcctgctccgcgaagtgcccttcggcaatgatggcgacttctcgcgccaggcgatgatcgggcggatcaacaacgatctcgccaatgatttcggcaacctggtgcagcgcgtgctgtcgatggtgaccaagaactgcgcgggcaaggtgccgagccccggcgtcgatgccgccatgctcgcccaggagccgttgatcgccgaggcccacaacctgatcagccgcgtgcgcccgctggtgaccgcccaggcctacaacaaggcgctggaagaaatctgggccaccgtcggcgccgccaatcgctatatcgatcgcgaggcgccgtggacgctgcgcaagaccgatccggatgcgatgaaccgggtgctctatatcctgatggagaccatccgccatctggcgatcgtggtgcagcccttcctgccgacctcggcagcgcgcatcctggacttcctgaaggtcgatgccgccgatcgcagcttcacggcactgggcaccaagcacgctctgttgcccggccgcgagatcggggcgccgcagccgatcttcccgcgcatcgacacgactgcgaagactgaaggctgacgcatccgcgaagagacgcgcagccgaccgatcatccggaacgaagacgggtcacatgctggtcgacagccactgccatctcgatttccccgattttgccgaggaactcgatgccgtactcgacgcggcccgcgcctcgggcgtgatcgccttccagaccatctccacccggctttccacttacgagcgggtgcgggctgtggcggaagcccatgacgatgtctggtgctccgtcggcattcatccgcacgaggccggccccgaggggccggtcgcggcggagacgctgatcggcctggccgcccctgatgccagggtgatcggcatcggcgagaccgggctcgactactattacggcaagagcccgcgcgaggaccagatccggaccttcgaggcccattgcgaggccgcccgcgccaccgggctgccggtgatcatccacacccgcgatgccgatgacgacaccatcgacgtgctgacccggcagatggggaagggggcctttccgggcctgatccattgcttcacggggaccgaccgcctggcggatgcggcactcgagatggggatgtccatctccatctcgggcatcatcaccttccgcaatgccgaggaactgcgccagaccgtaaagcgcgtgccgctggaccggctgctggtcgaaaccgacgccccctatctggcgccggtgccgaagcgcggcaagcgcaacgagccggccttcgtcgcccataccgccgccttcctggccgggctgaaggaggtgacggcggacgagttaggaacggtcaccaccgacaatttctaccgcctgttctccaaggcgatccgtcctgccgcgacgggggccaccggagcgtgatgtcgccgatgcccccgcaccctgacccgcgcacaccgcccgcccccgggcggatccgcgtggtggtgctggggtcgggcacgtctgcgggcgtgccggtggtgggctgtggctgtccggtctgcctgtcgtccgatccgcgcgaccgccgtcgtcgtgcctcgatcatggtcgagaccgcgaccacccggatcgtggtcgataccgggccggatttccgcgaccagatgctgacggagcgggtcgaccggttggacgcggtgctctacacccatgctcatgccgaccatatccacggcatcgacgatctgcggcctttcgccttccggaccgaccggccgacgccggtctatggcgacgatttcaccatcgatcggctgttcgacggctttcgctacgtcttcccgaacccggccaaaccaaacccgctctatccgccgacggccgaggccatgcggatcgcgcaggatgccgtgttcacggtcggcgatatccgcatcgaggcctttccacaaacccatggccggatcaccagcctcggctttcgcttcggaccgatcgcctattcgaccgatgtgaatgcgctcgacgatgccgccttcgatgtactggccggcacccggctgtggatcgtcgactgcctgcgcgaacggccgcacatgacccattcctggttgaaccagaccctgagctggatcgaccgggtggcgcccgaacgggcattgctcacccatatgaaccacgaaatgggccatgcggcactggcagcgaaactgcccgagggcatcgagcccgccttcgacggcctggcggtcgagctggcctatgagaccgaagaagggtgagcagcattatggatcccctgatcatcaagaccatcttcctcggcacgctgcgggacccgatcctctggatcctgtgtgccgtgctgggctggcagactgaccggccgctccacaagctgctctggatgcttgtcgcgggcggactgttcttcggcctgttccgggggctggtctatcgttacggcttcgacgaggccctcaccggcgacacgttcgggatggtcatcgcctcggcaaccctgctcaccatcgccggcggcatggccgtgttcgggctgcgctctgcctggcaggcgcgagggaaggcacgggataccgccctgcaggatacgggccggaagggcgaaagccggccgggcggaagccggaagggcggaacgaggccggtccagaccgatgcgccgcgcaggcgccgcaatgacgaccgggcccgcaagcggcggagctgatctcagtcagcggtcagcgccgtgcgaagcccggcctcgatataggcataggcgcgctccctgaagctcgcgccgtcggcaccaagccgcaggaaatccgagatcacgacctcggcaaggccgtgaacctgggtccagaccatcagggccagaaagccgatccgatccgcctcgcaaactccggccatctgcgcccgacggcgcacttccgcaagcaatggggcgaaggcggcttccgacgcggccgcaagcgctgcattggcgggatcacgggcctcgcccgagcggtggatcagccggaagagattgggatgctccacggcgaagccgacataggcatccagcaggtcgcgtagcgattggggtgccacggccagacagcgcgcccggagcagggcatagccctcgatcatcaccgcatgctcgaacgcacgccggtcggcgaaatggtggtagggggccgcctcggacaccccgaccaccttggcaagcggcctcagccccagggtcgaggcgtcgtggtccttaagatgaacgatcgccgcctcgaccagcattctggggaggtcgccgtgatgatatctggccttggccatcggccctttccgtgacgctgacagcactgcacggccatagtgatcagggccagccgattgttcaacggcttccgcccgcgtctctggccagaaagcagaggcaggcgacaccggcgagaccgctcataagggcaggaacggccagttcggccggcccgccgaccgcaggcaccaggccggcccccaaggctccaccggtgatctgaacaaggccgatcaatcccgatgccagaccggcccggctggaaaaggccgtcatcaccgtgctgccgaccacgggcagcaccagaccgagccccagatcgaagatcgccatggcggcaagcgtcggtagcggagccaccggaagggtgagcatggcgagcgtaccggcaacggcgatgccggcgccgacccgcatcagaccgcgcggacgcatgcgatctgccagccgcgcggcaagcacggtcccgatgacgaacccacccatggtgagcagcggaaacgtgccgaccaccgatgcgcccagccccaggccctgcacgaaaatcgcaggcgccccaaccagaaagacgaacagcgccgcaagaagcagcgcgctgccggcaagggcagtaccgatgcccggctcgcgcagcattccggcatagctgcgcggcagggcagtgatcggcgtggcggcggtgcccgacggccgcgtttcaggcaaccggtgcagaagcggcagcagcagggcggcatagacgaatgcgaccaggaagatcgcccgccagccgacgccatcggtcagaagtccgccgatcagcggcgccgccaccggagcgaccgagaagaccagggtgatcagagccatgatccgcgtcagcgccgccccgtcatgacggtcacgggcgattgcgcggccgaccacaagtccggcacaggcaccgacggcctgaagaatgcgcgccagaatcagccagatcgccgaaggtgccgccatcgcgatcacacagccgacaaggtatgccgcaaatcccggcaccagcacccgacgacgcccgatgcggtcggaaagcggccccaggatcgggttggcgagggcgaaggcgaccagacccgcggtcaccgtcgcctgaacggtcccaaggccgacccccagatcattcgccacggccggcagggccggcagccaggccgtggcggcaaactccccaaggccggccatgccggcgagaagcaggatcaggcgccgatcggctgccggcgcggaatcggactgcatggtcatgaggcatatcctccaatcttatcgttgttaagatatgcgcctgagacggtcggtcgcacaaggggaaagcaggggcgggggccgggatcttggcaaggcggtccgccgttcccatgtgaagagcgccggggcacgcccccgccgggcggccgaatccttcgccgcccctttcgaatgggagacgcagccagccatggcccgactgcgcctgttccgcgtcgctgccctgctcgggcgcgatgcccttgccctggtctccagcatccgtgaccgccgtcagagctgggcggccagggccgctgtgatcggcgtgctcgcctatgtggtgagcccgctcgacctcatccccgatgtgctgatgatcttcggcattctggacgatatcgccgtggtgagtttcggcttgcgctgggccgagcggcgaacgccgcccgaggtcctggacgaccatcgcggccgggtgaaccggctgttcgaccgctggttcggccggccgtcggagccggcgcgggagccccgctggacccgcaactgaccgggtcaaaaaaattccgaaaaaatacgacggccgggatgaaacccggccgtcgctgcgtctacgggatatgggcacgatacgcaacggcttcgatgtggttggggaactgggggcgcttcggcgttatgcccgggtgctgacccgcgacgaggcggatgccgaggatctcgtgcacgacgcgctggtccgtgcctatgaaaagcggggcagctttcgcagcggcggcaatctgaagggctggctgctggcgatcgtgcacaacaccttcgtctccgcccggcgcgcgcggctggcgcgtcagacccgcgaggagcgctcggccgagctggaaccgctgcatgcggaaccggcccaggacggcgcggtccggctggacgaggtgcggcgggcattcctgcagctccccgacgagcagcgcgaagcgctgcatctggtggcgatcgaagggttgtcctaccaggaagcggcggcagcgctcgacgtgccggtcggaacattgatgtcgcggatcggccgcgcgcgggccgcccttcgggcgctcgacgaggccgggcccgcagcggcgcggaccgccggttccccgccaaagctccgaatcgttggagggtcggatgacggcaccgactgagcgcctgcccgatttcgatctgcatgcctatgtcgacggacagctcgacattgcgcggcggatggaggttgaggattacctgtctcgtcatcccgaggtggcggcgcaggtgatggccgatctgcgcacccgcgatgcgctccggatcgccttcggtggcgcccagggccgtccgtcgccacggctcatcgatgcggcgcggcgtgtggaacgcggtctggcctttaccggcgtgatgcgtcggatgcagcgggcggcagcggtggttgccctgctgtcgatcggctgggcggcccatgcccagttcggtggcatctcgaccagcgaggcggcccccacgccgccgggcttcgtagacgaggcgctgatggcgcatcgggtggcgatgcttcgtcacggcatggtgtccgcgccgacggcggcagccttcgacgcccaggaaatccgccaggccacgcgcatttccctgccggttctgccggaagactggcgggtgatcgatgtccaggtttttccgtccaatgacggcccgagcgttgagatgacgatcgaggaccggaaactcggacggatgtcgctcttcgcggtcagggtcgacgagttcgacgtctcctggccgcaggaagtgaaggcggaagacgaggcggccgccttctggcagatcggcgatcaggcctatgtcctgaccgcctctgtcgcggacccgcgcgatctcggcaaagccgcggatcgcctggcccgcagcctctactgaacgatcgaacgcaaacgcaacggcaatgagttgacgagggcccccggcggcaatgccgcccggaacgggcccccaaaggggaccacaccagatgaacctgccacccttcgcccgcgaagcggcatacgcccagacgggcgccgcgtttgacgaaggcctccggcggcacatgctccgggtctacaactacatggccctggggctcgtcctcaccggcatcgtcgcattcgtggtgggcaccacgcccgcactttatgtgccgatcttcagcacgccgctcaaatgggtggtgatgctggcgccgctcgccttcgtgctcgtgttctcgttccgcatccacaagatgtcggctgccggagcacagaccgccttctgggccttctgtgcggtcatgggcctgtcactgtcgtcgatcttcctggtcttcaccggcgccagcatcgcccggaccttcttcatcacggccgccatgttcggcgccaccagcctttacggctacaccaccaagcgggacctgtcgaagttcggctcgttcctggtcatgggcctgatcggcgtgatcatcgccagcctggtgaacatcttcatcggctcgtcgatgctgcagttcgtggtctcggtggcaggcgtgctggtcttcgtcggcctgaccgcctgggacacccagtcgatcaaggagcagtactccgagaactgggaccatgaatcgagccagaagctggcggtgttcggcgcgttctcgctttacctgaacttcgtcaacctcttccagctgctgctgagcctgaccggccagcgcgaggagtgacggccgccggtgccggggcagggggcttcaaggcctccgcccggtgccggagggcaggggtgccgccagcacctcgcgtcccgcgtgaagtccaccaggctgcgactatcatcacacgtcatccgtcatcacgggaacagatcacgtcatggacgcccaggaccgcaaagccatcgacgacctctttgccaagctcggccaggtcgaacgcagcgccggtgcgcgcgatgccgaggcagagcagttcatccgtcagcgcgtcgacgcgcagcccggctcgccctactacatggcgcagaccatcgtcatccaggagcatgcgctgaatgcggcgcaggcccgtatccaggagctggagcagcagctcgccagccggcccgcctcgggcggtggcttcctctcgggcctgttcggcggcggcagccgccaggctccgcagccgcagccccggcaggcttatactcagcagggctatcgccagcagcagccgggatacggtcagcagccgggcggggccccctggggggcgcagcctcagcgttccggcggcgggttcctggcgggtgcagcccagaccgccatgggtgtcgcgggcggcgtggtgctcggcaacatgatcgccggcatgctcgcacccgatgaagccatggcagccgcaaccgaagccatgcccgaagagctcgatcccgcggccgacatgatggccgacgagggtggcgacttcttcggcggcgacgaggaattgttctgattttccatcgggctggctgcccccgttcagcccgatggttcgacgttcggcgaagtcgtcctcgagacccctggcgcttcgctgacaccggccggcacggccatttcgaccctgcccacgtctcgtgccggtctgcttccgacccgtccgccctgacggtcggaagccttgcccaaccggtccggttgcccccggatcggtcgccgatgcggaagtgacttggccgggaaacggttcaccgtttcccggcatttttttgtcggctcaggcctcgtcgcgggcaaagatcatgatgcggaacagctcgacgaagccggcatgggcatagagcgccgttccgtcgacggatgcttccagacagcaggcgagggcgccccgcatctccgccagctgcagggcgtgcgcgaccagtcggctgccatagccgcgcccctgacgggccggcagcgtgccgacatcgtcgaggcgcgcaatccggcccgccatggacagggtcgccgagcagaccggctcgtcctccacgaagccggtcagatgcaccagacgatgtccggcatgcctggctgcatggtggcgatcgctatactgccgcgaaatctcaggcccgccgccgaaagcttcggccaacgggcggctccagacctcaaggtcatcgatggcccggaccacaaggtcgacgccgacggcgcccggccggggttgccgcttcgccggatcgatcgtcatcgcggtcgtgatcccggacggcgtcagcccgtagccggcagcccaggcttcgtatgccgacgcccggtcttcgggcaaagcgagcgagaagggcaggccggcgccggtcatgaaggcaaccccacgatcagccgcggcgtccggcgcctcggccggcagatgcagggacagcaggttcagcgccgccgtttccacgccggtgacataggcccggacacctcgcccgaagccctcatgctgggcgctgatggccgtgaagaaatgatcctcggcgcgataccagttggggatcgctgtcccgtgtcggaggtcggtcaatgtcgatcccttatggcttaccgaccctcgggtctggctggcagtgtggcgcggcagaatgcatcaagaccgggcaccggtcaccaaaccatatgtcaggccatgacagcgtccgccataattcaggtcttattttccataatgttgcttatgcgattctaatgaaattctggagggcgcggtttttggccaagatcccccggtcgtcaagaaccgcgcctgagatcagtcccgacctccggtcaggcaaccgcctccagccgtatctcgccatcgtggaggaagcaggtccaggtgaagagtttcagatcgatcggattgggcagccggacatcggcaaccgtgggcaatctctgctcctgcgcatcgaaggcccgatcgatctgggagatcgtcacgatgatcgtgccggccgtccgggcgaaggtcttgagaacgtcgacctgccggcccagttccggcgtctggcgccgctgatcgagcagctggagatagtcgatcaccgccagggttccatgcggtgcatcgtgaagccggtcaacgacgtgatcggcgcagatctcgtcggaggtatcgatcacgatccggccactggcaatggcctgagccacaccaggcgccatcatccgttcaccgacgtcccgctcggtatagtccagggtgaagaaaaaggcctgacggcccgccactgcagcttcagccaccatctcaagcgcaagcagcgtcttgccctggcccgggcgagcgccaagcagtaccaggtcaccgggcaccagcccgttcaacacccgggcaccggggcccgcaccttcacgagcagcggcggcgagatggctccagctgcgaaagccttcatcccgggccacatggtccagagcctgatggagcgggttgccggtgctgcgagacagcaggcgtgcatggcgcttcagtcggaaaatcggcgcagacagtctcatcggagagcccttctctctcgcgggcagatgtcgcaacccctcctcatgcggcctgcccgtgacgagccggatctccggtccacgattcgccctgcatgtcggatgctttcccggtcggagggaggaggcccgggccgggcctgagatctccaggctagcggctgatccgggtgcgtacaacataaacaagtcagcctccatgcaacgcgacaggtgcaatcccgaccgaatcggtcttatatagaccggaccacccgaacccgaccgggagcccgcattccatgagccttcttgcccaaacccggatttccgtgctggacctgtcgccgatcagggccggccatccgattgcccaaagctatgccgacagcctcgctctggcccgccatgtcgacgagctgggctatacccgctattggctggcggagcatcacaacattccgggggtcgccagttcggccaccgccatcctcatcggccatattgccggaggcacgcgccggattcgcgtcggatccggcggcatcatgctgcccaatcacgcccccttgatcgtcgccgaacaattcggaacgctggagagcctctatccgggccgcatcgatctgggcctcggccgggcgcccggaaccgacggcttgaccgcacgggcgctgcgccgcgacctgaccggccgcccggaagacttccctgccctgctgatggagctgcgcggcttcctggccaagccggaatcttcgtcgccacgccgggtgcgggcgattccgggcgaaggcctggaggtaccgatctggctgctgggctccagcgatttcagcgcccgccttgccggcaagctgggcctgcccttcgccttcgcgggccagttcgcgccgcgctacatgctggaagcactcgcgatctaccgccgggcctttgaaccgtcggagacgctgcaggccccctatgcgatgatcggcaccaacgtgattgccgccgagaccgacgaagaggccgactatctctcgacctcggcgaagcagcacgtgctgaacctgatccgcaacgacatgcagccgctggcaccgccggtggacgacatggacgcgctctggtcggtgcacgaagcccgggccgtggaagacttcctcggcgcctcgatcatcggtggccgcgagaccgtccgcaaggggctggaccggttgatcgggctgaccggcgccaatgaggtgatgatcaatgcggcgatctatgaccaggatctgcgtcgtcggtcgttctcgatcgtctcggagctgaaggccgaggcggcgcaggccgcctgacccacgcggcgcagaccgccggacccaccgggcgcccgacttaccaggcgcctgccccatcgggcggccctgcacccgtgcggaaatccaccagatggacctgcggtggttcatcatggacccggggcggcggcggcggtatgaaaggggcccgacacggccgaagccgcccctctccatccagatggaagccgcccgatgacggacgccgcccctgcccgccccgccctgcccgacgacgcaaccgcggaccgccgcgacatccgggccctgctgcgggtgatggcgcggctgcgcgaccccgagagcggctgcccctgggacgtcgcccaggatttctcgaccattgcaccctatacgatcgaagaagcctacgaggttgcggacgccatcgatcgcggctccatggccgatctggtcgacgagttgggcgatctgctgctccaggtggtctttcatgcccgcatggccgaagaggccggcgccttcgccttccccgatgtggtggacgcgatcgtcaccaagatgatccgccggcatcctcatgtctttgcggaggatgccggcaccgaccaggatgccgtgcgccggcgctgggaggatatcaaggcggaagaacgcgccgccaaagtcgcccgcgccgatgccgccccggccaccgccccaagcctgctggatgatgtcggccgggcgatgccggcgctgatgcgcgccgcaaagctcggcaagcgcgccgcccggatcggcttcgactggccggatgcccggggcgtgctcgacaaggtcgccgaagagacggcggagctgcgtgaggcgatggatgccggccatcacgatgccgtgcgcgaagaggtgggcgacctgctgttcagcgttgcccagcttgcccgcaagcttcatctcgatcccgaagatgccctgcggcgggccgatgccaagttcgagcggcggtttcgcgcccttgaaacccggctcgcagctgaagaaggcacagctgaagaaggcgatgggccggtcgatgccgaccggctggaagcgctctggcaggcggtgaaggcttccgaggccgaagccgctctcatacctgaagacctccccggaccagacaaggagacgacgtgatgtccgaccgcctgaccgtcctcatcaccggcgcaaccgccggtttcggcgccgccctcgcccgcgcctatgccgcttccggcgaccgtctggtgctggtcgggcgccgtaccgagcgtctggaagcgctcaaggtcgaactcggcggcgaggtgcatgtggtcaccctcgacgtgcgcgaccgcaaggccgtggaagaagcgatggccgccctgcccgcccccttcgacgccgtcgacgtgctgatcaacaatgccggcctcgccctgggcctcaaccccgccccagcgcggatctcgatgactgggacaccatgatcgacaccaacatcaagggcgtgacctatatgacccgcgcgatgctgccgggcatggtcgcccgcgatcgcggtcatatcatcaatctgggctcggttgccggcacctacccctatccgggcggcaatgtctatggcggcaccaaggctttcgtgcaccagttctcgctcaacctgcgggccgatctgctgggggccaatgtccgcgtcaccagcatcgagccgggcatggcggataccgagttcagcacggtgcgcttcggcggcgacaaggaacgggccgcgaaggtctatgaaggcatgacgccgatgagtgccgatgacatcgccaacgtcatccactgggtcagcaagaccccccggcacctcaacatcaacgtgctggagctgatgccggtcatgcaggccttcaacgccttcgcggtgaagcgcggctgaagccgggccttgcccatcatcagaaagcccgccccggtcgcaccggggcgggctttttctttccggaattccagaagatcggtcgataactctttgtcagaaaagaagaaggccgcagccccgtttccgggactgcggcctccatcgatacatagaccgtcgatccgaagatcgggtcggcaggtatcggctggatcagaagtccatgccgcccatgccacccataccgcccatgccaccggccggagcagcgtccttcttctcgggcttctcggcgaccatggcctcggtggtgatcagcaggccgaccaccgaggccgcatcctgcagcgcgctgcggacgaccttcaccgggtcgatgatgccggccttcaccaggtcggtatactcgcccttctgcgcgtcgaagccccagttgctgtcgtcgctctcggccagcttgccggccacgacggcaccgtcgacgccggcattgtcggcgatctgacggaccggacgggtcagggcgcggcggacgatgtcgatgccggtggtctggtcggcgttgacgccggtcaggccctcaagcgccttggtggcgtagagcagcgcagtgccgccgcccggaacgatgccctcttcgaccgcagcgcgggtcgcatgcagcgcgtcgtcgacgcgatccttgcgctccttcacctcggtctcggtggcgccgccgacgcggatcaccgcgacgccgccggccagcttcgccagacgctcctgcagcttctcgcggtcgtagtccgaggtggtctcctcgatctgcgccttgatctgcgcgacgcggccctggatctcctccttctcgcccgcaccgtcgacgatggtggtgtcgtccttggtgatgcgaacggtcttggcggtgcccagcatgtcgacggtaaccgtctccagcttgatgcccaggtcttcagagatcacctggccgccggtcaggatcgcgatgtcctgcagcatggccttgcggcgatcgccgaagcccggcgccttcacggcggcgacgcgcaggccgccacgcagcttgttcacgaccagggtcgccagggcctcgccctcgacgtcctcggcaatgatcagcagcggacggttctgctgcacgacggcctcaaggaccggcagcatcggctgaaggctggagagcttcttctcgtagagaaggatcagcgggctctcgagctcggcttccatcttctcggcattggtcacgaagtacggcgagacatagccgcggtcgaactgcatgccctcgacgacatccagctcggtcagcaggctcttcgcctcttcgaccgtgatcacgccttccttgccgaccttctgcatggcctcggcgatcatctcgccgatctcacgctcgccattggccgagatggtgccgacctgggcaatctcgtccgaggtgttgatcgggttggcgcgcgacttcagggtctcgacgaccttggcaacggcctggtcgatgccgcgcttcaggtccatcgggttcatgccggcggcgacggccttcaggccctcgttgaagatcgcctgggcgagaacggtggcggtggtggtgccgtcaccggcgttgtcggcggtcttcgaggcaacctcgcggaccagctgcgcgcccatgttctcgaacttgtccgacagctcgatttccttggcgaccgagacgccgtccttggtgatgcgcggcgcgccgaaggacttctcgatcacgacgttgcggcccttcgggcccagcgtcaccttcacggcattggccagggcgtcgacaccgcgctgaatcttcacgcgcgcatcgttaccaaacttgatttccttggcagccatggttcttcctcaaaagctctgatgtggtcaggggatgggacccgcctggcggccatcccggtccctggtcacgaaatttggtccggcgaaagcggaaccggatgcgggatgaaggggatcagccctcgatcacgccgaagatgtcctgctccttcaggatcagaacgtcctggccgtcgaccttcacctcggtgcccgaccacttgccgtagaggacgcggtcgccgaccttcacgtcgagcgccacaaccttgccgtcctcgccgcggacgccattgccgaccgcaatgacttcgccctgctgcggcttctccttggcggtgtcggggatgatgatgccgccggccgtcttctgctcctgctcgatcgggcgcacaacgacgcgatcatgcagcggacgaatcgccatgagtactctccagtctgagcgatttctgaggatatgcccggcccgttcaggctctcccggatgggccggacctgcacgggctgtttagcactcctcaggtaagagtgctagcaaatcgttcaagggccgccggcccaaaaaaatcacgtcggcgacacaggcgccgagagatgcggccagcgggcgtggaaccggctcagatcctggggcttcaggcggacggcgacatgggccacggcctcatcatccgcacgttccgcgacttcaccgtgctcatagagccaggccagggcctggccgtcggcatgcggcacgtcgaaatgggcaagctcgtccccgatcgcgagccgggcatcgatcgcggcgaacaaccggtcgagcccttcgccggagagggctgagcccgcaaccgcatcttcggcgcgcgccgcctcgttcagcacccgctcccgcgcctcgccttccagcatgtcgagcttgttgcggaattcgagcacgtcgtcggccaggcgatggcccatgcccagctcgcccagcacatggagcacgtcgcgccgctgggcgccggtgtccgggtctgcgatgtcgcggacatggatgatcagcgccgcctcgcgcacctcttcaagcgtcgcccggaaggcggcgatgaggccggtcggcagttcggagacgaagcccacggtgtcggacaggatcacccgccggcccgagggcaggtcgagcgcgcgcatggtcgggtccagcgtcgcgaacagcatatccttggccatcaccgatgcgccggtgacccgattgaacagcgtcgacttgccggcattggtgtagccgaccagggccaccaccggataggggacttcacggcgcttcttgcggtgcagttcccgggtgcggacgacctcggcaagctgaagcttcagcctggccatcttgtcgtcgatgatccggcggtcggtctcgatctgggtttcgccagggccggccaggaagccgcggccgccgcgctggcgctccagatgggtccagctgcgcaccagacggctgcgctgatagccgagccgggcaagctcgacctgcaaccgcccttcccgggtgcgggcacggtcggcgaaaatctccagaatcagccagatccggtcgatgaccttgacgttccaggccttctccagattgcgctgctggatgggcgtcagcggccggttcatcaccaccagatcgaccggtgcggcttcgagcttcgccttgatctcgtcgaccttgcccgaccccagcagggtggaaggccgcatgcgcgcaaccggcacaaccagcccctcggcgacgtcgaggccgagcgcgccggtcagcgccatcccctcgtccagccgcgcacgcatgctgcgcaccgcttcgggatcgtcctcgaccggggccggcgcaccgcgccgctgctccttgacgtcgggctgcagaaccagggcccgggccggcagatcgccgtcgggccggatgatgatcttatcgtcggacaaaccgctccttcatgcgccgggcgcaaaggacaggaaaggttgcgacatcatgtcgccagcggtcgccaccccgcccccaaaggcgatgacaggccgcacgcgaccccgcggcggcctggtcagaaaccctgccggacaggggacccgcgcgggcagagcacgtgttccccgtccgtctcgaccatcaatggtcgccgtgatccttgtcgcgatcgccctgagcctgggcatcgaacagctggaccggcaccgtcggcatgacggtcgagatagcatgcttgtacacgagctgactgtgcccgtccctccgcagcagcacggagaagttgtcgaaccaggtcacgacaccttgaagcttgacaccgttgaccaggaacacggtcaccggagtcttgttcttccggatgtagttcaggaacacatcctgaaggttctggttcttttcagacgccatgagaggcaccccttcttgttatcatgcggcgatgttggtctgtctcccggccgccgcgaccgcttttcgggtcttagccgggatctttgtcgagccggttgccgggcgtcccccgcccgggtaccgcgtgccatcacacgccggcccggagccgtaccatatcggaccgcccgatcaggtaagacccatcgccgaagttacaaggtcgtgcaggtggcggcaatcgacaacccggagatctgcgcgtgtaagcaccccttcatcaagactcgtgccgtcgtggaccagaaggatgccggtgcagcccgcggcccgggcacagtccatgtcgaccagggcatcgccgacaaaccagacattcgggccggcctcgcggccgacggtggccagcgcctctatgaccggcgccgcatcgggcttgtcgcgggcggcatcgccggcccccagcagggcgccgaagcgttccccccaccccagatgggcaacctcggcccgcaggaacggcccctgcttgttgctgaccacaccgagcggaatcccctgccccgccagcaggtcgagcagatcggcagccccctccatggcgaccacggtctcgaggtgccgcgcggcataggctgccttgaaacgcagcgccgcctcctgccagcgatccccgaaaatctcggggaaagtgtcgcgcatcgagcggcggatgcgcagccgcccctcttccggcgtcagcgccggcggcttgccataggcgatcatgacgtcgttataggcggcgaggatcgctccccaggcatcgaccagggtgtggtcccagtcgaacagcacggcgtcgggacggccgagccgcgcaaaggcagccgcatcgtcaagcccgcgctcgggcatggtcagggtcatggcgaaggcggggctccggatcggttcagaagaattcgaggcggacagagaacagtttttcaaccttgcggatactgtcggccagggcgaagagcacgatccggtcgcgtgccttgatcaccgtatcgccgtcgggagcgatgaccttgccctcgcgcaccacggcgccgatgatcaccccctgcggcaggccggtctcccgaagcggacgcccgaccagcggtgacgtctccagcgcatcggcctcgatgatctcgccgccgccatcctgaaggctgtagacggcatggatgcggccacgccggacatgctgcaggatccgcgacaccgtcacggcccgcggattgatcaccacatcgacgcccagcgagctgatcagcggcgggtaggtcggattgttgaccagcgccatagcccgcttgcagcccatgcgcttggccagcagggccgagaggatgttggattcgtcgtcattggtcacggtgacgatcgtctcggcgccgccggtattggcgtctcccagcaggtccgggtcgagcccgctgcccgaaagcaccaggctgtgggtcagctgatccgcgatccgttccgcccgatggcgatcggcttcgatcagcttgatgttcagccgcggctgcagcttttcaagctgcgagaccaggaacaggccgatattgccgccaccgaccacgatgatccggcgcgcttcgcgttcctcgaagccgaagatcgccattgcccgcggcacgtggtcccgatccgcgacgaaatagatctggtcgccggcgatgatctgatcgcgcggggtgggcacgatcatccggtccccccggatgatggacacgatccggagcgtgagatccgggaacagttcggtcagctgagagaggggcgtgttgaccaccggacacgaggcttccgccttcagactgaccagatagacccgatcaccggcgaagggaatgacgtcggtcgcccccggcaccttcagccgccgcccgattgcccgtgccacttccagttcaggcgagatgatcacgtcgatcggcaggttctcgcggctgaacagatcggcccacatcggctgcagatagccctgatggcggacgcgcgcgatcttggtcgggacgttgaacagcgcatgcgccacctgacaggcgaccatgttgacctcgtctgaggccgtgaccgcgatcagcatgtcggcatcggccgcccccgcctgctccagcacgtcgggatgcgaggcgtagccgatcaaccccttgatctcgagcgattcggaaagcttgcggatcaggtcttccgactggtcgatgacggtgatgtcgttctcttcgcgcaccaacgagcgtgcgatgttgtgccccacctggccggcgccgcagatgatgaccttcatgtggccctgccctttcgacgatctgccagcgggttacgacgacgtgttgatgccgaggcttttgagcttgcggtgcagcgccgagcgctccatgcccacaaagctcgccgttcgcgacacattaccgttgaagcgggcgacctgggccttcaggtaattgcgctcaaaaacctcgcgcgcgtcgcgcaacggcaggcccatgatctcgccatcttcagacgggttgaccaggactggtgcccctgcacccagctcgggcggcaacatctcggcacggatctcggtctggccgtcgccaggcgccatgatcagcagccactcgataacgttgcgcaactgacgcacgttgccgggccactctccggcctgaagcacggccagcgcatccgcccccaggctgcgcggcggcagacccgacatcgccgctgcccgcgccatgaaatgccgcgccagttcggggatgtcgtcccgccgttctttcaggctgggtaccctgagcggcacgacgttcaggcggtagaacagatcctcgcggaaacgccccgactggatctcgctcgcaagatcgcggttggtggccgccaccacccgcacatcgacctcgatcggccgctcgccgccaagccgggtgaagcgctgttcgtgcagggcacgcaccaccttgccctgggtctccatcggcaggtccgagacctcatcgaggaacagagtaccggaatgggcctgttcgaacaggccgagcttgcgcggcgtgtcgggaccaagcgcccccggctccgcgccgaacagctccgcctccacgcgatctggcgtcatgatggcgcagttcagcaccacgaatggcgcatcggcccggcgcgaatgggtatggatccgccgcgcggccacctccttgcccgcaccggccgggccggtcaccagcacgcggctgttggtcggcgccacccgctcgatcgtgtgccgcagctgacgcaccgccgccgaagtgccgatcagctcggcatcgccgccggtgcgcttcttcaggtcggccacttcgcggcgcaactttgcatgctcgatggcattgcgcaccaccagcagcaggcgatcggatttgaacggcttctcgatgaaatcataagcaccttcgcggatggcggtgaccgccgtctcgatggtgccatgaccgctgaacatcaccaccggcaggccgggatggtcgcgcacgatttcggacaggatgcccatgccgtcgagccggctgccatcgagccagatgtcaagcagcaccatatcgggcagccgggccgcgacctcggccagcgcctcgtcgctgttgcgcgccgtccgggcggtatagccctcgtcgcggagcagttcagcgaccaggtgccggatgtcgtcttcgtcatcgacgatcagaatgtccgatggcatcgcgtcagggccttgtagaaccagaagagctgttgggaccgtcctgccgtggcgtggaatgccggttgtctgacgcggccgcgccggggacggcacccggatcggccaggggcagttccagtgtcgccaccgccccgatgatacgcccgtcggccgatcgacggtcgtcgatcgacaggcggccgccgtgatcttccatgatcttgcggacgatggcgaggcccaaacccgttcccttcgccttggtggtgacgtaaggctcggtcagtcgcccgcggaacgcctcgggcaggcccttgccggcgtcttcgacggtgatcagggcccgcctctcccccgcctccagaacgatccggatcacccggcgctcttcgggcagatccttgaccggcaccccttcgccctcggccacgacgtcaaccgcctgaccggcattgaccagcagattggtcaaggcctgcccgagcaggcgcgcatccgcccgtaccatcaccggaccgtccggccgttccagatcaaacttcagttcggggcgtcccatgcgctgggtgatcgaggcttcgcgcagcaacggccccagatcaacatcggccatcaccggctgcggcatgcgggcgaaggacgagaactcgttcaccatccgtccgatatcgccgacctgacggatgatggtctcggtgcaggcgacgaatgtgtcgggatcggaggtgatttccttcagatatttccgcttcagccgctcggccgacagctggatcggggtcagcgggttcttgatctcgtgggcgatgcgacgtgccacatccgaccaggcggccgtgcgctgcgccaccatcaattctgtgatgtcgtcgaaggtcaccaccacgccgacggttgccgccgcgccgtcgcggccgcgctgaaccaccagatcggccgccaggcgcaccatcagattgcgatgattgccgccggcaaccgcctcgatctgggcctggaccacccgatccggccgttcggccaggcgggcgagcaacggctccagcgccggcagaagctcggtgaccggccggtccactgcctgatcgaaatccacccccagaagggccagagccgaacgattggccagattgacccggttttcggcatcgagaccgataacacccgccgagacgccctccagcaccttctcggtgaagcggcggcgggtgtcgatctggcgattggccgccagaagtgcctcgcgttgcgccgccaactgacgggtcatgcggttgaaggcccgggccagaatgccgacctcgtcatcctcccgcccctccggcacctgcgcggtcagatcgccgccgcgcacccgttccgcggcgccgaccagctggctgaccggccgggcgatcgagcgcgcgaccagaaagccgatccacaccgccgcgagcagcagaagaagtgcgatcagcacgaacaggccggtgaagctgagctgtatacccgaccggcgggtatccgcctcttcgtattgcgagaccgcccggttcacctgctccatatggtcgagcacggtgctgtcgacgaaccgccccacatacaggaaaacgtcccccaggctcggcacctggaccagcgcccgtacccgatcgtcctggcggtcggtcagcagcaccacctcgccccgccgcgcctcgtccagcagcggctgcggcacggtggcgaattccaggctgaagctcagttccgtgcgggcaagaatgcggccatcgccgcggaagaccatcgcctcgggcagattgcgaagcgccgcctggatctcgatcaaccgctgaagccggccattggcatcaaaggtggtcagggcctcgcggtcgatgtcgcccgccatggcgatgacatccgctcggatggtgcgctgatgctccagcagataggcctgggccacctcgcgcgactggctgagcgccgtgcggacccgctcgttgaaccaggtctgcacgccgaaatcgaagaagagcgccgagaacaccatcacgacgatcgcgggcagcgccgccaccagcgcgaacagcgtcaccagcctcagttgcagccgcgaggcggtcgactgccggcgccgttgcagccaaagccggaccagcccatgggccagcatgccgaccagcagcagcagcagggccagatcgatgttcagcagaatgaacaccgtgccggcatcggcccgggcctcggtcccccagttgttgccgaagaacgaaagccccgtcagcgccagataggtcgcaacaccagcacccagcgccgcaatcagcagggcgatcgtgaagatccggccgggacggatgcgggccacgagcacggccatgcggcggccgaaattgccggcaatgcgaccggcaacccgctggtgccgcatctcgggcgcccgcgacggttgcggccgttcctcctgcacgccctccccggcggatccggtggtcatctgccggccacgctgccgccgatgcgggtcggctcacccccgcgggtgacctcgatcgacagatcgcggatcttcttgcgcagggtgttgcggttcagccccagcacctgggccgccttgatctgattgccgcgggttgcgaccagggtacgctcgatcagcggccgctcgacctcgcgcagaatccgatcatagagacctgccggcggcaggccgtcatcatgggcatcgaaatactcggcgagatggaaatcgatcgcctcacccaggctgccgccgcggcgccggtcgtcatccgccggcatcggctcggcgaactcgccctcgatatcggggcgatagatcacgtcctccgccgacagcgccgccaggcgacgcatcagattctcaagctcgcggacattgccgggccagtgataggcggtcagcacctcgatcgcatcggccgacagggtcttgagcggcaggccctgatcgcaggcgagcttcaggaaatgccgggccagatccgcgatgtcttcccgccgctcgcgcagcggcggcaggcgcacaggcaccacgttcaggcgatagaacagatcctcgcggaacaggccctgctggatcagctggcgaaggtcacgatgggtcgccgcgatgatccgaacgtccgcccggataggcgtgcgcccgccgacggttgtgaattcgccttcctgaagcacgcgcaacagccgtgtctgggcatccagcggcatgtcgccgatctcgtccagaaacagcgtaccaccctgggcctgttcgaaccggccggtcttgcgctgggcagcaccggtgaaggcgcccttctcgtggccgaacatctcggattcgatcaggtcgcgcgggatggccgccatgttgatcgccacgaacggcccgccgcgacgcttgccgtaatcatgcagcgcccgcgccaccagctccttgccggtgccgctttcgccggtgatcatcaccgtcagatcggtgcccatgatccgggccatgacccggtagacttcctgcatcgacggcgaacggccgaccagcggcatctcttcttcggcctgcggctgaccgcgctgatccagcgccggcggcggtgcatcgccccgccgggtgttgagcgcccgctgcacgatgcggagaagttcgttcagatcgaagggcttggggagatattcaaaggccccgcgttcggtcgccttgaccgcggtcagcagcgtcttctgtgcggtcatcacgatgaccggcaggttggggcgcaggcgcttgatccggggcaacaggtcgagcgcgttctcatcgggcatcaccacatcggtgatcaccagatcgccgtcgccgtcctcgaccatccgccacagcgaggcggcggtgccggtggtgcgcaccgtatgcccggcccggctgagtgcctgatgcagaacggtacagatgctgcggtcgtcatcggcgaccaggatggttgcgggctccatcgcgtccgtcgttccttcaggccttggggttgtacatgggcagcatcaccttgaacacggtgcgccgggggcggctgtcgacctcgatcaccccgccatgatcgttgaccgccttggcgaccagcgacaggccgaggccggtacccgagggtttggtggtcacgaaaggatcgaacagattggcccggatatcctcgggcacgccctggccgttatcctgcaccgtcaccaccagcggcaggtccagccggtcacggctgcccggcacctggacacgcaaaccatgctggaaggcggtggtgagcgtgatttctccgccctcttccggaacggcttcggcggcgttcttcaccaggttcaggaagatctgcaccagcatgtcgtgatggccgtagaccggcggcagcgaggggtcgtactgctcgatgaaccggacatggctcgcgaaaccgttctgggccaggcggcggacatgttccagcaccacgtggatgtttaccggctcccgctcgatcggtcggccgtcggaaaactgctccatccggccgatcaggttcacgatccgatcggcctccttgcagatcagctgggtgagcatgcggtcgccctcggcgacattgtactccagcagctgtgcggcaccgcggatgcccgaaagcgggttcttgatctcgtgggccagcgccatggccatgccggtgatcgatcgggcggcgccccgatgggtcagttgccggtcgatcttatgggccatcgaccgctcgatcagcgacagcagcaccgcgggggcaccctgatcaggcagcggggccacctgcgcatcgaccagccgactgccggtccgcggcccgtcgatcacgatgtcgtattcgttcaggctggatccgccatgcaggaagcatttgcggatgatgtccatcagcgggctgtcatagcggatgaactcggtcagcgccgagccgatcagcaccgagatgccggtgccgaaaaactgctccgcagccggattgccatagaggatccggtcgtcattggccaccaccagaaccgggtgcggcaaggcgtcgagaatcgcatcgcccgggacggacgatttggagggccggcgtttccggccgaagctggtcagagccatggtctgggccagacctttccacatgcgctggcgggggctgccgacggggtcctggcccccgtccgcgggcgtggaggggccgtcgtccgcggtcccgtccacatcacggacgggatcctcgggatcgggggtgtcgtggttaagaagatcggggtgccggaggatgggatcactcatgcggccactccgaaatctgccggaagatcgcccagcgcaaggcgatcgagcacggcacgtacgtcgtccggctgctcggcacggacaagatggtcgcgtatcgcccggccggcgccggcaacggtcgcataggcgtcgagatgcttgcgcaccacccggcggccatgggcctcgccgtagtggtcgagtgccagatcataatgcgcccgggcaagcgaccagatggcagccgtgtccggcatggcgacgctacgccccgccagccccgccatcaccattgccggcagccacggacgccccagagtggcgcgtccgatcatcaccccgtccgcaccggttcgatccagaagccgccgcgcatcggcagggcttgcaacgtcaccattggcgatcaggggcacgcgaacccgccgccgcactgccgcgatgcccgcgggatcggccgaacctttgtagaactgggcgcgcgttcggccgtgcacggtgatcatcgcgactccgatctgttcaagccgtgcagccagatcgggcgccgagagttcaccttcggcccagcccagccgcatcttgaccgtgacgggcaccgggccggccgcacggatcacggcccgaacgatggcctcggcacggtcgggttcgcgcatcaatgcggcgccgcaggcgccactggtcaccttctttgccggacagcccatgttgatatcgatccaggccgcccccgcctcgacagccttctccgccgcctcggccatcacctcggggtcgcgccccgccagctggaccgcgaccggccccggctcacccgccaggtcgatcatcgacagggtgcgacggcacccctcgaccagggtgccgccggcgatcatctcggacaccgtcgccgacacgtcgaagcgccgcaccatcgtccgaaacggacggtcggtcacaccggccatgggtgccagcagcaccggaggtgcagctctgtcgggtgagaaaagccgatcgatcatcgggttcctggtcatgggctgggcaattgcccgagctgagtgcataaagtttaggcgaagtgtattgagccggcccgcgcggtgcaagcgtcggccgcgcttgcaaccatcggccgaccccggtatcgaaggacactgcggtgtttcgaagccccaccccgccctgcccgaccaggagatgcgccagatgaccccgacccggccgcagccatccgacgatgccgtcggcgacgctccgccgcgtggccgcgcggcggcactcatcgtcgcggccggacgcggccggcggttcggcggcggtgttcccaagcagtatcaggcccttgggggccgcgccctgctcgcccacgccgccgcagcctttcttgcccacccgcggatcgatctcgtccaggtcgtgatcgggccggatgaccgggacctgcacgaccgggcgttggcagggctggaggtggcgccgccggtcatcggcggcgcggagcgacaggattcggtgcgcctcggcctggaagcactggcggcgcgtggtgacatcgatttcgtgctggttcacgacgccgcccgccccttcctgccggccgggatgatcgacagggtcctgaatgccctgggtgacgcgccggcagccctgccggcactcgccgtcaccgacacgctgaagcggggcgaggcgatgacggtcgccgggaccgtgtcgcgcgacggcctctggcgggcgcaaacccctcaaggggcacggctcgacctgctgcttgcggctcatcgcgccgcggccggacacacgctgccccgcgcgctgaccgatgatgcggccgtgatggaggcggccggccatgccgtccggctggtcgacggcgacgaagccgccttcaagatcaccacgaccgcggatatggacagggcccggcagttgctggcgcggcgcggtcagacggccaccctgctcccggccaccggcagcggcttcgatgtccacgctttcgcccccggcgaccatgtctggctctgcggtgttcctgtgccgcatgatcaggggctgtccgggcattccgatgcggatgtcgccctgcatgcgttgaccgatgcggtgctgggtgccatcgccgccgatgatatcggccgtcattttccgccgacggatgcccgctggcgcggcgcttcgtccgaccggttcctgatccacgccctggccctgatgggcgcgatgggcggccggctggtgcattgtgacgtgaccatcatcggcgagcgaccgaaggtcggtcctcatcgcgaggcgatgcgccgccgccttgccgaattgaccggactgccgcccgcacggatcggggtcaaggccaccaccaccgagcagctgggcttcacgggccgccgcgagggactggcggccatggcgaccgccacggtgctgctccccgatctctccgctccggagccggtggtttgagcccccgccgccatcgcgagcatctgccggcccatcatccggcagagctgatcgcgaccgtgctcggcagcggcaacgccccgcgcgcacccggcaccgtcggcaccgtcgccgccctggccatcggcatcccggtcgcctgggcgggcggtgccccggcgctgctgatcggtgccctgcttgcggtcatcgccggctggtgggccatccgcctggtcaccgctcatgacggggtccacgaccccggacgcgtggtcatcgacgaactggccggcctctggattacgctggcagcactggcccctctcgggcggctcggcgactggcactggtggcttgcggccttcatcgctttccgtgccttcgacatcgccaaaccctttccggtaggatgggccgaccgccatgtccgcggcgcactgggcgtgatcctcgacgacctgatcgccggggtctacgccattctgttgctcgtcgctttggcctccggcctcgacatggccggcattgccctttgatcgcacgccggagcacctgcctatgctcactgacagcctgatcgagaccgcagagcttgttctgtcccgtgcgcgggaccgcggcctgaagatcgccacggtcgaaagctgcaccggcgggttggttgccggcacgctcaccgccgtcgccggctcttcggatgtggtcgatcgcggcttcgtgacctattccaacgaggccaagaccgagatggtcggcgttccggcagccttgatcgaggccgaaggcgcggtgagccggccggtcgccgaagcgatggcgaccggtggcattgcccggtcgcgtgccgatcttgccgtgtcgatcaccggcattgccgggcccggcggcgccacgcccaccaagcccgtgggactggtctatctcgcctgcgcgcggcgcggcggcacggtcacccatcgccggcatgtcttcccgggcgaccgtcaggccgtgcgggcgcagagcgtcgcggtggcgctcgacatgctgctcgacgccctggcggactgaccccggccggagccccgacgggtggtcagccgcgcccatcgagcagacggcggacggcgccgagtttgtcgggattgcgcatcgtcaggatggcgcccacccgcccctgcccgtcggggacgagcgcgctgacgctcatgctgccgtcgggaaaatcctgaatgaagccgggtgcgccgttaaccagggcgaggcgcacgccctgcgccgggtgcttgcgggtgatcgagatcaggaaccgcaccaccttgtcgatgccgcggatggggttgagcgccgccgccgccttgcccccgccatcgctctccagcacgatttcaggggcgaacaggcgccggagcatgacctcgtcgccgcttgccaccgcttgcagaaccgcttcggcaagcgcacgcgccgcctcgggatcggcgctgccactgccggggctgcggtcgagcagcggatctgccgccgccggcagctccgcccgggcggccgtcaggcggcgccgggcgcgcgacagccgctgacgcaatgccacgggggtgatgccgagcgcatcggccgcctcgtcggcctccatctccgccacctcgaccagaagcagggcagcgcgttccgatggcggcacccgctccatcagccggagcagcgccagcgacagggtctcggtcgtctcgatgaggcccgcctcgggcggcacgatgtcggacaccagcggctccggcagccaggggccgggatagccggtccgggcacgccggcggctgcgcaagcggtcgagtgcaagccgggtcgccaccgacagcagaaaggcccgcggttcacgcggccggccggcctcggtgccggtttccgcccgctgccagcgcagccaggcatcctgcatcacatcatcggcgtcggccgagctgccggtgagccggtaggcctgcgcccaggccgccggtgcatgggcgagaaaggcatcggttcgggctgcggagggtcccggcatggcgcttgtggtcaggctcatgcgcgcagctccacatgaatgtccgcccggtccggctcggcatccggccatctgtcgaaatcggcccgaaaggcgcggtcgggcagggtttgccagatcctggcccagcccgcggccagcgccgccggctgcgggccggcggtctgcagcaccagaaaatcggccgcggccagatcgatccggatcagcccgtccggcaccgccagaccgggcaccagaacccggccgatggtcagccggaacggggcgctgtggtcgccctgataccgatcatagacggcaaaggtcgcagcctcggcgcagggccgcccctccagcggccgctccgcaaaccagcgcccccacagggcgccgatcgcatccggatcgtcattcgagacgatggcagcaaggccggtcacggcaaaaccgccggagcggcagcggctgaaacccggaggcggcgtggcgatgtcggtcatcggatcgtccttcgacagggagacgctgccagaaagacgtccaccccggacatcctgtgacatccctgatcgcgatgtcacatcgaaaaatcgagaagccgcggaggacgggccgggatcagggctcggccggccgtggcgcctggccgcgatgcagaggctcgcggccgtaaagatcagcggcccgggcctcgaaagccttgaccatgcgccgggtggcctcgccgaacagcgcgcccatcacattgtcgagcaggcgcgagcggaatttgaaatcgacttcgaaatcgaccaggcaaccttcgggatgcggctcgaaacaccagcgattgcgcagatgttcgaacggcccggtcacgtcggtcaccagcacctcatgcgggcgcaggagttcgaccttcgaggtgaaacgctcgcggatcatcttgaagccgatcaccagatcggcctccatgcgctcgcgcttgtgcccctcggcatcggtgaagctctcacgcgtgcggatgcgtgaggcgatgcaccaggggaggaattccggatagcggtcgacggcggcaacgaggtcgaaaagctggtcgggcgcgtagggcagtacgcgcttttcgctgaaggacggcatcgtcgaacgctaactcccgttggcgagaatcgtcgggcagacggcagccgggcagctcccccgcgcgatgcgggggctgctgccacggcgccgcggcggaccgtctctctatacggtctgagcggcacccgctgcaagctgcgcctcgcgtgcggccttcagctgcgcgaagtccttgtcggcgtgatgcgacgaacgggtcagcgggctggacgacaccagcaggaaacccttggcccgccccatggtcgcataggactggaactcctcgggcgtgacgaagcggtcgaccggcagatgtttgggcgtcggctgcagatactggccgatggtcatgaagtcgacatccgcggcgcgcagatcgttcatcacctgatgaacctcgcccttggtctcacccaggccgaccatgatgcccgacttggtgaagatcgaggggtcgacatccttcaccatcgacaggatcttgagcgagtggaaataacgcgcacctggccggacatcggcatagagccgcggcacggtttccaggttgtggttgaagacatccggccgcgcctcggccaccgcctgaagcgcgcccttcttgcgctggaaatcgggggtcagaacttcgatggtggtctcgggcgacatctcgcggatacggcggatcacctggacgaactggccggcgccgccatcgtcgagatcgtcgcgatcgaccgaggtcaccaccacatgcgccagccccatctcggccaccgcttccgccagatgtgcgggctcgtccgggtccaccgcgcgaggcatgccggttgcgacattgcagaaccgacaggcacgggtgcagatgtcgcccaggatcatcacggtggcgtgcttctgggtccagcactcgccgatattcgggcaggcagcctcttcgcagacggtgaagaggttgaggcgccgcatgcgctggcgcatctccgccacctgtggcgaggtcggcgccttgacgcgaatccagtcgggcttacgctgacgctgggctggcgtggtgctggctggcgccgtctcgacgggatggatgatcacggccacgtgcgatgtcccccggcctggatgggttgaggcccggccccgaccggcgatcgggagccgggcctttggtcgagcataccacagtcgaccgcgccacaggcgtgcctgtcgcagggcgctgagggtatttcgggttagaaatggatggcccgtccgaaggcgtcaagcacggactcgtgcatcatctcggacagggtgggatgcgggaagatggtgtgcatcaggtcgagctcggtgccttccatggtcttggcgaccgtgtagccctggatcagctcggtcacctcggcaccgatcatatgggcgcccagcagctcgcccgtcttcgcgtcgaacaccgtcttgaccagcccttcgggttcacccagggcgagggccttgccattgccccgataggggaagcggccgaccttgacgtcgtaaccggcctctttcgccttggcttcggtcatgccgaccgatgccacctgcggcgtggcataggtgcagccgggaatgttctcgcgggtcatcgggtggacatgctcgacgccggcgaaggcctcgacacagatcacgccttcatgcgaggccttgtgagccagccagggtgcgccggccacgtcgccgatcgcatagatgcccggctcgtcggtttcgagatacggaccgacctggatctggcccttctcgaccttcaccttcgtcgtctccagccccagatcctcggtgttgccgacgatgccgatcgccacgataacgcggtcgaccttcaggctctgcgtcttgcccttgccgtcttcgagcgttgcggtcaccccgtccctgcccttgtcgagcgccttgacctgggtgccggtgaggatcttcatcccctgcttttcgaaggccttgcgagcgagacccgaaatctcggcatcctccaccggcaggatgcggtcgagcagttcgaccacggtcacctcgacgccgagcgcgcgatagaagctcgcgaattcgatgccaatcgcgccggagccgaccaccagcagcgacttgggcagactctcgggcaccatggcttcgcggtaggtccagacccgctcgccatcgggctccagccccttgaccacgcgggcacgggcgccggtcgccagaatgatgtgatcggcggtgacgctgcgcttgcccttcgcgccctcgatcacgaccttgccagggccgttcagacggccgcggccgtcggcaacctcgaccttgttcttcttcagcagatgagccacgccctgcgacagggtcttggccacgtcacggctgcgcttgacgatcgcggacagatcgaagctcggcttctcgaccgtgatgccgaattccctggcatggttgaccagggtccacacctcggccgcccgcagcagcgccttggtcgggatgcagccccagttcaggcaaatgccacccaggtgcttttcctcgaccaccagcgtgcgcaggcccagctggccggcgcggatcgccgcgacatagccgccggggccgccgccgatcacgatcacgtcatagtcgtcgccgctcttcggccccgaggccgtcttcggcgccggcttcttcgcttcggccttgggcgcctcggccttcttcggagcctcgggcttcttcggggattcgggcttcttcgcggcctcggcagccttggtagcttccttcggcgcctcggcaccgccggcagcggcctttgccgcctcggccggatcctcgccttcatcggcgaggaccgcaatcagggcattgaccgcgacgttctcggtgccttccggtaccacgatcttcgccagcacgccctcgtccgccgcctcgacctccatggtggccttgtcggtctcaatctcggcgatcacctgaccactttcgatcgtgtcgccttccttgaccagccagcgggccagggtgccttcggtcatggtcggcgacagcgccggcatcagaaccttgatcggcatgggatgggtctcccgtccgtctcgtgtgtgtctcgaaggatgaaccgcgggatgccgctcagagcagcatcgacagcgggtcctcgatcagcttcttgaaggcggccaggaactgggcgccgacggcgccgtccaccacccggtggtcgcaggagagtgtaaccgtcatcaccgtcgcgatcgccagcgcaccatccttcaccaccggccgctgctcggcggcaccggcggccaggatcgccgactgcggcgggttgatgatcgccgagaactccctgatcccgtacatgccgaggttagagaccgagaaggtcccgccctgatactcctcgggcttcagcttgccgtcgcgggcacgggtggcgaggtcgcgcatctcggacgagatcgcggccagacccttggtatcggccttgcggatgatcggggtgatcagcccgccgtcgatcgcaacggccaccgagacgtcgacatccttgaagcgcagcaccgcctcgtcggtccaggccgcattggccgccggcaccttgcgcagcgacagggcgctggcccgcaccacgaaatcattgacgctgatcttcacgccgtcgccggcacgctcgttcagctccttgcgcaccgccagcagccggtcgatgacgcagtccaccgtcaggtagaaatgcggcacggtctgcttggcgtcgagcaggcggcgggcgatggtcttgcgcatgccgttattggcctcggcctcatacggcatgcccagcttgtcgaccagatcgcgggtctgggcagaagccgcggccgagatcgccgccacgctgtagccgccaccggtctgctgggccggcgccggggtcgccttgggcgcctcggcggccggagcagcgtcgctgcggcccggggctttcggcgcctcggccggctttgcacccgatgcgatcgccgcctcgacatcggccttcacgatccggccatgcggaccggtgccctcaacaccggagaggtcaagtcccgcctccgacgcgatgcggcgggcgagcgggctcgccttgatccggccgccctcgccatcggccgccggcttcgccgacgccttgggagcgggtgctgctgctacttccgcctcacccgcatcgtcaccttcggcctcggcctcttccgccttggcggcgggcgcaggcgcgccggcaccggcggcagcttccgccactgctgcatcgtcgtcgccctcttccttgagcacggcgatcggcgtgttcacggccacattctcggtgccttccggcaccaggatctccgccagcacgccttcgtcgaccgcttccacctccatggtggccttgtcggtctcgatttcggcgatcacctgtccgctttcgatcttgtcgccggccgacaccagccacttggcgagcgtgccttcggtcatggtcggcgacagggccggcatcaggatggtctgagccatgttcggtcctcggattctcgatggggtccggcgatgccggctcagaattcgtagccgacggcgcgcttggcggcctcgacgatgtcgtcgggctgcggcagggccagcttctcgagattggcggcatagggcagcggcacatccttgccgcagacccggatcaccggcgcatccagatgatcgaaggcgtgctccatcatcagcgcagcctgctcggcgcccatgccggccgtcggccagccttcctcgaccgtcaccaggcgattggtcttcttcaccgaagcgacgatggtgtcgacgtcgagcgggcggatcgtacgcaggtcgatgacctcggcctcgatcccctcttccgccagcttatccgcggcttccagcgccttgccgacattgatcgaccaggcggtgatggtcacgtcccgcccctcgcgcacgatcgcggccttgccgatctcgaccacatggtcgtcgtcgtccggcacttcgaagctctgaccgtagaggatctcgttctcaaggaagatgaccgggttcggattgcggatggcggccttcagcaggcccttggcatccgccgccgaccagggggcgatgacgatcagcccgggaacatgggcataccagctggcatagtcctggctgtgctgggccgccacgcgcgccgccgcaccgttggggccgcggaacacgatcgggcagcgcatctgaccgccggacatgtaattggtcttggcggcagagttgatgatctgatcgatcgcctgcatggcgaagttgaaggtcatgaattcgacgatcggcttcaggccgcgcatggcggcgccgacggcaaggccggtaaagccgtgttcggtgatcggggtgtcgaccacccgcttcgccccgaattcgtcgagcagaccctgggtgaccttgtaggcgccctgatattcggcgacctcttcgcccatcacgaagacgtcgccgtcccggcgcatctcttcggccatggcgtcgcgcagcgcctcgcgtaccgtgatcttcggcatgtatggacccgtttctctctgaaatccgtcaccagagcggcgccgacgcaccctgccccggtctcctgtgaaaaccttgaaccggcagagcctcgatcagctctcgaccagcacgtccgtccacagctccgacggatcgggctcggggttctcctgggcgaaatcggcggcatccaccacgatgtccttgatctcgcggtcgatgcccttgagcttcgcctcgtcccattcaccgctatcgatcagcagctttttgaccagttcgatcgggtcgcgctcggccttcatgcggttcagttcgtccttggaccggtacttggccgggtcggacatcgaatggccgcggaatcggtaggtcttcatctccagcaggatcggacccttgccgctgcgggcatgctcgacggcgaattcggcagcaccacgcacggtccgcacatccatgccgtcaactgcgaaacccgggatgccgaagctctcaccgcggcggtaaagttcagtgaccgcgctggcccgcgccaccgaggtgcccatgccgtagagattgttctcgatgacatagaccaccggcaggtgccagaggctcgccatgttgaagctctcgtacacctggccctgattgaccgcgccgtcgcccagataggtgacggcgaccttgccgtcttccttgtacttgtgcgcgaagccgaggccggtgccgatcggcacctgggccgccacgatgccatggccgccgaagaagcccttctcgaccgaaaacatatgcatcgagccgcccttgccacgcgaatatccgtcgcggcggccggtgagttcagccatcacgccgcgggcttccatgccgcaggcgagcatatggccgtggtcgcggtagctggtgacgacgctgtcgccgtcgaccaggctgccctgcatgccgatcacgacggcttcctggccgatatagaggtggcagaagccgccgatcaggcccatgccgtacatctggccggccttttcctcgaagcgccggatcaggagcatctctcggtagtagtggaccagctgttcgatggtgctgttctcgggcgcgagcgcgttgctctgcgagcccgagggcttacggcgcgaagtcgccatgcggtcctccccggatgtgacgcgcgggagccgcacgagccggctccggagcgcctaggtggagttgaacctaagccccgcatccgccgctggcaagcgaaacagggggcgcaaatccttgtgctgcggcgcaatagagatgattaacttatcctcagttaattgacacattcgcgtctggaatggccatctgcgcggcttcggcatctcgcagcgcagcaaccagagcgcccgacaagcgttcatcaagaccgaccgacagctgcaagcccagacgacgggtgagccccagatcttcaatcgcaacgaaaccaagaccttccggtaccagcgtccgcggagcgatcgtcacgcccaacccggcccgcactgcagcaaaggctcgtgcgtcctgatccgtggcaaaggacgggcgaagccggataccacgcgaatcgagcagcccctgcgcatccctgccccgctcgcaatgcatacgcaaaacgaaggcctccccgtccagatcggccacccgcaccgagccgcgccgggcgaaatcatggccgggcgggcacaccaccgccagcggatcgtcccgcaccggcacccaccagccatcggccgcacgatccgagatggtcaaggctgcatccatccgtcccagccccaccgcctcggcaagccgtggttcccgcgcttcacggatggtcaattccaccgccggcagatgccggtgcaaggcctccgccagccccagaaccagccccatcggcacggtcggcagcacgcccagagtcaacacgctctgctccagaccacgccgcacttcctgacgcgcaagatcggcatcacgcacgataccgagtgcacgccgatggaaccggcgccccagagccgtcagccgcacggcgccgcgctgccgctccagcagtgacgtaccgagttcatcttccagcgccgccaatccggccgagagcgccggttgagaaacgttcagagagcgtgcgccgccggtgatgctgcctgccgccaccaccgcgatcagatagcgcaattgcctgagggtcacggcggttcctccatccaattttcagatcgataagatccagataatccattttccttaagtttaggctgctttctatgatggcgccagagaacgccctggtaacaggcgccatcaccgctcaggaggccccggcaatgcgcgaagatctggtgctgtacatggttgaggagggcatcgcccggatcaccatgaaccggcccgaagcgctgaacgcgctcgacgatcggctcaatgatgccctggccgtcgcctgggaccgcttcgcggcggatgatgcggcggatgtcgccgtgctttcgggtgaaggtcgggccttctgttccggtgccgatctgaagagcttcattccgcgctggcagggtgccgacatgatggcgccgcgccgcaatgcgccaaccggcatcggcggcgggctcacccgcggccgccatcgcctggtcaaaccggtggtggcggccctgcacggccatgtcatcggtggcgggttcgaacttgctcttgcctgcgacatccgcattgccgcagaggatgccagcttcggcatcttcgagctgcgctatggcctgcaccagggcgatggcgggctcgtgcgcctttcggccatcgccggcatcggcacggcgctcgatctcaccctgaccggccgaccggtcgacgcggccgaagccttgcgtctgcacctggtctcccgggtggtgccgcgcgctgacctcatgaccgtcgcgctggagacggccgcacgcatccgggccaatggccgcaccgccgtccgctcggccaaggagaccgtgctggaactgatcggccgccccctcgacgacgccctcagattggaaaccctctacggctattcgagcctgggtgattttggcgaggcggggcccaggctcgcccgctttctcgacaagaccccttcccggcaggatggagaccggtaatggcaggcagactcgtcagtcaggccgacgtgatactcggccagaagatcaagagattacgccggctgcgcggcttcagtcagagcgacgtcgccaacgtcctggagatcacctttcagcaggtccagaaatacgaacgcggcgtcaatcgtgtgccagccgcagcaattccggcgcttgcgcggttgctgaacaccaccgcaagccatcttctcgacatcgagtcaccccgacaggccgccgccacggatgatcgcgaagtgatggccctgcaggcagcgctctccacgctgcccgagaactcgccagcccgcgtgcaatatctgaaggcagtcgccgccctggccgccgccattcgcgcagcaagcgatgatcagctggcggcgaacatcaccgacaacaccggccgggtctccgcgtcgggcgtcggcaccacctcatcggtgatcccccagtccgcaaggtcataaaccgccccatggaccgtgccccgaccggtggcaaaggtcatcttgcggctcagcacgtcgttccgccactgggcggcggcgtggttggcgatgacctgcgcaaaggctgcccggcaggcggcattatcgagcccggccgtatcgaccgccagcagatcggccgaaactgcactgctcacaccggtctgtaccgcgacatcgaaccagaaggcgatgtcgagcagagagacctgccgccccgacatatagcggctgagatagccgaccgcccggccgaaccaggttgcgaaggcatggtccatctgaaccgatttggccgccccctgattgccaagggcggagaaatggcccgcccatggatcaatcaatcgggtgttgttggcccccgtcgaaattgtcttcgcccagtcgaccgcagcctggccgcggagcggcagggcctgcatcatctgatcgtattcatccccgaagatgccggcaatcagcccgggggctctgatctcgatatccgagaacagctgctccagcgcccctgaggacagggtgaagccgagaatgccccaggtaagtccgcccgaatcgaaggcccccaccgcaccggtgaaataggtgccctcgaaggcgacggttggattcagcacccggtcgaaggcggtgagcggccccagcgtcgagagggactgccactcatcctcgagaaaggtggcggagacgggaaaaccgcttcccgtctgccagtcattcatggcccgggcgctcgccgggccgaaccggccatcgacgaccagacgcgcccctttccggttcaacagggtctgaaccgcatccgccagcgggcccgaaatcatggcccggccctgggtggcggtggagaagtaaatcgtcacggcagccgctccacgcctgtgaacccctgatggaaagcctaccgcaaaacgcagaggcgtccaatcaccgggtcgtcacatgatggcatgcagccaagggttatcgcggtgcctcgggcagaacgtccagaacactgggcgtacccgaacccgcggcgcccgaagccggcggttcactcgacgcatcgggcgtgacgggtgctgcagcgtcgtaaaattcaacgcgatcacgcgcatcggtgtaaccgagtacccggcggacctgctcgtccagcatatcgggatccaggctctctgcgcgcatgagagccacctgcttctccagccgctgccgttctgtccgggcgtcgtcgagctgatggttcagcgccgccagctgctggcgcatctgcagccaggccacgaccccgcggtcgccctgaaccgcgtggaacgcaaaatagctgaccaggcacccccagaaaatctggggcgcgatctggcgcaagcggcgcgttatatccctttgcatcgacatggggtgcatggaatcacgcagttgtcacggcgtcaatcagccttcgtggcgcaggcctccccgtccgatatttgtcatggcgcctgtggcgcggtcgccgcgccggctcattccacgggctgtcacaaatatggctaaattttaaccatgtcatgtcatctgacggttttttgagcgaacccaacaccgttcggacacctgcgcgcctgtcgccttctacgtaatcttccccggagagaaccgcggagacctgcggacggcagaccgccgccttcctacccaagcatgtttggtccgcttcttgctgctctggctcatggatcggaacaacgcgccctaccggaggccgtcaatgaaactcatcgtccgcaccatcgccagcggcgccattctcgccgcagccgccgtcagcgccgccactgccgcagaacccatcaaggtgggcgttctgcattcgctgtccggcaccatggcgatcagcgagaccacccttaaggacaccgtgctgatgctggtggacgaggtgaacaagagcggcggcctgctcggccgtccgcttgaagcggtcgtcgtcgatccggcgtcgaactggccgctgttcgccgaaaaggcccgcgaactgatcgagaaggacaaggtcgacgttgtcttcggctgctggacatcggtctcgcgcaagtccgtgctaccggtattcgaagagctggacgggcttctgttctatcctgtgcagtacgagggtgaggaaagctcgcgcaacgttttctacaccggtgccgcccccaaccagcaggccattccggccgtcgaatacctgatgagcgaggatggcggggcggccaagcgctgggttctgcttggcaccgactatgtctacccgcgcacgaccaacaagatcctgcgcgctttcctgcactccaagggtgtctcggatgacgacatcatggagagctatacgcccttcggccacagcgactggcagaccatcgtctcggacgtgaagaagttcgccagcgccggcaagaagaccgccgtggtctccaccatcaacggcgatgccaacgtgccgttctacaaggaactggccaaccagggcatcgacgccgccgacattccggtcgtcgccttctcggtgggcgaggaagaactggccggcctcgacaccggtccgctggtcggccatctggccgcctggaactacttcatgtcggtcgatacgcccgagaacgccgacttcatcaagaagtggcacgccttcatcaaggacgacaagcgcgtcgtcaacgacccgatggaagcgacctatatcggcttcaagatgtggagccaggcggtgctgcaggccggcaccaccgacgtcgatgccgtgcgccaggccatgtacggccagaaggtcccgtcgctgaccggcaccaccgcggtcatgaacgtcaaccaccacctgtcgaagccggtgctgatcggcgagatccagggtgatggccagttctcgaccgtgtggaagaccgatggtccgatcgtcggcgatgcctggtccgactacatcccggaaagtgccaagctgaccgccgactggacctatccctgggtctgcggcaactgcgagacgccgaagtacaagtgatgcgctgacatcacggcggctgcgccgggccggcccaaccccggcatggcctggcgcagcagcatcttcacggaaagtcttcaccgatcggacggtggcccgtgccgcccgatcgcggaggacggggcttcggctgtctgcctgtggccgcggtacgctctcccgccgcccgagacatcacgaccgccgaagccccaccctgcccttgccgccccggatcggccggtcagcttcaccggcggctccgcacgcggttgcagaagacgagcccgatgcccggacaagcgatttctccccgccggcctgccggcggccccgccacgctgctgcgcgccctcgcgctggcggcggtgctgctgatcctgccgttcgccaccggcccatccaccttttctcccgcaggcgtggccgtcgcccagacgaccgatgccgcaccgaccgcggaagaggatgcacagctgcgcgccgcactcgccaccgaaggcagtggcttcgacggcgcgctggcactgattcgcgccctggccgccacgggcgatgcccgtgccgcccgggcgatcgatgccctccagtccggcaatctcggccgcctgaacgatggcggtctggtgatcctggaaggtcgcggcaacgatgccggcatgcgcgatccggtgaccggcgaggatctcggcaaggccgaacgcggcctggtcgagcgcatccgcgtcaacaatcgggtgcgggtcgaggcccgcgccgcgatgggcctgatcgatctcagggcaaaacggccggaacggcgcattgctgcggccgacggcctgatcaagtctccggatgcggcggcactgccgctgctcacccaggcgatcgagaccgagaccgacggccgcgcccgcgatgccctgaccaaggcgctggccgccgtgcaggccttctacgccgagaacccggaggaacgccttcaggcgatcgagaccctgggcgactatgccgacccgcaggtccgcagcctgctcggccggatcgccgacggtacaccggaagggctctccccggatgccgcccaggcggtgaagggtgcggcgatcgatgcgctggctgccgtggaagccaagctcgaaatgtgggcgctcgtcggcaatgtctatcaggggctgagcctcggatcggttctcgtccttgccgccgtcggtcttgccatcaccttcggcgtgatgggcgtgatcaacatggcccatggcgagatggtgatgctcggggcctatacgacctatctggtccagcagggcatcgcggccgcggcgccggccctgatgccggtatcgctgttgatcgccctgcccgcagccttcctggtctcgggggccgctggtttcgcgatcgagcgcagcgtgatccgctggctctatggccggccgctcgaaaccctgctcgcgacctgggggctcagcctgatcattcagcaggcggtgcgctccatcttcgggccgaccaatcgcgaagtctccagccccgactggatgagcggcgctttcgagatcgccggcggcatcacgctgacctataaccggctctggattctggccttctccctggtcgtggtcggcggcgtggcactgcttctgcgcaaaacgcccctcggcctgcatgtccgtgcggtcacgcaaaaccggtccatggcctcgtccatgggcatccggaccggccggatcgacgccctcaccttcgccctcggctcagggatcgccggcattgccggtgtggcgctcagccagatcgacaatgtcagcccgaatctcggccagggctacatcatcgacagcttcatggtggtggtgttcggcggtgtcggcacgctctggggcacgctgatcggcgggttcgccctgggtgtggtgaacaagctgctggaacccttcgccggtgccgtgctcgccaagatcctggtgctgatcgcgatcatcctgttcatccagaagcggccgcgcggtctgttcgcgctcaagggccgcgcggtggaggcctgatcccatggcatcgaccaccgaacccgccgccgctccccgccaggccccgcgcggcctggcacgcggcccgcgccggccgatcctcctggccctgctcggcgatcgtggcgggctgatcttcatggggctgatcgcggcctccgccgtgctgatgccgatctccgccctggtgctgccggcagagcatccgctggcgatcccgtcttacatggtgtcgctgttcggcaagtatctctgctatgcgctgcttgccctcgccctcgatctggtctggggctattgcggcatcctcagcctgggtcacggcgccttcttcgccctgggcggctatgccatgggcatgcatctgatgcgcgagatcggcccgcgcggcgtctatggcaacccggttctgcccgacttcatggtcttcctgaactggcaggaactgccctggtactggcatggcttcgacatggcctggttcgccattctgatggcgctggtcgtgcccggcctgctcgccttcgtgctcggctggctgtgcttccggtcgcgggtgaccggcgtctatctgtcgatcatcacccaggccatgacctacgccctgctgctcgccttcttccgcaatgacatgggtttcggcggcaataacggtctcacggacttcaaggacctgttcggctacagcctgcaggcacccgagatgcgggtggcgctttattccgccaccgccatcgccctggtcggtgcctatgcgctctcgcgcatcgtggtgacctcgaagctcggcaaggtgctggtctcgatccgcgacgccgaaagccgggtgcgcttcctgggctatcgggtggagcactacaagctcttcgtcttcgtgctctcggccatgctggccggcattgccggtgcgctctatgtgccgcaggtcggcatcatcaatccgggcgagttcgcccccgccaactcgatcgaagccgtgatctgggtggcggtcggcggccgcggcacgctctggggtgccgccctgggtggtatcgcggtcaactgggcaaagacctggttcaccggcgccctgcctgaattctggctcttcgccctgggggcgctgttcgttgccgtgacgctgttcctgcccaaggggctggtcggccggctgccggccttccccaccttcggccgccgccgcgaggccgtcccccccgccgccacggaggaccgcggatgaccgtgcataccgccgacctgctggcagatgccggcaccgcacccgacggtggccgcagcccccggggcagtgccctttatctcgacggcgtgaccgtcagcttcgacggcttccgggccctgaatgagctgtcgctggtggtcgatcacggcgagcttcgcgccgtgatcggccccaacggcgccggcaagaccacgatgatggatgtgatgaccggcaagacccggccagacaagggcaaggtcctgctcgacggttcgatcgatctcacgaagctcgacgaggcgcgcatcgccacccttggcatcggccgcaaattccagaagcccagcgtcttcgagacccataccgtggtcgacaatctggaactggcgcttgccggtgatcgcggcccgtttgcggccctcaaattccggcgcaccgccgacaaggccgcgcggatcgaggcggttctagaggacatcgccctcgcccaccgcgcccatgaacccgcgggccgtctcagccacggccagaaacagtggctggaaatcggcatgctgctgatgcaacagccgcgggtgctgctggtcgatgaaccggcagccggcatgaccgatgccgaaacctcacagaccgccgtgctgctgaagcgcctggcgcagtctcatgcggtgatcgtggtcgaacacgatatgggcttcgtgcgcgatctggactgcaaggtgaccgtgctgcacgaaggctcggtgctcgccgaaggctctctcgaccatgtccaggccgaccagcgggtcgtggacgtctatctcggccgctgacggaggcttgcacccatgctcgacgttcatgcgctggacgtgcattacggttcggcccaggcgctcaagggcgtctcgatcgaggcccgcgccggcgaggtcacctgcgtgctcggccgcaacggtgtcggcaagaccacgctgatgcgcgcaatcacaggccatctgaagccctcgggcggcagcatcaagctggatggcgccgatcttgccggccgcgcgccctatgaccgggcccggtccggcatcggcttcgtgccccagggccgcgaggtctttccgctgctgacggtggaagagaacctgcgcaccggcctcgccgcccggccacgcaagctggagcggaagatcccggacgacatcttcgcgctcttccccgtgctcaaatccatgctcggccgccggggtggcgacctgtccggcggccagcagcagcagctcgccatcggccgcgcgctcgtcaccgcccccaagctgctggtcctggacgagccgaccgagggtatccagccctcgatcatcaaggatatcggccgggtgatccggctgcttgcccgggaacgggggcttgcggtggtcctcgttgagcagtatttcgattttgcccaggagcttgcggatcgcttcatcgtgctggatcgcggtgaggtgatcgccgccggagacggggcagccctcgacgacgacatccgtcgccacctcaccgtctgataccggtagcccccgaaggtgcagattcccaaagacgatgcggctcgtgcccggcgtgccgccctggattgcggccgtctgaccctggtgatgggccccgctcccactgccaggcgtggcctgcgcgaccttgtccagcaggtgccctatcgggcgctcttcccccatgcggaacccggcgagccgccgatggtggtggtcaccagcacctcgggcggtatcgtgggcggcgaccggctggggctggacgtgacggtcgaggacggggcccggctgctgctgatgccgcaggcggcagagcgcgtctatcggacgaccggaccggtttccacgatcgacaatctgttccgggtcggtcggcatgcctgcttcgaatggctgccgcaggagacgatcatctacgaccgtgcccggttcgagcgtcgcacccgactaatgctcgccgatcagacctctcgcgccctgttcggcgagatactcgtgctcgggcggactgcccacggtgagagcgtcctcagagcacgattgcgcgatgcctgggcagtcgagcgtgcaggcaggcttgtgctggccgatgccttcgacctggcagaggaggatttcgccgccgccatcgccagcccctccgcgctgggcggcatgaccgcaatcgcaggattctgcggaatcggcagtccgggagagaccgcgggccaggcgctccgcgaccggttgcggcgggaactggaagcggctgaaggcccggagccggctttcggcacgaaacatgcatcaaatgcaacagggtccgctgcggatccggatgccctcacccgtcccatcgtcgggatcggtctcgtcgacgggtgtctggtggtgcggatggcggggggcgatgccgcccgtctgaagcgggttttcgaccggctgtgggcggtggcgcgggcggaacttcttcatcatccaccgcgtttgccgcgcatccgtcgcggctgaactgaaatccgcccgtcagaggcgacaggttaaacgatacagggaacggccagggagcgtccgccgcatgcatctgagccctcgggagacggaaaaactgctgatcgccatggcggccgaagtggcgcgaaagcgccgtgcccgtggcgtgaagctcaactatccggaagcgattgccctgatcaccgatgtcgtggtcgaaggcgcccgcgacggccgcagcgtcgccgatctgatggcggcaggcggtcgggtgctcacccgcgacgaggtgatgccgggcatccccgagatgatcgaacagatccaggtcgaagcgaccttccccgacgggaccaaactggtcaccgtccacaacccgatccgctgagggggccaggatgaccgacaccaccccgccccgcgctgctgcggataccccgttctctcccgacgccgaaggcctggcgccgggcgcgatcatccccgccgccggagtgatcaccctgaatgccggccgcccgaccatagagatcgaggtcgcgaacaccggcgaccggccggtgcaggtcggctcacactatcatttctatgagaccaataccgggctcaccttcgatcgcccggccgcttacggaatgcgtctcgatattcccgccggctcggccgtccgcttcgaacccggccagacccgcagcgtgcgcctggtcgcctatcagggcgaccgggtggtgcatggcttcgacggtaaggtgtcgggcgcgctcggcgccgcggcacccaagggcggggagggttgaacccatggcctacgagatcgatcgcgtttcctatgccgccacctacggaccgaccgttggcgatcgggtgcgtctggccgacaccgaactggtgatcgaggtcgaggaagaccgcaccatctatggcgaggaggtcaagttcggcggcggcaaggtgatccgggacggcatgggccagtcacagcgcacccgcgccgatggtgctgccgacaccgtcatcaccaacgccctgattctggaccataccggcatcatcaaggcggatgtcgccctgcgcagcggccgcatcgccgcgatcggcaaggccggcaatcccgacatccagcccggcgtcgacatcgtcatcggccccggcaccgagatcatcgccggcgagggacggatcctgaccgccggcggtattgacgcccatatccatttcatcgccccccagcaggcgatcgacgccatcgcaagcggcgtaaccaccatgatcggtggcggcacaggacctgcggaaggcaccttcgcgaccaccgtcacccccggcccctggcacatgatgcgcatgatccaggcggctgccgacctgccgatcaatgtcggctttctgggcaagggcaatgccagccggcctgaaagcctgatggagcagatcgaaggcggcgcttgcggcctgaagctgcacgaggactggggcaccacgcccaaggccatcgacacctgcctgaccgttgccgacctgatggacgtgcaggtggccatccacaccgacacgctcaacgagagcggcttcgtggaacggaccattgccgccttcgccggccgcaccatccatgcctatcacaccgaaggcgccggcggcggccacgcgcccgacatcatgaaggtggccgggctcgccaatgtgctgccctcttccaccaatcccacccgcccctacaccgtgaacaccatcgacgagcatctcgacatgctgatggtgtgccaccacctcgacccgtcgatcccggaagacgtcgctttcgccgaaagccgcatccgacgcgagaccatcgcggcggaagacatcctccatgatctgggggccatctcgatgatctcgtccgacagccaggccatgggtcgggtgggcgaagtgatcatccggacctggcagacggccgacaagatgcgccgccagcgcggccgcctggcgggcgagaccggcgacaacgacaatctccgtgcccgtcgctatgtcgccaaatacacgatcaacccggcccgcgcgcacggcatcgatgccgaagtgggctcggtcgaggtcggcaagctggcggatctggtgctctggaagccgatgttcttcggcgtgaagccggacatcgtgctcaaatccggcagcatcgcctatgcggcgatgggggatccgaatgcctccatcccgacgccgcagccggtgatctaccggccgatgttcggggcgatgggcgccgcgcggacggcgtcctgcctcaccttcgtctctggggccgctcttgcctccggccgtcttgaggcaatggcgggcggccggcggcttgcggccgtgcgtgggaccaggacggtcaccaaggcgcagatggcgctcaacgacgcctgcccggtgatcgagatcgaccccgaaacctatgaagtccgcgccgatggcgaggtgctgacctgcgagccggccgaggtcctgccgctcgcccagcgctacttcctcttctgacacagattttccagggagacacaccgaaagatcaccgatcaaaccccccgtcccgatgcacgatccgcatgcgacagccgcatcgcgtcgccacgcaggagaccggttcccatgaagatgacccagctttccgccacggccgccgccgtcgagaagatcacgcccctggttcccgaagcccctcagtcggtcatgcccagggccgtgcaggtggtgactgctgctttgccggttctgggcccggatgccgcctggggcacgatcaccctgccgcatgccgaccgccatcgccggcggatccggcttgccaccgatgacggccgcgccttcctgctggacctgcgcgaggcggtcaggctggccgatggtgaccggctgatgctggaccagggcggccatgtcgtggtccgggcggcacccgaagcggtgattgaagccgaaactgcggatcggcgggatctcgtccgcatcgcctggcatctgggcaaccggcatgtgccgctggccgttaccacccatatcgtcacgccgcggctgcgcatttcccgcgacctggttgcccgcgacctgctcggccggctgggggcgcatctgacggagaccgtcgcccccttcgatccggaaccgatcctgggggccgccggcatcgcggcgggggatgagcacggtcatagccatgggcatcacgatcacgggcatcatgaccacggccatgccatgaaggcgagcgccgccgtcgatctggtcggcggcaccggtgccgacaccgcccgtgcggcctggcagatcggcaaccgccatcggccggtgcaggtggtggacggctggcggatccgggcctcggatgaaccgcttgtccgccggatcgccgccgcgctggggctgcgtgttctgccggcggcagatgccttcgagcctgaacccggtgcctatgccgatcacggccatcaccactgatcccgccatgaccgccgaaggacaggccctgctctacggatggccggacggacccgcagcttgtgcagtcacgaccgacgtgcagggcctccaccagctgctcgcctggaccagccccagcttccccatcggtgccttcagctacagtcacgggctggagcaggcggtcgaagacggcacggtcggcacggcagaaacgctcgctgcctggatcgacggcgtcctgcgcttcggggccgggcggacggatgccggtttcgctgtgcgcgccgcccgccaggcccgtgccggcgacatggccgggcttgtggaaaccgccatcgtctcgtccgccctggtccccgccggcgaacgcgccttggaggcacgccagcagggacggtcgttcctccatgcggttgcccgtggctgggcgctcgacaaagccgcggacctggcggcgcagctcgacgctgtggaggttcccgtcaccctgccggttgcggcaggggcctgcggcggatgggccggcctgcccgaagacatgctgatcgaagcccttgtccacgcctttgccgccaatctcgtctcggcgggcgtccggctggtgccgctggggcagaccgatggccagcgggtgctggcggcgctggggcctgtgatcggtgccgtggccaccgccgcccgcgccaggccggaggccgctcccggcggggctgccattcttgccgacattgccgcccttcgacacgaaaccctctattccaggctgttccgctcatgaccacactctcccccgcgcccatcccgctcacccccgagcgtagttccaggcccttgcgcatcggtgtcggcggccctgtcggctcgggcaagaccgcccttctcgaagtgctctgccgcaggctgcgcgacagctatcgcatcgcggcgatcaccaacgacatctatacccaggaagacgcgcagatcctgacgcgggccggtgcgctggcaccagagcggatcatgggagtggagaccggcggctgcccgcatactgcgatccgcgaggatgcgtcgatcaatctcgcagcggtggcggagatgagcacccgcttccccgatctggagctcatcttcgtcgaaagcggcggcgacaatctgtcggcgaccttctcgcccgagcttgccgatatcacggtctatgtgatcgatgtggcggcgggcgagaagatcccgcgcaagggcggccccggcatcacccgatcggatctgctggtgatcaacaaagtcgatctggcccccctggtcggcgccgatctcgggatcatggagcgggatgccgcccgcatgcgcggccgccgccccttcctgttcaccaatatgaagagtggcgccggcgtcgatgccctgatcgcccgcctgctggacctgggcgggctggacgatcggctgggcgtgtcgtctgcggcaccgctggatgtcgcggcggccagagccgaggccgctgcctgatacggatcagagccggacgacgccaccacggccgggcaccgggacatgctcgtccggctggagtgtggtgcgcggccccattgcggcctgggtcgaccagaacccccgcagatagacgagaagcgccgtcaccgtcgcgagttcacccggcgtgaagacggccgagtagacggcgctcgccgccagcaggaacagcacatagtcgccgagagccgctgccatggcctcggcacgcgggtcggcgagctgccgctcgggcgcccgcgcccgccggccataggcgtcgcgcagccccgcaacatagagaccaaagatcagcagcgccccgaccacgccatattcaaaaacgatgccgacccagccgatatcggccagataaaagtgatcggtgccaaacaggtcgaaaagcgtcaccgcgctgaagcgggtgatcgaccccacgccgaagagccagcgccagacatccgccagcatgtagtcgaatgccagggacagcgaccgggcccggatcgagagcgagttgccgaggctcttctccagggcctcgaccgccgggatcagaaccgtgatcgccagcaccagcacaccgatcccgagccccagcgtcaccagcgatcggggcagcttgggcagattgcggtagagcacccaggcgctgatcaacagcagagccagaatgctgatccgctgcttgaagatgagcaccatcgtcatcagcccggccagatacagcgccacatagagcagccgcggcgagacgctcatccgtcgaacgagataaagcagcgagagcacaccgaagaccatcggcatatagatccggtagccacgctccagttcgtacatgaacagcttgctctgggtggcatccaccgcatagtgcgtgcggggcacgatcagccagagcagccacatcagcaggaaggtcgccacaccgaaagacagaaggatccggcgcagcagatccggcgacgggcgcagcagtgccagcgtcgagagcacgctgaaataataggtgatcggccagactttgatcgtcgtgccgaacgcgtcgataaaggcattgcccagccagagcatcgacagggccggggtaatcccgatgacatagccgagcacgatggcatagagcggatgatgacgtccgctcagccggaaggcgccgtggagtgccagcggcagggtcagaaacggccaggccttcgagagatagtaaaatggtcccgcatcgatgaggtaatggaagacctgcccgaacatcggcagtgccgcgacgagcagcaggatctccatccggccggtcgatcggtccgtcgccccggaactggcaaggaccctctctgccagatcggcggagacatccccatcgacagcgaggccgggcgccacgacccggccgcgacggcgcgacagaaccgccttctttccgccgccggttctcacgacggtcgctgcagaatgccgcggccaccaaatcgtgcgcggatgatgataccgaggatgggcaggctctcgtgaaatacccggcggaaatggcccaccggcgacagcatcagacgccagccgccttcaaggccgagctttcgaacccaagccggtgcgcgacgcaccagtccggtgacgaaaagcagcgaagatccgatgcacagacccgtgccaaccgcccctcctgcgtcggcgatgcgccgggcaagcagctcggattgtggcgagccgaccgcaatgaagacatatcgtgccgaccgcgcttttactgcctccaccgtggcatccactgcggctgcatcacgaatgaaacccatgggcggcacgtattgatgaaggtcggtcaacccgaactggcggcgaagttcagtcatcaatcgatcatcaccgccgacgaccatgactccgtcgtcgggccggatatggtgatggaacagtcggccggtgacatcggctcccgacgcatgcggcaaggcctgccccaggacaaggcgagagaaccggcgcaccacattgccgtcggacagaaccagccacgcaccagcataggcccgctcgaactccggagctcctcgggcaagccgaaccatatgttgggcgttcggagtgaccacataggcaaagccggcatcgggatcgcgtgctgcgatggcggccgcagccggatcgcaatcgagatcgctgatctcgagcccgagaaagtcgatccgcggcaccgcagccggcgtggaggcggtctcggcggtcatccggtcgtgcctccctgcgctagaacggcgtgttcttcgtcgtgtcgttgcgggtgatcgaatactggaagacccgctggaacggcacgacaccctcgatgaactgcgcgacccacagattgacctctgcaatccggctgcgcgggacgaagatgatgtcgccctgcacgatcggaatgtcgatcaaccggccttccagaagtccccgcagatcgacggtgcgcatcatcggtcgatcctgcgggtctcgtcggatcagcacgatctcgttcatccggccattgggcgttattccaccggccaatgtcagggcctcggcgacgccgatccgtccgacgatgcgatatacaccgggcgcacgtacgtcgccgccgacatagacccgggccgaaatggcatcgtcgacggccacgttcacgtccgggtctcgcaggatgcgcgtcgactggccggccacacgctcggaggcttgggccggggtcaggtcggccaccagcacctcacctgcagatttgagcgagacatagccgtcaggccggaccgtaacctcttcgtcgaactccggcgttcgccagaaaccgaccttgagcttatcgccctctccaatgcgatagggcggcagctcgtcggtccagtcggcaaaggcgatcggattataagtgccggacgcgaagggcgaatccgccgcgaccggacgaatggcctggccggtctcgcaggcgccaagcatcagcacgagccccatggcagccagaagccgcccccagttccctgcgatccgcatcacagccatcgatagatcgccctcggaatgtggaatcggcggccggtcaccacggctccaagcatgtctccaccggcatccagaatctggtcccgggtgtggctggcgaccggcgcacgggtatgttcagcccgcacgacaaggatggagccgtcgaccaccggcgcaagccgcaaggcaacaaagctattgcgggtcgccggtgcatcgacgatgacgaagtcgtagcggctggcaagcccctcgatcagcacccccaactcacccacctcggtacgcatgcgccccagcgtcgaacccgcagcatccacggtcacgtcgaggcggggaatccgtgtcggcgcggcccggataccatcgacgcccaactcaacggcatctccggcgcgcagtgcgccagcctggccatttccgtcacgatcgagatctaccaaaagcgtccgccggccatgcccttccgccagttcggtcgccagcgccctggagaaaccctcacggttttcagtttcgcctgaggagaccacctgaatggaccggagcgactgcccatcttcccgtcccgcaagcaggcgtccgacaaaataaatcatctgctcctgggcgccaccacccacgaaaccgcctgcttcgttgaaggtggccagaaccggcagtccgaggccgcgctcgatttcaagcggcaggagatacaccctgcggttccaggcagctgccagacctgcaacagcggcaaggagcaggccaccaaacaggccggccgccaccagattggttgcctggctgcttccacgtgcaggcgcatcggcatattcgaccacacgcacattcgatgcccgttcggcagccgcagcctcttccagactggccgtttctgcgcgttcccgtgcctgacggtagagcttgtcgacgacgtccaggctgcgcgtcaggtctccgatcacctgttcgccctctcgcagctcggcaatgcgcgtgcgggcaacgtcacgctgacgctccagctcttccagctgacgggccgtcgcctcctcttccagctgaatctggatgagatggttggtcagaaaggcgatggcgggattgcgaacggtccggtcggcaaaatagaccggccgttccttctcctgaaactgctccagcgtcttgatctggcgctcgatttcctgcaggcgcggatggttgtcctgatagcgcgcccgcagctggtcccgttcaagctggagtttgatgcgggcatttcgcgcctcgtcattgtcggtacggttggtccgttccgtgaaatcgaacacccgttccggaagcttggccaaccgctcctgcgcattcgccacctcgatgcgcagcgcttctcgccgctccatcacatggcgcctgcgttgaatgatgctatcctcctggttcaccgccagaaggatctcctgctccagattcaggaccttgtacttcgccttggcagtggccaggtttcgctgcagctggtcgatctgctggcgaaacttctcagcttcctcttccaggaagggcgatcgcggattggcatagatggaaccgcgtcgcgccagataggcccggatcaattcatcgaccgccctgatcgccacagcccgatcctgatgggaaaatgccacgagcaccagattggaaccgctctgcgcggtgatccggaagcgcgcctcggccaggtcggtggcgcgttcgaccagttgatcctcggagtcagctttgccgaaacccagcggtccctcgccatcaagccgaggaaacagggtctggacccccaccttgcgcaccatttcacggatcagggtccggctgcggagaatgtcgacttccgactccgtcgccctcaagccgtcgatggacaggatggacgggcgttcgacaaggtcctgatttccggactgctcggcattgaacaggacaagaagccgcgcttccgcctcgtaccggatcgggctgaaccacgccgccacacaggcaccgatcacggtcaccaggaacaccgcgatcatggccctgcgatgataggaggcgacgatcagcaggtcgcgcagggtatatgccccctgtcccgtgccctgcctctgccgtcgcgcagcctcgttccctgtcacgagcgacattcgacacctgcccagctgaggtcgtggtatctggtctcgatatacagacgctgaaccacctgccagatctcgctcgtgcgatccggacaatagctcatcgctgccgaatgagggtttccggcccaatctttgggaatgttcaaggtcacctgatatccaccaagaaatttctccggctcggaggcccaccatccaaaaggcagttcgcgtcggaagtattcgcggatttcatagagcggatccaactgtcgacttgccctcatggctgcgaccgaggggtcatcctcatccgcacggagttcctgaccgaaagccgccggaccggcaagaacggtgaatacgatcgcgctaaggatccgcctgcccgcccggtgtcccaagacgtcctctccagagactttccgcagtctgacgcggccaagagatcgacgacaaccggcgatagagcggacgctgcagccttcgaactcgctgagcacagcatatttgccccgcgccacgacttcaagcacgccttgtggccacgaagtaggtatactggcagagacttcagaaacgcgtcaggaacgacccgttcccgcgagtcgtcagtcttcccactctctcggatggatcggcaggtgcaacggatcgtcctcttcttccagcgccctgtggttgcgggcttcggtgtgcgagcctttgaagtggtggcgaagctggcgctttatcttctgacggcacgtattctgggggtggccgaagccggtctgtttttcctctgccttacttggtccagctggttttcaaccttcgggcgcatgggcatcgaccgggctctgacccgtcacatgggggcggaactggggctctcccagggtgccaccgcgcggcggacgctcctggccggtgtcggacgggtgaccgtgaccgggctcgtgctgggcatcgccaccggacttggcggtaccactctggcgcacatcgtcttcggcgatccggctctggcgcccgcactcgtccacacctccatcgccgtcgccggcatgtccgtaaccttcacactgaccgccgcactcgcgggcaccggtcggacgacctgggcgcaattcctgcagaatgcgttctggcctgcccttaccgtgctcgccgtcatcgcaggagcgcgggacgccgcgagcctggtgacctggatgggtgttgcgatctggttttccggcggtgttgccggcctgatcttcttttgcgaccggacccgtttccggcacgacacaacactgagcgccggcgagcccgcctccggctctgccggacatatgccgccactgatgacgacggcctggccgcttatggtggtcgagctcgtccaggcgaccatcgtgtcggttccggtcctgcttctcggagtgatggccgacgctgccgatgtcggcgcattcagcgtggcgctgcggatctcgatgctggtctggatggtgctggtcagtctcggcaccgtcgccagcccgcgctttgccgccctgcatcgcaagggtgatctggacagcctcggtcatctgaaccggcagatccagctgatcggcaccgtcaccggcggtttcgtctgcctggcgatgatcgtgctgcccgagacgctgcttgccatcctctctcccgacttcatcactgctgcggttccgctgatgatcctgggtgccggacaggcaatcaacgccctttataccgggcaggatgtgctgctcgccatgaccggcaacggcggcaccctgcagcgcctcaatctcgcgcagctggtggtggttctgctattgtccgtgagtttcatcccgctgatcggtgcatccggtgcagcactcgccacagcaatcgcaactgcacaggggggcctgggggccgccatggtcgcggcctcgctgctaccggcggcccgtccctttgccgcgctccctctgccggcgacgctccgccatcttctggctctgaaccggcaaccgtcaacgacctgatcatctgcttccgccccgcatctcaccaccacacggctgacgaggcccgccgcgcatgaccacgtccgacagcatcacgccccggctgcgcaacatcactttcggtcttgtgaaccgggccgtccgcttcctcgatatcctggccatgctggccgctgcagtagtcgcccggccactgtcggaagccaccgcggccgatgtgacctgggcacaatcggtgcttctgggtgcactggccgtcgtgcccatggtgcaggtgaacgagggacgtcgggtctatcggtgggaacggtaccgccacctgcgggggcaggtcgccgacatcatcctgggcctgctcgcctctctggtggtggccggcatcttcgccatcggctttctgccgggcggcattgtcgaaagctggctgacgaccttcgggattgccggcctgatcctgatgaccatcgggcgaagcatggctcggatcgccgtggcgggtatggaacggcgtggggcattgaagcgtcgggtggcggtgatcggcgccggcgaagaaggcgaggcggcgatccgctatctcgatgcccccggccggcgtgatctctatgaattgatcggtgtctttgacgatcgcgcagcgcgtcgcgcagtggaaattgcgggcctcaccgtcactcacggtgtcgacgaactggcccgtcgggcgcgtcaggaacgcgtggacgtggtgatcatcgccctgccctggcgggccggccagcgcattgccgagatgatgcgtaaactctgtgccatcccggccgacgtgctgctgccgatcgaggcggactggatcaatctgcgcggtgcgcagctgttcaatgtcggcggcctgccctttcttcaggtcgcacgccggccgctcaagggcactgacgcgattctgaagagcatcctggactatatcgttgccggcattgccgttcttctgctgtccccgctgctgctggtggtcgcgatcctggtgcggctcgacagccccggtccggtcctgttccgacagcggcgggtcggtttcaacggccgtgaattcgacatgttcaaattccggtcgatgaccgtcgatcccaccgacgacgggtcgcgcggcacgccgatggacaatccacgcatcacccggctcggtcgcttcattcgcaaaaccagcatcgacgaactgccgcagctgttcaatgtcctgcgcggtgagatgtcggtcgtcggcccccgcgcccatgtccccaatatgctggtcggagagcgcacctatttcgagacggtgcaggaatatgccgcccgccaccgggtgaagcccggtatcaccggctgggggcagatcaacggcatgcgcggcggcattcacgatgccgacaaggcccggcgtggggtcgagctggacctgcaatatatcgagaactggtcgctgtggttcgacatccggatcatggcccggactttgttcggcggcatggccggacgggatgtgttctgatgcaggcgatgcgcgcccttctgttgacgacgatcggccttctggcgacgcaggcggcctcgggcgccgagcgggtcacgcttccccagcccttctcgatggcctattacgaaagctgggacgagatacccgtggcactcggcagcgccacgcggctggcgatgacaccggaccatatcgatgtacaggtcctgggtttcgtcaaaccggacctcgtctaccgaggcgggctggatcttaccgagaccgggctccaggccccggtccccggccccgtcctcgccgatgccattcgggcgctgaaagggcgcgcacctgcgatgaaggtgctactggcggtcggtgggtccggctatgtcgatggctggcaccgctatgaccccggggccctggcacgtctggtcactgatcttgggctcgacggcgtcgatctggactacgagccggcaaaaccggattgtcagacggcggaggcgcgcaaaggctccaccgtcgtctgtcggacggatctcacctggtcgaggctgatcgccgacacccgtgcggtgcttccacgcccgatgatgctgagcattccggcctggagcactggggcttatggcaccggcgcatttcagaccgagccgcccggcggcccgtatacgggcagcatgctgtggttgagccgcgatcgcgaggcggccgccgccgtcgatctggtgaccatcatggcttatgccgccggcccgtcctacgatccggaacgcgctttcgcggcctatcgggcaatctgggacggcccgctcgcactcgggctgatcgtgccccctgacccgaccggccaacctgttccgggaatcgatgccattcgcgatcttgccgcacgcctgaaagaccaggagcaggccggggtgatggtctatggcatgcttggcacaccgccctcgggcccaagtgccgcaacgcccagcggcggcatgatgctgcgggccgtctgcgagggcttcggccgcgacggatgcgatgcggttctcccttaagccctgaaacggggcaacgggatcaggcagagaccaccgggccgtaagccgcctccagccgggccagcggctcaggccgtgcgacgaagatgaaattgttgacgtagatcctgtcgggcagccggcgggtcccctctgcattcaaagcagagcgatcctggagccgggcgatatcgaagcccgtcatgtcatgcagacggccgtcgagcagataaagaccgcgatagccgatcggtccgagcaaagcctggagttcggccagagtgcccggggtgtgacgttcttccgcctctatcagcaggctgggctgatgggccttcagggtttcgaccgcgccacgaagtgccgtgccttcgaacccttcgacgtcgatcttcacgaagcccacgcgccggccgcggccgatgtctgatttgagatcgtcgagccgccggacggcgacggcaatgtgcagcattccaggcgtgctgacgctttgcactgcctcctccttcatggaggcgagaccggatccggcctcgggaacatgcagtacagcctctccttcggcgtcgcccagcgccatcggcatcaacaccagccgcccttcccgcaattcacgggcgaaccgggtcttcagcaccttgcccatggtggggttgggctcgaaggcgaccacgcgtccggcaacctgcagcatgggcgccgtataggcgccgtgattggcaccgatgtcataggcgtcggcatcggcctcagccagaatcggtaccaacgccagttccttttcgccgtaatcgggggccatacgatcgcggaagtcgatcagccgggcgtagagccggggcattcgtcgttcaatgatggttttcaggccggccacggcagagaatccctcggatcgtatgggcgatgactacgaactttatcatcatatcacggttgtcgaccgggaggatgtctatcgctgccacaacgctgcgcggacgagacacttgccccgaatgacaggccggccgatgatcacatgatgaccacggaccccacagataccggcttcgatggccgcggcccccacgcccctgatccgcggatccaggctttgatcgcgtattggcggtcgctacggatggggcgcccgatgccgcttcgtcgggatttcgatctgctggtcgatatgccgagaaccctgcccaatcttctggtcattgaacgcctggccgatggcggctttctgcaccgctatgtcggcagtgtcatcgtcgcgctcgccagacgcgacgccaccggccatctcgtcgacggcatctggtacggaaatcgctgtgccgacatcctgcgcgcttatgaccgcgccatcgacgaggccacactcatctggggcgtcgatcgtgccacctggccggatggcgagtggcgcatggcagagtggctgatcatgccgcttgcccgcgcagacggcacgcccggctgggtcgccacctataccgtcgtgctcgacggcccggtaacggcctaccgtccgcaggttcgtgtcctgaaggactgatatccccacggctacagcctgaaatgctgcgccagcacggagccaatcgccccgacggcgtcgtcgccatccgatgaatgcgcaaggacaacagcctggtgcacaccgatcgggggtagcgtttccacgatctgcatggccggcgtcactctggacctgtcgaccaccgacagggcaagcccggcttcgacgcaggtctcgaccgcaccggccgacgggctggcgagcagcacccgccacgaccggccggctgatgtcagagcctccagcatcgcatcccgataggggcagtcggccgcatgaagagcgagcggcagaatgtcgggcagcgcctttgccagcgccggcgccgccacccagaccggcgtcgtcgccacaaggtaccgcccgtcatgctctcccccggccggccgcacgatcaccgccatgtccagccgcccgcgccggaattgatccgtcagtacaccacttgcagccgtttcgacctcgagcaccacccggggccatcgcgccacgataacgggcaggatgtcccggatcacatgcccggcatattcatcgggcacccccaggcggaccttcccggcaggtccggtatcctgaatctcgtccataagacggtcatggacccgaagcagttcggtcgtccccgcgagcagacgctggcccaagggtgtcagcacgacggcgcggttgtcacgctcgaacaggcgaccgccggccaccgcctcgagccgttggacctgaacgctgatggccgccgggcttttgttgagccgttcggctgcagcccgaaaccgtcccagccgggcgatcatgtggaagctgcgcagaaggtcgaggtcgagcattggcggcatgatcaaatttttccgaacatggtgatcaaatcatttcgttttagtgaatgataacaccgcggcaggatcaagactcctttcacgaccctccgcaacggaatgtgccatgacgatgatctccaccaggcttcgccacccggggaccagtatgcccttggccctgctcgaagccggcctggtggtcagctggagctccggcttcgtcggcacgcgcctggcggtcgatcacgcgccgatttttctggtcgtgttctggcggtgcattctggtcagcctgatcctgctgccctgggccatccgccagatccgcagaactggcccgctccgcagatcgggatggcgacgcctcggcgccgaggccgcaatcggcgcgctggcgatgggcggctatctcgccggcgtcgcgaaaggcatcgagttgggggtgcccgcggggctcgcggccctgatcgcagatctcctccccatcggtacggctctgctcggcgccgccttcttcggccggcatctgccgggtcgcggctgggcgggcctcgttgccggtggcatcggcgtcgctattgtcggccaggatgcgttggcgtctcacgagataccggtcttcgcgatactgctgccgctcggtggcatggcggcactggcgatcgccaccctctggcaggcccggctgccggccgggggggaccccggcccccttgcacggctctggctgcacgcggtggtctctgccctggtgtttgccggtctggccggcgccgatggcggtctcgcaccgccggcgacacccggcttcgcagttgcggtgctctggacggggcttctgtccagcctcggcggctatggcctctactggctctgcctcgcccgaagctcgcccacccgggtggccacggttctctatctgagcccggccgtcaccctggtctgggcatgggccatgttcggtgagccgctcacctggatgatggtggtcggcaccgcgctctctgcctggggcatctcgcaggtcatccgtgccgaaggccagggcagcgaacaaggccagggcagcgaacggcgaaggcccgcccggatcgctccggacgggccttcgtgcaggtcgtgatcgccgggatcgacgatggcgggatcagcggcgcgcaagcgccttcagcgcaccgcggccggcgtaatagccggtatcgcccaggatctcctcgatgcggatcagctggttgtacttggccagacggtccgaacgcgagagcgagccggtcttgatctggccgcaattggtggcgaccgccagatcggcgatggtggtgtcttcggtctcgcccgagcggtgcgacatcaccgcggtgtagccggcgcggtgggccatgtcgaccgcacgcagcgtctcggtgagggtgccgatctggttgaccttgatcaggatcgagttggcgaggcccttctcgatgccctcggccaggatctgcgggttggtcacgaacaggtcgtcgccgacaagctgaaccttgccgccgatggcgcgggtcagggccgcccagccgtcccagtcctgctcagccatgccgtcctcgatcgacacgatcggatagcgtgcgaccagatcctcgtagaagcggaccatctcgtcggcgccgagcacacggccctcgccgtcaaggtgatacttgccgtccttgaaaaactcagacgaggcggcatcgagcgccagcaccacgtcctcgcccggcttgtagccggcggattcgatcgccttcatgatgaagtcgatcgcctcggcattgctgccgagattgggcgcgaagccgccttcatcgccgacattggtgttgtgaccggccgccgacagctgcttcttcaggtggtggaagacctcggcaccggtgcggatggcatcggcgatgctgtccgacgccaccggcatgatcatgaattcctggatgtcgatcgggttgtcggcatgggcgccgccgttgatgatgttcatcatcggcaccggcagggtgtgcgccatgacaccgccgacatagcggaacagcggccagccggcctcttccgccgcagcgcgggcaacggccaggctgacgcccaggatcgcattggcgcccaggcgcgacttgttctcggtgccgtccagctcgatcagcgcctgatcgatgccgatctggtcctcgccgtcatagccgatcagctcgtccgaaatctcgcccatcacggcctcgacggcctgctcgacgcccttgcccagatagcgggcggtgtcgccgtcgcgcttctcgaccgcttcgcggctgccggtggaggcgccgctcggcacggcggcacggccgatcgcaccgctttccagctcgacatcgacctcgacggtcgggttgccgcggctgtcgaggatctcgcgggcacgaatatcgacgatggcagtcatgggatgtctcgctctccgttcaagggcaaggggccgggatcgactgtcgaggggctgcctgccgacgaaacgcgccgtcgacaggaagcgatgcaggatcagaatgaaggccgcccatgacgatgatgctgtcggggcggcagaagatcagacggccagcgggcgggccttcgcggcggcatcgaacgccatccagtcggccaccatctcgggcagcgccttcagcggcaccatgttcggcccgtcgctcggcgccttgtcggggtcgggatgggtctcggcaaaaatcgccgccacacccaccgccgccgccgcacgcgccagcaccggcacgaattcgcgctggccgccgctgcgcccgcccagaccgccgggctgctgaaccgaatgggtggcgtcgaacaccaccgggcaaccggtgcgggccatgatcggcaggccacgataatcggttaccagggtgttgtagccgaagctcgccccccgctcggtgagcagcacgttggggtttccggccgcatccagcttggcgaccacattggtcatgtcccagggcgccaggaactggcccttcttgacattgaccacccgcccggtcttcgccgccgcgaccagaagatcggtctgccggcaaaggaaggccgggatctgcagcacgtccacggcctcggccgcgatggcgcactgctcgggcagatgcacgtcggtcagcaccggcaggccggtggtctcgcggatctcggcgaagatcggcagcgcgtcttcaaggcccaggccgcgctcggcactggccgaggtgcggttggccttgtcgaacgaggtcttgtagatcaggccgatgccgagcttttccgacatctccttcagcgccgccgagacctctagggcgtgggcccggctctccagcacgcaggggccggcgatcagcaccagcggccggtcattggcgatctcgagcgcgccgacgcgcacgcggcgcataccgttctgggtctcggtcatctcgggccttccttgggatgtccgcagcagggggatcttgtcggtcagacgagccgcgactgctccatcgcggcccgcacgaaggacacgaacagcgggtgcggctcgaagggacgcgacttcagctccggatggaactgaacgcccacgaaccagggatgatccggcagctccacgatctcgggcagcacgccatcgggcgacaggcccgagaagcgcagacccgcggcctccagccggctgcggtagttgacgttcacttcccaccggtggcggtgacgctcggcaatccgctccgcattgccatagatggcggcggcacggctgccaggcaacagggcgcagtcataggcaccgagacgcatggtcccgcccagatcgccgccctcgatgcgggtttcggtcgagccgtccccccgcgaccattcggtcagcagacccaccaccggctcttcggtcgggccgaactcggtcgacgacgccttgggcaggtcggccagatgacgggcgatctcgatcaccgccatctgcatgccgaagcagatgccgaaatagggaatccgccgctcgcgggcgaaggtgacggccgcgatcttaccctcggccccgcgctcgccgaagccgccgggcaccaggatgccgtgcacgccctccagatgcagcatggcgtcgtcgcgctcgaagacctgagcgtcgatccacttcaggcggaccttgacgttgttggcgatcccgccatgggcaagggcctcgttcagcgacttgtaggcgtccatcagctcgacatacttgccgacgacggcgatggtcacctcgccttccggccgcttgatccggtcgaccacccgctcccagcccgtgagatcgggccgcggcgaaccggtgatgccgaaggacttcagaacctgggtgtccagcccctgctcgtgatagcggatcgggacctcgtagatggtctcgacgtcataggccggcaccaccgcctcttcacgcacattgcagaactgcgcgatcttgcggcggtcggaggccggaatttcacggtcgcagcgcaccagcaggatgttcggctggatgccgatgccgcgcagctctttcaccgagtgctgggtcggcttggtcttcagctcgccggccgccttgatatagggcaccagcgtgacatggatgaacaccgcccgctcggggcccagctcgttgccgagctggcggatgctctccatgaagggcaggctttcgatatcacccaccgtgccgccgatttcgcaaagcacgaagtcatgcgcctcggcatctgccaggatgaattccttgatgcagtcggtgacatgcgggatcacctgcacggttccccccagatagtcaccccggcgttcgcgggcgatcacctcggaatagacccggcccgaggtcacgttgtcgttgcgccgggcggcgacaccggtgaaacgctcgtaatggccgaggtcgaggtcggtttccgcgccgtcgtcggtcacgaaaacctcgccatgttgatacgggctcatggtgcccggatcgacgttgagataggggtcgagcttgcggaggcggacacggtagccgcgggcctgcagcagcgcacccagcgccgccgagcccaggcccttgcccagcgaggagaccacgccgccggtgatgaagatgaaacgcgtcatgggagaagctcgtcctggtctttggcgcgggggcgcgccggacgtcgatcaacgggcgaaggccacgccccgaaagcgcggcccggccggcgatcgacacaccggcccgtcctcgaagtccttgagcggaccggccccgacgggcccgtccatcaagctccgagccccgcggccgaagcggcgcggggcccgaagcagtgtcgtcagtttgcggccggagcggccggcgccgaaggcggcgtcaccgtgtcgcccgaaggcgccggtgccgcaggcgacgaaggcgtctcagcgggtgcggccggtgcgacgggcgccgtcggcgtcgccggggtgatcggcgcagccgggcccgccggcgtggtggtgtcgatgcggtcgaggaccgagccaccccgattgtgggtgccgccgaggatggcgaggcccaggctggtcaggatgaacagcgtggcgagtaccgcggtcgcacgggtcagcaggttggcctggccgcgcaccgacatcagcccgccgccgccaccgccaccaccgatgccgagcgcaccgccttcgctgcgctgcagaaggatcgtgatgatcagcgcgatcgccagcagcaggtggatgaccagcagaacactttccatggggcgtgtggtccgttctcgaaagtgtggtcgcgagacccgggctttctgccgggccgcacgggtttctcagaggggggagcctcggcctcagcgggccggtgccgccgccccgatggccaggaagtctgcggcgttgaggctggcaccgccgaccagggcgccgtcgacatcgtcgacccccaggatctcggctgcgttgccgggcttcaccgaaccgccatagaggatgcggatgccctgggcggcatcgccgaagcgcgccgccaggcgcgcacggatcgcgccatgcaccgcacggatatcgtcggtcgtgggcaccagacccgagccgatcgcccagaccggctcgtaggccaccaccagacggtcggccgaggcggaggccgggacggagccgtcgacctgcgtttccaccaccgcaacgccctcgccggccttgtactgatccagcgtctcaccgacgcagacgatcgggacgaggcctgcggctgccgccgcctccgctttcgcggcgacaacggcatcggtctcgccatgatcctggcgccgttcggaatggccgacgatcacataggtgcagccgacatccttgagcagggcggcggcatgatcaccggtgtgggcaccggaggccttggcgtggcagtcctgggcgcccagggcgaccttcgaaccgcggatcgcctcgcccacgaccggaagcagtgcggcgggcgggcagacggcaaacccggcggcgaggccttcggcgccggcggcgacttcggccgcaagcgcgcggccatcggccaccagcatgttcatcttccagttcccggcgaccagcggcgtgggacgatgcggcatacccggtagctcccgtaatcttataagaggcggctgcagaaacgagtcggtctcttccccggcaggaaagcccggttcaccggcggatccgcgggatgatcgccggcggcaatcaggtccacgcacgcattcacgcccggcaaacgcgccctccgcgtccggtcggggctgctataacacgcctcgcagggcatttccagtcggtgcgacagcacataacgcaggcccgacatgcagcgggcgggtttcaagattgcgacgcagaggccccgccttctattatgcgcgcgaccgtgaccccggccgtgcccgcctgaccgtgccgccgggccgaacagagatcaggatccgtcccgcatgctcaaccagtttcgtaccgcgtcccgccactggctgttccgcgtgttcctcatcgcgctggcagccagcttcgcggtctggggaatcggcgacatcttccgcggccgcaattccaccgtcgtggccgaggttggcggcgtggaggtgacaccgcaggagctggaccggatctatcagggtgagatccagcgcgcccgccagatcttcggcccgaccttcgaccagaacatggcccgcagcatgggcctcttggagcgctcggtcggcatggcggtgggcgatgccatgatccgcgccgagaccgcgcggctcgggctcggcgtcaccgatgacatgatcgcccgctcgatcaccgaggcgccggccttccgtggcatgggcggccggttcgaccggatggtctacgagcaggtcctggcgcgcaacggctatacgccggcaacctacgaggcgtcgctcgccgatgatctgcggcgtcagcagctgatctcggccctggcgacgcccgttccggccccggagccgctggtgacgctggagcacatgttccagggcgagcagcgccggctgatcacggtgcgtgtccccgccgatccggccgcgatcgaggcgccgtccgacgaggtgctggccacctattacgatgccaacaaatcggcctatgcgatccccgagcggcgggccgtcagcttcgcaacgctgacccccgaggcgctggcatccgagattaccgtcgacgaggcggcgctgcgcgaggcctatgaggcccatctcgaccgctacaccaccccggccacccgccaggtgctgcagatgaccttcccggacgaggctgcggccaaggctgcccgcgaccggattgctgccggtgaatctttcgacgaagtcgccggtgcgctgggcttcgacgcctcgaccatcgatctgggcgacgtcacccgcgagcagatgctgcccgaacttgccgatgcagctttcgcccttggcgaaggcgcggtgtcggcaccggtgcagagccccctcggctggcatgtgctgaccgcacgcaatgtcgtcgagggcaagacccagagcttcgacgaggtccggcgaggccttgaagaagagctgaagctggagcgtgcggtcgacaaggtctatgaggaagcgacccggatcgaggacagcattgccggcggtgcgaccatcgagcaggtcgcgcagcagttcggcctggacctggtgaagatcgacgcgatcgcagccgacggcaccgatggtctgggtcatccggtcgcccgcgcgcccgagaccgaccgcttcccggccctcgccttctccaccgatcagggtgctaccacgccgctgaccgaatgggaaaacggccgctatttcatcctgcgtgtcgacggtatcacccagcccgaggaccggccgctcaacgaggtgcgcgagcgcgtcgtggccgactggcgggccgaagaagcccgcaagcaggcctccgagcgtgccgagaagctggtcgaagcggtgaagggcggcgcggcactcgccgcggcggcggccgggttcggcctggatgtcgaaaccccgccggcaatcgatcgccgcggccagattgccggtgccccgggtgcgcagccgcagcgcgccaatctgccggcgccccttgtccgtgatgccttcgctgcaaagaccggcgatgccgtcgccgccgataccggcgacggcagccgtatcgttgcggtcgtggcggatgtgatcgtgcccaaggcgcccgaaggggcggaagcggccgctcttggtgcgcgactggaacaggcgcagtcccagagcatcctcacccagtacgagaaggtgctgcgcgcccgccatccggcctcgatcaatcagggcctgatcaaccagatgtacccggctgccggctcctgaaccggcagccatccgcatcggtaccaggccacgcctcgcctgccccctctttgaaagcacatggccgcccatggacatcgcgcccgatttcgaccgcttcgcgacgctctacggcgaaggccgggcccaggtggtctccaccaccctggccgcggatctggaaacgccggtctcggccatgctcaagctcgcggatcggcggccctattccttcctgctcgaatcggtcgagggcggtgccgtccgcggccgctattcgctgatcggtctcaagcccgatctgatctggcgggtggtcgacggccgggtcgaggtcaatcgcgacgcccgggcggatctggatgccttcgtgccggaggagggcgccgagcccatcgcctctctgcgggcgctgatcgccgagagccgtatcgacctgccggacggcctgccgccgatggcggccggcctggtcggctatctgggctatgacatggtgcgcttcatggagcgcatgccggccccgaagaacgatgcgctgggcatacccgacggggtgttcacgcgccccaccgtgatggcgatcttcgatgcggtcgacagcaccgtcaccctggtgacgcccgtccgcccggctgcaggatgcgatgccgccatggcctggcggctggcgcgggaacggctgatggatgtggtggcggatctgggccgcggcctgccggtcggtctggcgccctcggcggccgatcttggccagaccggagagccgcgctccaatgtcggtcaggcgcgcttcgaggagatggtccgcaccgccaaggactacatcctggccggcgacgccttccagatcgtgccctcgcagcgcttcaccctgcccttccggttgccgcccttcgccttctaccggtcgctgcgccgccagaacccctcgcccttcctgttctatctggatttcggcaccttccaggtggcgggttccagccccgaaatcctggtccgggtccgcgatgacgtgatcaccgtgcgcccgatcgccggcacccgtcggcgcggcaaggatgccgcggaagatcaggcgctggccgaagagctggcggccgatccgaaagaggtggccgagcatctgatgctgctcgatctggcccgcaacgatgtcggccgcttcgccgaaatcggcacggtcaaggtcaccgagaatatgatcatcgagcgctacagcgcggtgatgcatctggtctccaacgtcgaaggccggcttgccgatcgtcatgatgcactggatgccctgatcggcggcttcccggccggcacggtttcgggtgcccccaaagtgcgggcgatggagatcatcaacgagctggagcccgaccgccgcggcgtctatggcggcggtgtcggctatttctcggccggcggtgccatggacagctgcatcgtgctgcgcaccgcggtgatcaaggatggggagctgcacgtccaggctggcgctggcgtggtcgccgacagcgacccgacctctgaatacgaggaaacccgcgccaaggcccgggccctgatccgcgctgccggcgaagcctggcgctatgcgggtggccttgcgcgatgacggtatccgcgaccgagccgctggttccgccagaagtgtcgtcggtccggatcgaaaccgaccgtctgatcctgcgtcagtggcagcagggcgacctggcgcccgttgccgctctccgcggggacgtacgggtgggcgagacgctcggcggcacgctcaccggagaccagtcccacgcctttgcacagcggatggcggcggagatcgccgcgcgcggctggggcttcttcgcgatggaagaccgccgctcaggggatttcgcgggcttcggcggcctgcggccggtccccttcgaggcggccttcacgccggccattgaactgggctggacgctctccccggccctctggggacaggggcttgcgaccgaagccgcacgggcggcaagcggctttgccttcgaaaccctgggccttgacgaggtcgtggcctacacggccgcgtccaaccagcgctcgcaggcggtaatgcagcgactgggcatggttccggatccggcgctggatttcgatcacccgcgccttgctccggaccatccccttgctcgccatgtgctctaccgcctgccgcggccgtagagcaccatcagggagcgcgccatcaggccgccttgccaccgaagtcatagccggcatcatcgatcgcctcacgcaccacggcctcgtcatgggcgccggcgatcgtgaccaggccggccggccggtcgatctcgatctcagcctcgggcaggcgggtgcccagggcgcggcggaccgcctttgcgcagccgtcgcaggtcatgccctcgacacgataggtctgggtggtcatgtccgtcactccttcactgccggcccgtcggcaaagaccgggccttcctcggcccgtgcgggggccgcctcgtccgacgcggtgcggggaccggccggttcactggcgccggggaccgcgaccagcgcagtcaacggcacgaaaacaatgccccgcgcctgggccgccggcagccagcggttcagtaccttcagggtctcgggatgcgggtggccgatggcgatcgcagcgccgtgacgccgggcgatcgcctccagccggtcaagctgggccgcgatcttgcgctcgtcgatctcgtgatccagaaacacgtcgcgctgaacattcggaatgccggccgaaatggcagccttggagcctaccgatttcgcggtcgtccggctgtccaggaacagcagcccccgcgccttcagctcggccatcaccgccgccatcagtggcgtgtcctcggtcgcccggctgcccatgtggttgttgatcccgacataggcgccgaaggcctccagattatgcttcagccgcttgacgttttcggccaccggcagcgccggattcagggcacccggccccggatcggccgggccctgcggctgcatcggcatatgcacgatcaactcatgccctgctgcccgcgccttggccgcctgcccggcgacatcctgggcatagggcaggaaggcgaatgtgatcggcgacggcaggccgatggcggctgcggtctgcggcttgttgacccccatatcgtcgatgacgatggcgacccgcggccccttggatgccaccggtgccggcatcgcgtaacgctgccaggcgggcttgccgtcggccggcggccggatggcatccggcaccggcggttgaatcgccgccagttgctgcggcgccggttcagctgtggcaacggcagccggtgcctcggccggcttcgcaggcgcggcttttggcgccgccggctgcggatcaggcttcgcggccggtgcaggcggcgtggtcgcggcggcctggggctgcgactcacggctcgcatccgcacctgtgatcgtatcgccgctgccggccagatccggcgtccattccttccgcggtgcttcgggggctgcggccggggcctccggggcctggggccgggcaggctcggtcacggctgcaccggcaggcagggtcggccgggcgacctgttcatagcgcgcgggcttgatcagcgacccgatcacggcgcctgcgaccaccaatagggcgatgccgaccagcccatagcccaggaaacgccgccgggcgagcagagccgaaccgaaacgagcaagaaacccggggccttcagcccccgaagccccgaccggcccacgcaggctgcgcggtgtgccaccagatgcgggcttgcgggatgccgccttcgatgccggcttgccggcagccgtccccggttttgcacccgcagccctgaaggtggcgcccttggccgcgccggccttcgccccagccgcctttgacgccgacgcctttgacgccgacgcctttgacgccgacgcctttgacgcccccgccttggacgcgccagtggcgctactgcgtggcctgcttccggcagccggcttgcggccggccgtgccggtctcgtcgctgcccttgcggctgccgccaccctttcggccggcgccgccgtcgcggcgtccgtcctcgcccttgctcatgcgtctggtccgtaatcactctggtcctgggccgacccgcggccggcgggcgcactatagcccatcgtccggccgctgccgatgggcctgcacgtcatgaccggcgaccacatcctgcccgtcatgctcggccagatcgtccaggatcgggcaatccggacgaccgtcgccatggcagtttgcgaccagatgggcaagggtgcgccgcatgctccggagttcggccatccggcggtcgatctcggtgatccgggcttcggccagctggcggacgtcgcggctggcccgtccgcgatcatcccagagtgccagcaggtcgcggacgtcatccaccgggaagcccagatgcctggcgcgcagtacgaaccgcagccgatcgagtgtcgtcgccggatagtcgcgatagccattggcggcgcgcgccggcttcggcagcagcccgatctcctcgtaatagcgcaccgtcttgggattggttcccgcagcctcggcgagcgcaccgatggtcaggccggtcatgcggcgcgctccctcatcccggccggccgccagcgggccagcagcagggcattgccaagcacgctcacggaacttgccgccatcgccgcccccgcaaacaccggatccaggatgcccagggcggcaagcggaatgccgatcacattatagccgaaggcccagaccaggttctggcggatcttcgcccgggtcgcccgacagatatcgagggtcgcaggcaagagggatgggctctgtcgcatcagggtgacatcggccgcagccatcgccacatcggtgccgccgccgatcgcgaccgacagatccgccccggccagggccggcgcatcgttcacaccgtcgccgaccatcatcacccgtcggccggccgccctcgcctcggccaccacggctgccttacgggccggatcggccccgccgaccgcctcgctgatgcccagccgtgccgccaccgcctgcgcggtcgccggggcatcgccgctcagcatcttcacggtgatgccgcgatcgccgagcgctttcaccgccgccgcggcatcggatcggggggcatccgccagcacgaaaccgccgagaaggtccggttccccggcttccggcaccgccgccagccagacgaccgtcgcgccttcggcttccgctgcatctgcctccgccgtcagcgccgccgggatctccaccccggcctcagtcatgaagcgtcgtgagcccagcctgtggggcagcccggcgatcgcgccctcgacgccggcaccggtgcggttgcgccgctgggcgacctcgaccggcgccacatcctccgtctccgccgcagcgcggatcgcacgggcaagcggatgttcgctcgcctgctgcaggccggcggcgcgggcgagcgcattgcccgtcgcaccgatcatccgcagcagccgcggccgcccctcggtcagcgtaccggtcttgtcgatcagggcgaggtcgatgccgaccccgtgatcgaaggctgcgggagaccgcaccaggatgccggccttcgccgccgcccccgtcccggccacgatcgcggccggtgtggcgaggcccatggcgcaggggcaggcgatgacgagcacggtcacggcatgaatgatcgcctcgggccagggcgtgccggtcgccacccagccggcaaaggttgcaagtgcgatcaggatcaccgccggcacgaagaccgcgcttacccggtcgaccagcgcctggaccggtgcgcgcgtcgcctgggcgtgttcgaccatccgcaccacttgggcgagggtggtatcgcggccgacccggacgatgcgggcaagcaggggatcggaaccattcaccgtaccggccgacagcgtgtcgccgacacgcttcgtgaccggcaggctttccccggtcagcatggattcgtcggcggccccctcgccttcgatcacacgtgcgtctgctgcgatacgctcgcccggccggatcgacaacacgtcgccgggccggagtgcggtcacggcgacctcgacgtcgtttccgtccggggtgcgacgcaacgcggtgtcgggcctgagcgccgccagggcccggatggcggcgccggtggcacgacgtgccctgccctccatccagcggccgaacaggaccagcacgatcaccgcggccgccgcctcgaaataaagatgatggacctggccatgaaccacccagagatagaggctgagaccgaaggccgcccaggtgccgagcacgaccagaagatccatgttccccaccccggcgcgcagcgccccccaggcgggtttcaggaaccggcggcccaggccgagttgtaccggcacggccagcgccagctgcgcccagcccggcagcgggccgataccgaactgggtccagaccatctggccgaccagcggcagggccagcagcgcgccgatcacgacctcgatgcccatgcggcggctctcggccagctcctgcgcctcgcgcgcctcgcgggggtcgacacccaggccgccatcctcggcggcttcgggaatgatgtcaccctcatagccggcgcgggtgagtgcctggatcagacgctcgtctgtgacgcccggctccagcgtcaccagcgcctcatgggtggcgaggctgacctccgcatcccggaccccctcgacccgcttcagcgcccgccccacccgggtgacgcaggtgccgcaggtcatgccctccacggcgatacggcgttcgacggcgttgtctccggggccctgttgcgcagccgtgatcgtatccatttcgcaaccctctctcgaatgctccgcgggggtgacgccgatgggcggcatcggatggagcatcccttcacgacccagtctgcaccttccagtcgctggaaggtcaagcaccccctgaccgattgcgacggcctgtcgcggcgttccggcaaccggccggtgctacggccgcatcccgcggcttgacggcagcggatgcagggggtttcctgtgcctccggcggccctgtatgggccggtattcttccgtgcgcgaggaccccgaccccgatgatcctgccgaccccgaagatcctgatggtggacaattacgacagcttcacctggaatctggtccattatctgggcgaggccggggcggaggtcgaggtggtgcgcaacgaccagatgaccgcagacgaggccatggcgcatcggcccgacggcattctgctctcgcccggcccctgcgatcccgatcgcgccggtatctgtctcgacatggtcgcggcagctgcccgaaccggcacgccgctgctcggcgtctgccttggccaccagaccatcggtcaggctttcggcggccatgtggtacgggggccgaagccgatgcatggcaaggtgaccgccatccaccatcatggcggtccgctgttcgccggcctgcctgagaccttccccgtgacccgttaccactcgctggtcgtagagcgcgcaagcctgccggccgcgctggtggtgaccgccgaggatgatgacggcatcatcatggggctgtcgcatcgtgacctgccgatccatggcgtgcagttccatcccgaaagcatcgcatccgcccacggtcacgagctgatcggcaatttcctgaagacggtccgcacctccgggaccgcacgcgcgacggagaccgcatgacttccgacaccaccagcccggatttccgggcgctgattgcccgtgccgccgacggccatgccctgacccgcgaggaagcccgccaggctttccggctgatgatgggcggcgaggcgacgccggcgcagatcggcggtttcctgatggcactccgcgtgcgcggcgagacggtcgaggaaatcaccgcgggcgccgaggtgatgcgggccaaggccaccaccgtccgggtgccggccggcgcgatcgacacctgcggtaccggcggcgatgcgcgcggcacctacaacatctcgaccgccgccgcactgatcgtggcggcctgcggcgtgccggtggccaagcatggcaaccgtgcgctctcctccaaatccggctctgccgacgtgctcaaggcgctggggctcaatatcgaggccgatctggagcgggtggaacgcgcgggacgcgatgccggtttctgcttcctgatggcgccgcgccaccacgccgccatgctgaacgtcgccggcccccgggtggagctcggcacgcgcaccatctttaatctgctgggccccctcgccaatccggcgggcgccacacgccagttgatcggtgtcttcgccgagcgctgggtggagccggtcgctcaggtgctgcgcaatctgggctcggaacgcgcctgggtggtccatggtcgcgacggactcgacgagatcacggtcaccgacgagactgccgtgtcggagctgaaggacggcaaggtcaccagcttcacggtctcgcccgagatgttcgggctcacccgccatccggcagaggcgctgaaaggcggcgatgcccagaccaatgccgcggcgatcctggcgatgctggacggcacgcccggcgcgctccgcgacatcgccctgctcaatgccggtgctgccctgttggtggccggggttgcgggcgatgtcggccagggcatcgccatggcccgcgacgccctggatcagggccgcgccaaggcggttctggacagggtcatcgcgatcaccaatggccgggagggctgacgacatggccggcgataccctcgcccggatctgcgccgacaagcgcgaccacatcgcccgcaagaaggccgagacgccgcttgcggcacttgaggaccggctcggcgaagcctcggcgccgcgcggctttcgcaaggctctggccgccagaacggtgcagggccttccggccttgatcgccgaggtcaagaaggcctcaccctccaagggactgatccgcgccgatttcgaccccgcatcgcttgctcgcgcctatgccgcggccggggcggcctgcctgtcggtgctgaccgacacgccctatttccagggcgaggatgcctatctggtcgcggcgcgtggagcggtcgacctgccggtgctgcgcaaggacttcatgctcgacccctatcaggtgatggaggcacgcgcgctcggcgccgactgtatcctgctgatcatggcggcacttgacgatggtcaggcggcagagcttgaagcggcggcgttcgagcttggcatggatgtgctgatcgaggttcacgatcgcccggaactcgatcgtgcccttcgactgaagagcccgcttctcggcattaataatcgcaatctcaagaccctggtggtcgatcttcagacctcgatcgagcttgcggccgcggtgcccgccgatcgggaactggtctgcgaaagcgggctcgacggccccgatgcgctcacgcggatgatggggcatggcatgttccgcttcctggtcggcgaaagcctgatgcgacagaacgacgtcgaggcggcgacccgccatctgctgtcggcgcgggcgccggccgcggcggagtgatggcgatgacatccggcctcacccatttcgacgaaagcggtgccgcggtcatggtcgatgtatcggccaaggatgtgaccgagcgcgtagccgtggccgaagcgcgggtgcgcatggcgccggagacgctggccgtggtgaagcggggggatgcgaagaagggcgacgtcatcgccatcgcccgcctcgcgggcatcatgggtgccaagcgcaccgccgacctgatccctctctgccatccgctgccgctgcagtcggtgacgctcgacctggaggcggatgacgccctgcccggcctggtcatccgtgccaccgccaaggtcacggcgcgcaccggcgtcgagatggaagcgctgaccgccgcgagtgtcgcaagcctcacggtctacgatatgctgaaggcgatcgatcgcggcatgaccatcgagaccatccgcctgatcgaaaagcgtggcggccggtcggggcactggcaggcggccaccccggacgacgccggctgatcgacacgcccctcttcacgcaccgggagcccgacatcatgctcaccgtcgacgacgcccgcgcccgcatccttgcagacgcaacgccgctcggcgccgaaacggtgccgctggggctcgcccgtggccgggtgctggcacgcgatgtcgtcgcccgccgcacccagccgccgcaggccatgtcggccatggatggctgggcgctgcgcagtgtcgatcttgccgaggggcaccggaccttccgggtcaacggcgaagcccgcgctggcgaaggcttcggcggcgatgtcggacccggcgaggcggtccggatcttcaccggcgcgccggtccccccgggggccgatctggtggtgatccaggaggataccagggtgaccggccaccacgacagcggcgcccctgctgccgtcgagatcacgggggagcgcgcggacgcggaggccggggacaatatccggccggccggcatcgacttccagaccggtgcggtcggtcttcaggccggcagagggctggaagcacgggcgatcgcccttgccgccgccatgggacacccctggttgcccgtgcacaggcggccgcgggtggcgatccttgccacgggcgacgagctggcccggccgggggagccgctcgggcccgatgcgatcgtcgacgccgtcagcccctgcctcaccgcgctttttgccgatgccggcgccgatgtcgtcgatctgggcatcgcccctgacgcgcgcgaccggatcgatgcgcagatcgccgccgcgcggggcgccgatcttctggtcaccatcggtggcgcgtcggtgggcgatcatgacctcgttcaggccgcactgctggctgcgggggcagagatcgatttctggaagatcgccatgcgtccgggcaagccgttgatgtacggacgactgagcggcatgccggtgctgggcctgccgggcaatccggtttcggcctatgtctgcagcctgctcttcgccctgccgctcatcgaccggctgtcggggcgcgagccgcgcgatgccgcctcggaacggctgcccctggcggcgccggttgcagccaatgccatgcggcaacactatatgcgggcacgccttctgcgtgatggcgatggcgctgaaacggtgctgccggttcgtgatcaggacagctcgcttctgtcggcactggccgatgcagatgccctgattctccgccggcctcatgcccccgcggccgaaccgggagagctcgtcgacattctccgtctcgaccggctcgactgatctgatgatttacatcttttgttagaatgaattgcattcataagctcccatcagttgtattttcgcgaacaggtgcgaacaagactgaaacgaacagacgacaagcgtcttgacgcgtggcgatgacaggcgtagcctgaaattgatgttgcgcctttgttctgtgcgacaacagtctcgttcaagcagtctgcggttcagagatcggtcggggccggtttttgccgcgcgatcaccgggaggcgcgggtgctcacacgcaagcagcacgaattgctgcggttcatcctggaccgggtgcgggccacgggggtggcgccgtctttcgaagaaatgaaggacgcgctcgaccttaagtccaagtcaggcatccatcgccttatccttgggcttgaagagcgcgggttcatccgcaggcttgcccatcgtgcccgggcgatcgaagtcatccgcctgccggatggcggaccgttccagatgccggggcagagccagggcgacagcccctctacggcaccggccagtctggcctcggccaatcccttcgtcaccccacccgtggctccgcgcgggccgcgtctggtcgaaatcggcatcgggcgggcgcccgtcgccgcgcaagccccccaactccagccccagcgctttcgcagcctgacccgaccgccgttgaatgcgccgccgcgcaccggtcgttcggacgacaacggcaatgtggtgctgccgctttacggcaagatcgccgccggtacccccattgaggccctgtccgacggggaccggaccgtcgaggtgccggcgaccatgatcccggccggatctgagtattttgcgctcgaggtcgaaggcgattcgatgatcgaagccggtattatgaacggcgacaccgtcatcatccgccggaccgataccgccgacaacggtaccatcgtcgtcgcgctgatcgatggcggcgaggcaacgctgaagcgtctgcgccggcggggtcagtcggtggcgctggagcccgcgaaccagcactacgaaacccgaatctaccgaccggaccaggtgaaagtgcaagggcaactgatcgccctcttccgccgctacgcctgatcgcgttccgaacctgggaaagccgccgcccgcacctctgcggtcggcggctttctgtcggaagaagcatccgggagcagatgctcaccgtgtccagggccgatctccgcgcggccccacaaccccctcgatcaccggtcctgcctcgtcgagacgcaccgtcacggcggcaccaccgaagttgcggcccgtacgttcaatcagcgtggtcgcagcgcaaccatccggtcgcctgatatagggggcatcgcgacggggatcggccccggcgagcacgaggtcggcatgggcgcaggcttctgccagacgttcgcgtccacggaccagggcgatacgaagccccgcgcgttcaagccggcacagatccccaccgtcacatgcaacggcttcggtcatgtcgcggattgtgagcgtccccagcttttccgcccactgatccagcacgaagcggtcgcgttccggtgtcatcgcgtaaagagcaccgtccggcccgcgcagcgccatgctccgcccatcccccgacaggaacaggtccggcaggaccggccgggccgccagcagcattccgagcgcaatggccaccaaccccgcccagcgccaggcccgtcgccagatcaccagccacagcccgccgaaggtcatcaacaacagggccgtcacgctgaagcctgcaaccggcaccaccgcccccggccagccggcaacggtggtcgcggtcgcgatcaccagctccatgccccgtgctgcgagcgcaaagcagatgccgcccgcgctttccgaaacgagactgagcaggcttccggtcaatgcgacaggcatgatccagaagccggtgacgggcacggcaaccaggttcgaaaccaacccatagccgctcgcccggccgaaggcataggcggcgtaaggcgcggtcgcagcgccggcgatcatcgatgtcgcgagcaggccgaagatccatgttgccgcccgcatgggcaggccgcgcctcgtgccggcgtcgagaccggcaaggcgccggatggtcgggctttcatagagtgcgatcagagcaatgaccgctgcaaaactcatctggaagctgggaccggtcagggccgccggctgcagcaccagcacgacgatcgccgaactggccaccagtggcagcgacaacaccggccggtcggtcaggatggcgagcaggcccagcgcggtcatcacgaaggcgcgttgcgtgggcaccgcaaaaccgccgaccgcgagataggcagcagcccccagcagggccgccacggcggcaatctttcgtcccggccaacgatccgaaatacgaggcaggaaggccatgaccagccggacggcgccgaagatcagccccgcgaccatggtcatgtgcagaccggaaatcgagatcagatgggcgaggccgctgtcgcgcatcgctgcttccgcctcatcgccgatcgcccctctcagccccgtcaccatggccgagagcaccgcaccgccctcgccaggcgccgccccacgtatgacggcatccagatcgaggcgcaaccgttccacggcttcgcgcgccgtctgcaggatttccgacggctccggggccggtacgatatcgggttgcgcataggcaaaaccaatgccgccaagccgctgaaaaaaagcgcttcgggcgaagtcatgaccgccgggcaccacgggcagcgacggcggtgacagactggcgcgcagccggacgccatcccccggacggggcacaggcccctgccggacggtgatccggacccgtgccggcagatcttctgccgcgacgcggtcgatcgccgtcggaacgatcagaagccgcccgccaccgcggccatcgggctccaccgccagcacacggccggtcacctccccctgagccgggcgcatcagcatcggggcatcgaccagccgcgttcccgtgaccgccgaccagaaccccgccgccgtccatgcacaggcgaagagtgtcagagcgagccagggcagtcgtgaccggagcgcgatgccgagaccgagcgcgccgagcgtgagcaccacccccagccagacgggcggttccgccgccaggccgaaatagcctccgcagccgattgcgaagaagaccgcactccacagccgccatcgatcctgctcggcgatgaaggcgcgcaggagcggcccaccgaggctgcgacggcggccagccgtggccggcgcatctccgatctcatccaccaggctcatgctatccccgctgtctgctgccgaagacgccaagcccggggctgcacccgcggatttttcgtgctaatcagagggccactcgccgtgcccgccgcggcgcccattcgaaagccgtgttccatgaccgtcgtcacccgattcgccccctcgcccaccggcttcctccatatcggcggcgcacgcaccgcgctgttcaattggctgtatgcgcgtcataccggcggacaatttctactccggatcgaggataccgatcgacagcgttcgaccaaagaggcgatcgacgcgattcttgatggtctgacgtggctgggcctcgattgggacgctccggagacctatcagttcgcccgtgccgagcgtcacgccgaggttgcccgcgacatgctggcgcgcggccgcgcctatcactgctggtgcacgcccgaagaactggaagcccagcgcgccgaacagcgcgcggccggcaagccggtgcgctatgacggccgttgccgccaccgcgacccggcgaccgttccagccggcgtgaagccggtggtacgcctgctcgcgccgtcggaaggcgagaccgtggtcgacgaccaggtgcagggcacggtccggttctcgaatgatcagctcgacgacctggtcctgctgcgcggcgacggcacccccacctacatgctcgcggtggtggtcgacgatcacgacatgggcatcacccatgtgatccgcggcgacgaccacctgaccaataccgcacgccagagcctgatctaccaggcgaatgactggccgaccccgaccttcgcccacatcccgctgatccacggcccggatggcgccaaactgtccaagcgccatggcgcgctgggggtcgatgcctatcgggacatgggcctgctgcccgaggcggtccggaactacctgctgcgtctgggctggtcgcatggcgatgacgagatcatctccgacgctcaggcgatcgaatggttcgacctgccggcgatcggccggagtgccgcgcgtttcgacatggcccggctgaccaacctgaactaccactacctgcgcactgccgaggacgcccgactcgtcgacctggtcgtgccattcatcgaggcgaacacgggcaagacagtggacaagaccggtcgcgcccgcctgcttgccggtatggcagggctgaaagagcgtgcgaagaccttgatcgaactggctgaatcttcagccttttataccgtggagccgccgttcagcttcaccgacaaggccgccaggatcctcgatggcggcggtcgcgacgtgctgaccgcgctgaagcccaagctggaagcggccaccgcctgggaagatgcggttctcgaggacatcgcccgcgcccatgccgaagagaccggtctgaagctgggagcggtcgcccagccgctccgggcggccctgaccggcaccaccgtttcgcccccgatcttcgaggtgctgcgcgtgcttggccgcgaggacgccatgaagcggatcgacgccgcgctctgaattactgaaaccggctttcttgcaagaagctggtttcttttggccaaaaataacacggaatttacgtataaaattttctatcaacatatacatttgacgaattttatgctgcgggacatagatgaagcgatcacgaccagggcagggccatcgccctgctccgctcccctcgacacctgcatctccagaggccaggaccgctcctatcgcccttcccgccaatcgaccgccgccgcttcctgaccgccatcgcggggctcggaatcgtcctctcggttcctgccaccagctttgcaacaagtacccccctcaaaattggcgtttctgcagggccttatggcgaaattctcgacttcgctgcaaagatcgccgaccaggaaggcttgaaggtcgagatcgtggagttcaccgaatggacggtgatcaatgccgccctccagtcgggcgatattgatgccaacaatttccagcatatcccctatctgaacgctcagatctccgcccggggctacgacatcgtgccactccagccctcgatcgtggtgccgatggggatctatgcggggcgcgccaaagacctcgacactctgcccgatggcgcgaccatcgggattcccaatgatcccaccaatagtgcacgtgcgctgaagctgctggaactcgccgggctgatccgcctcaagccggacatcgaccaggatgcagcctctcccctcgatatcgccgacaaccccagacatcttcgcttctccgagatcgacgctgcccagctaccccgcaccctgccggatatcgatctgggcgtgatcaccctcaactatgcagtgcttgccggtctcgatccgaaggctgcgctaaaactcgaggacgagacctctcactggacgctggtctgggctgcacgccgcgaccgcgcccaggatgcccgcctggtacgtttcattgagatctaccgttcagctccggtgcgggatttcgtgctcgaacgcttcaagggcagcatcctgccgacctggtaagccgggcttgtcgcatatcccccatccatgacaccctcaggaaccccatcccaagggaaggacctgaggaccatgcaggccgaggacggcatctggaccaacgccgcagagctgtggcaacaacagatggaactggatgccctcggcccgcgcctgcctggcagcaccgcccatgaaaccttcacggagcgcctcgccgatcacctgcacgggatcggcctggaagttcgtaccgatgtctgcaacttcgatctctggcagccgcggtcttgcagcctgcaactgccgggtggtgtgcatattccatgcacccctttcccgtattctggcgaaacgcccgcggatggggtgacggcgcctctgatccgatgtcgcaaccgacgggatcttgccagggcgagcggggctattgcgctgctggaggtcgacatgccggccgtaccggctcggctgctgtttcgcagacgaggttcaaaaccagccgatctccgcctgcccggcctcatcagaaatgcagtgattgcctcggttctgcgggcaccggatcttcgcaaagccgcatccctgggtgtcctcggggtcgtttgtctctggaagggcatgtcagcagagaatgcccgtgcccaacatctccccttcaccacgccctatcaggggtgtccggcgatctgggccgacgtggagacgcgcgatcgtctgattgcacatgccggcgagggcggcctcgtgacactgacgctggccgcagagaggcgacccgctacctcacgcaccctctgggcagttctgccgggccgggatgctgaaagcaccatcgttatcaacacgcatactgatggccccaatgcctgtgaagaaaacgggccgctcggcttgattgctctcgcccgctatttccacagccggccgatcgcaccgcgacggacgatggttttcgtcttcaccaccggccatttccagatcccgcaattcggcattgatcacagacaggcgacctcccgctggctggaagatcatcgtgactggtgggacggtgcggccggtcaccgtcgggccatcgccggtatgacgctggagcatctcggctgcatggagtggagggatacggccgatggtttcggccccaccggggagatcgaggctgagctggtctatgccggcaatgaccgtctcgcccggctctaccacgaatgtcttgccgatcgcagccggacccgatccatcatcctgcgccctcacaaccgattgcacttcggtgaggggcaacctttgtttcaggctggtattcccgcagtcgccctgatccctgcccccgactatctctgtcgtaacggcgatgttcttccacaactcgatccagaactgatgcttgagcagctcagcaccttccgggaagttcttgatcgcctcgatcagcttgacgacccgggcccggttcagcgccagtcctggggattctaaccggctctctttttaaatcaaacagtccggccaatattttcaggcgtgtccaatgcgccgcgcagcgaggtcgagaacgacccgcgctgcccgagcgctgggccgcgccggatcgtcggcgggtccccgcaaccggctgagcgcttccgcaagatccgcacgctgggcatcgcgcaggtctgcacgctctatcagcggggtcagggtccggaccatgtcgtcgggtgtcgccttgtcctggatgagttcggggacgatctcgcgatccatgaccagattgaccaggctgacatggcgtaccgtcaccagccgccgggcaatgctgtaggtcagcgggttgatccggtagaccaccaccatgggcaccgactgtcgcgccagctccagggtcaccgtgcccgatgcggcaagggccagatcaccggctgcaaaggcgtcgcggcgctcggccgccgtcgccaccaccacggccggctgcggcaaggcccagcccgcaacaatggcgcgaacccggtccgcctccgcccggattgccggcaccaccacacgcagcttcggatgccgctgcgccagcctggccagagcttcccccatcggcggcgccagccgggcgatttcgcccttgcggctgcctgggagtgccagcaccaccagatcgtcgggcgtcatgccgtgtgcggcccggaacccggctccgtcgccgacatcgacggcatcctcgaccgcaggatggccgacgaaggtgcagggcagaccgacccgggtgaaccagggcggctcgaaaggcagcagggccagcaggtgatcgaagatggccgcaaacttttccgcccgcttcggccgccaggcccagacggtgggcgccacataatggaccagcctcagccccagtggcttcagacgcgtcgccagccggcggttgaaaccggggctgtcgatggtcaccacaacatcggggcgtgctgttgcaatggcttctgccgtctggttcagacgccgccgcaacgatcggacatgtggcagaacctccagcaggccgaacaggctgagttcttccatcgggaagaggctctgaaaaccttccgccgccatggcttcgccgccgacacccatcagccggacccggccaccggtcatctcgcgcagcgcccggatcagccgggcgccgatcagatcgcccgaggcttcgccggcaacaagagcgatgagcggcccttcggtcgcagtcacgacatttcccccgtgacgaacagccccgcgccatccgcagctgcaatgatcgccggacggtcgagcaccagaacccgccccgccccaagcgccagaccggcaaaaccggccgtccggagctgatcgatggtgtcggttccgatggtcggccagtcgacccggcgttcctgcccgggcttggccgtcttcaccagaaccggtcgcgaccccggccgcgccagtgcaccacatcgggcgatgagggcctctgttccctcgatggcttcgacgcccagcacgatcccctgctgaaccacgaccgcctgaccgatgtcgagacggccaagtgcctgtaccacctcaaggccccggcggatgtccagccgcgcctgatcgtccggcgcatgccgcccccagacgccgggcggtgcatcaaggccgcccgcaatctggtcggccccgaccacccgaaagccttcggattccaggtcggccaccacagccttcagcagggcgtcatccccctgcccgatccgcgtcgccacccgtgccagcagcctggcacctctggcatcgggcatgacggtcgcgaaagatggccgcttcacgccgccggccatcacgaggtcgcgcacgcccgcggccttgagcgccgcgatgatccgtccggcggcaccgatacggatccgggcatgcggcacgtctgcaaagcgtgccggatctccggcgccgtccagcacgaccacaaagacgtcgcggccggcatcgcgggcggcctgcaccaccagttcgggcaggcgcccggcgccggcgatgacaccgagcgtggcctcgctggtcacgatgcgtcgcccgctccgcccttcacccgcgggcgggtcagggcccggtcggcctccgccttcacgaagtcgatcagcgggcgcacggcctccacctcaccgaactccgcctcgacggcagccaggcgttcggcctgagtgccgccatcggccaggaacaaccggcgataggccgcccgcaccgcatgcatgtcctcgcggctgaagccgcgccgcttcatgccgacgatgttgaggccggccagatgggcacgctcaccggtcaccgtcccataggggatgacgtcggcttccacgcccgacatgccgccgatcatcgcatgggcgccgatccgcacccactgatgcaccgccgacagaccgccgatgatcgcatgatcttcgacccggacatgaccgccgagcgtcgcattgttgaccagcaggcagtgattgccgacatggcaatcatgggcgacatgggcccccaccatcagcagcacgttgttgccgatggaggtcagcatgccgccgccctcggtaccgggattgacggtcacatgctcgcgggcgacgacgtcgtccccgatttcgatccggctgtcttccccccgatatttcaggtcctggggctggtggccgatgaccgcgaaaggaaaggcctgaaagcgggccccgatgcgtgtgttgcccgtgacgacgacatggctgtggagcacggagtgggggccgatctccacccgcgggccgacgacgcagaacgggccgatgcgactgccggcgccgatacgggcaccctcctcgacaaccgcactcggatggatctggatggcctcggtcatggtttcatccgtcacgcgcggtcgacgatcatggcggcgaaggtggcctgtgccaccaccttgtcgtcgacggtcaccttcgactcaaacttccacaccgcaccgcggctctgcttcttctcgacattcacacgcatgacatcgcccggcttcacaggccggcggaaccgcgcttcatcgatcgacatgaagtagaccaacttgccttcgctgtcggggccgagggtacggaccacgagcacggccgccgtctgcgccatgctttcgatgatcatcacgcccggcatgatcggcgcgccggggaagtggccctggaactgatattcgttcatcgagacacatttgatgccgactgcgcccacgttcggctttacgtcgaccaccttgtcgatcagcaggaacggatagcggtgcggaatcatctccatgacccgctcgatctcgatcacctcggactgttctgcagaaggcacggtggtttcgctcatctcgatggatatcccctgaaaagtcgccctcgcggattgtttcccgctgtcgggctgcccgatgtcatttcggctcccggtcgcgccgccggatcagcttcgccagtgtcacactctgacgatgccagtcgcgcaccggaaccgccggatagccgccccacaccgccctggccggtacgtcggtgatgacccccgacttagccgccagttgggcgccggcaccgatgttgagatgaccggcaatgccgacctggccgccggccaccacgaaatcgcc

(The sequence listing continues in the following parts.)

What is claimed is:

1. A method of producing a didemnin precursor, didemnin, or didemnin derivative, comprising the steps of:
    a) culturing a host cell harboring bacterial didemnin synthesis genes; and
    b) recovering said didemnin precursor, didemnin, or didemnin derivative from said host cell,
    wherein the host cell is an isolated *Tistrella mobilis* bacterium having Accession Deposit Number NRRL B-50531 with the depository Agricultural Research Service Culture Collection National Center for Agricultural Utilization Research Agricultural Research Service, U.S. Department of Agriculture.

2. A method of producing a didemnin precursor, didemnin, or didemnin derivative, comprising the steps of:
    a) culturing a host cell harboring bacterial didemnin synthesis genes; and
    b) recovering said didemnin precursor, didemnin, or didemnin derivative from said host cell,
    wherein the host cell is:
        (i) an isolated *Tistrella mobilis* bacterium having Accession Deposit Number NRRL B-50531 with the depository Agricultural Research Service Culture Collection National Center for Agricultural Utilization Research Agricultural Research Service, U.S. Department of Agriculture; or
        (ii) a host cell comprising the polynucleotide sequences of SEQ ID NO:42-51.

* * * * *